United States Patent 11,549,145 (METHODS AND COMPOSITIONS FOR INHIBITING AND TREATING NEUROLOGICAL CONDITIONS) - sequence listing, part 55

SEQ ID NO: 1248 - DNA, 368740 bp, Homo sapiens
gggttctataagtaaagatcaagagattaggtaattgtccaatttgcagcaaaggtagttttgctgaggtttaacacagagttttttctagatcataacatctcaataacatttatgcttttctcttgcaatccttctgaataatgagtttgtcaaggctttcttcattttcttactactgtgagtggtgaaaagccatgaatctgagagatattacatttatctgtgttagtatttccagatgtacaaaaccagtgtccaaatgtacactttaatttggccaaattcatttaacattgagacgatgttctgagctcctcctgggactctggtgatgtgcagaggtttaggattgtattcctaaaagacttgctaggaatgttgtagtaattgcaacatacttatataaacgtaaacctgatgactgtagttgcacaatagaattcctactgaagtctttacatgaagaaacactgatgtttctgtcagtcctttgaaaaattggttgatctacatttgatcactttatatgacaaaagctgttgttaaatgacgtgatcctatatctagtatatgaacatagtgagtattcttattatttattaatattatgatcatcatgccttttcttgactctattttttttttctttttttgagacaggatctctgttgcttaggctggagtgcagggtacaatcttggttcactgcggcctcaacctccctcactcaagcgatcctcctgcctcagccactcaagtagctgggatcacaggagtgcaccatcacacacagataatttttgtattttttatagagataaggtttgtcagggcttgtcttgaactcgtggactcaagggactggcctgccttggccccccacagtgcctggattacaggtgtgagccactgcagctggccccttgcctctatttgacgctttctgctcactcctttgcattctttttaaattctattcaggaagatataatgaattacagttgaaagcaaaactatctaaagttgctgacataactcatctagtttacaagtttagtgaaaaatcactcaaactagtccataaaattgaatggttcattcaatgtgaaaaacaaacacacaggtaaactgtggccatgagctggaataaagcaatgaatcaacaggccaagtgccacccccattcctattatttctgagactgtgagttaaggcaggttaaggtggccagaataaaataggtagttttctttctgggaaccgtcaattaaaatttaaaaaatcatttattgactgtatgtagtctctgagcagcgtaatcaggggagtgcatcgaagaagacttagtcatctaagattgaacctgaaaaggaaaattataatttgaaagtaagacaaagaaatataatatacagcataaaaagtagaatattgtaaatattctaagacatttttaagatgggttacatggtgtgtatatatctatgatttaaataccatgttaaaaaccagattaaaatcttattcactgttcaataccttgcatcagatcatgaagtgagaaatgtcagactcagtcataatttgttgagtgattaaataaataaatgaatatatgagtagatgagtaatttcatgagtaaattaaaattctgatcaattaattttcttctttaagttctacaagatagaaaaaaattgtcttctatattgtttcacagaagactatatgtattatgtatttattttctattaaggaaaatgcagtctatttagtggccatgtggagaacattcattcaatcattccacttggtcaaaatcactactttagggtttttttaagagaaagataaaaatattatctatatggacaaatttgtttacctagagtatttaagttgtaaatgaatgtaggaaatgaaattttcaaatatataatttgatcattttgttaatttgaggtaagaattgtaatttataaggaaatacctaccatactacatgagcaataagttgaagaattttcttcacagtacctaccattttaattgtatgatagttttggaaatgtttatatatagtaaatttttaagacctgtatcaccatcatgtttgatggttaagattattgagaataatttagagagctagtaagtggtttaggcaagaagcaaaccctgttttttagtccacagttttctactcttggaagtatgttatgttgccacatagaaagtcaagtttaaggcccctattattattgtactgcagtctagatcttcctttaaatcctttaatatttgttttacatatttaggtgctctgatgttaggtgcataaacatttacaattgttatatcttattgacgaattgaccctttaatcaacaaaataaagtttaaaccagagtttatatcataaataacaaaatagaagaaataaaatatttcaaatgtttaaagacttcaacttgtggtaatgtgtagcattttaccaactttaatatatttacagagatttaaggttgtgctagcagaagtccattttcagaagacttcaaacatctacatataaaagcacagaaatataagtacttcttaccaggtcgagtgatctattttgacaaaactaatgtgatttgtttagatcaattatttaaaaaacaaactgtttactgatggtgaatgactacaacattcataaaactttgaagtgcaaactctatttctttattttgattatcaataaatattgctcctatggagaaaaatagctaggttgcttaaatctgggatataagaattatacatgtagagcaaaattataatttattcaaaatacaggcacaaatgtttgtatatatgcaaatagcaacacaatattcaatcttaataaatgttactgaattccatatactaggctttcttctctaatcatggatttccatatactgggtgtgctcagtctacacctcttctttcaatgggggccggttgtagtaactttcctagtcataacaactctttagctcttaaatgaaaggaatataaggttattttctataaatgcagagatttataagcagtatagttatagtggtaatgtttcaataaaacaaattgtggcttcattcgaaagtgttccagttaaaacttaaaaaaatacttgcagagtatcaaaactttaaggtatactaattgatattacaagggattcccttgtaattttatgtatctgtctatctgtctatctatctatcatctatctgtctatctattatctgtctaacaatcaatcgattgatatatctatcagcataagtcttcagatttgccaattcagacttttactagcaagaagaaaaatctttagaataataaaattttagactaaaaattaatcaaattttaaaagcattatttgttgtcataatcttagttctctcagggttagattattatgtcaaccagtgttttaagttttattctagcttcataattcagtctctcaaactaatgtgtggagaagtcaagtcagagtagcaaaagtgcaaattattatttggtttggaaataccaagtttagtataatttattaaatcaactcaacagatacacagtgtgcttctctttacataaagcaaacagaaaaccttagtttggaatgagagtgacaatatgtgttatattttcatagcagtttgctggcttccaagcacttccacttaactaatcaactcccgttcttccctcagccacacacaccctttctcatccagcatattaccttgtgagtttttgtcaaagcacttaaaactttctggaatattttattctttctcacatgtttaacagttcagtgtcagtcttttctaataaaatttaaatttcatgagatttaggcacttattctgtttcatttattcacaaaactcctgtgatagcagcattaggtgtatatattgattgaacaatcagtgaatcaaggactacgtcactgaatgagcccatattgtttaaattgatcacagtagtacacaccatgattctgcttttacagatggagggaattttccttgggtgaagaatgttgccaactttacatggctggtaagtgggagtgatacagcccaagcctcctgtctccctcttctacagtgaaggttctgctgaaccttccatgtgataatttgtcctgcttaaaaatattttggacacatactgtatttacctaatacaataatacatgaaacttatagatggtaaaattctaattggatcatcaacataaaagtataaggaaaaattatcattagctcatcatcatgaaaatatgaagccattcttttttccccctttttttaaaaattagcctttattttaagtgcagaggtacatgtgcaggtttgttatataggtaaacttgtgtcacgggtgtttgttgtacagattatttcatcacccaggtattaatcctagtagccactagttatttttcctgatcctgttatttgaaaactgacagagtcattcaactgggcacagtctccaagttatctgctgaatgcaactggtacagaataagcacacgaggtggatgactgtggtgaaagagtagctgttcaatctggacaggtttttgcttcctgtgaaaagggaataaaatactaactttcaggattattgagagtcttaaattgatatgtgaattttatctagaacatgtctggtagtagtatgtgccctcaaaatattcctacataccaataacaatatcgatgtttctgaaaataataacaagagacagttaaggaacattcatgatgtcctagacaatttcctaaggattttataaatcttatctcatcctgatgaagcactatgacagaaagaacattttttagagttctataaaggaatggagactaagcctgtaactaaaatgcccatttcacactatgatggagaccagtattttgaagtagctaactaaaaatcaaagctaggattttaatcactacaaattattgtgtatttcccctctatctaaagaacctcaagaaactatccagaacatacatttgttcattcaattcttaagcatataaagacaatatcttcatgatgtgggtgaacagttttgttctctgtatcagaatctgtattgataaataattagcgataagtatatttgagtgaaataacttattaaaatatttatttaatatcaaatataagtaaataactttatctgacccatggaggacactaagttgcataaaatttaattttgaacaacttctaaacaacagaaacaacaacaaagcatctgcccaatttgaatataaagaatattatgtaggttcatagaggaccacttgagttgccttcaaaaatgtaaggaccaacaatgtagattacaactagaaagggatcaagactacgatatttaagaaccatctttccatcatttgattcttcgtgagtgttcaggatttctgtttcccaggtccaagcttcatcatccaccgatgcccaattcaaccaccgtgatggaatttctcctcatgaggttttctgatgtgtggacactacagattttacattctgcatccttctttatgttgtatttggtaactctaatgggaaacatcctcattgtgaccgtcaccacctgtgacagcagccttcacatgcccatgtacttcttcctcaggaatctgtctatcttggatgcctgctacatttctgttacagtccctacctcatgtgtcaattccctactggacagcaccaccatttctaaggcgggatgtgtagctcaggtcttcctcgtggttttttttgtatatgtggagcttctgtttctcaccattatggctcatgaccgctatgtggctgtctgccagccacttcactaccctgtgatcgtgaactctcgaatctgcatccagatgacactggcctccctactcagtggtcttgtctatgcaggcatgcacactggcagcacattccagctgcccttctgtcggtccaacgttattcatcaattcttctgtgacatcccctctctgctgaagctctcttgctctgacaccttcagcaatgaggtcatgattgttgtctctgctctgggggtaggtggcggctgtttcatctttatcatcaggtcttacattcacatcttttcgaccgtgctcgggtttccaagaggagcagacagaacaaaggccttttccacctgcatccctcacatcctggtggtgtcagtcttcctcagttcatgctcttctgtgtacctcaggccacctgcgatacctgcagccacccaggatctgatcctttctggtttttattccataatgcctcccctctttaaccctattatttacagtcttagaaataagcaaataaaggtggccatcaagaaaatcatgaagagaattttttattcagaaaatgtgtaagaaacccgagaggctcaccctaggctgttttgtgatattcatgttttcaggaataagttgtaataattgattgtggttattagataaaattggtgtaaatttaataaataaggctactaaaatgcatcatgtatcaaaatcgatatttcctttcaaaagtttttgaataattttaatatgccattgggtaaaaaaatctggtgttatgaagaagacaattctaatagtacatgttttcaagttaatgactcactaaaaaaaatcataaagcctaaaatattatctttaaaagtattttgtgttaaagttctgttctatattcatccactcttcaacttttggtaagtccaaaataaaaatggtgtcaattaattttcaaaagccatatttagtattacagaagaaatgaaaacattcagttgtgcattcattcaaagttaaatatgagaaatgtatgtttttggaggaccataagaatatgagtgaaatgcatactgtgaaaagatgagtggatttgtcaggtcatagatgaggggattagtaacactttacatagcttcccttttatgttaaagaaaagctctagatacatcatacttatcagcccacgattttactaaaaatgcattcaagtgctttggggatacatttattttattatctgttttaagtggctcacaccctatattccaatttattatcaacttcttctccatacatccattaaggcctttgaggagttaatagtattgtcttgttttgtgatggtgtcatgtatctgaaagatttattttgatggccaatagtaacagccgttatctggtagcttatattgcaataatcagtaatcccaaattcttagtaggataatataacaaaggtttacttctagtttatagtatctttcaaattcagatcgtaagcagggctctctgtactgtatatccttgaaaaataaaatgcaagataagaagccagtcacactgaaacatgattttaagcgttgaccaaaaaaatgccagttggaaaaggtgatgggagcacccacctcaaagcctaagcgactatttcatcttagagctgaacacatcacgtttatgagttcttttgtgaatatggaaataacccaaagtatccccctgcatgccttacctgactgttttggcatctgctgtggaaagagacccttgagctcacaagcaaatgaacaattgataatatttaaaaagcaacccaagtcttcattttgacaataagagttaataatgagtaatgtaaaatatatatttgaaataaagatttgaatatacattatgacttcaagggtcatcacaattaaaggataaagcactcaggtgaaatgaaatcctaatgtacatttgaaaacaaaggaagtcataaaggagttttaactttcagaaaatgatattcatttattttgagtattggaaggtaaatttccacaggcaggaactggttacccaaatgaagagaacacggaaaagtgcacactggttttgctgcctgtcccagtcatttggcccaatgcgttacatggccatacctcctgcagaggcgagggtgttgacagtttccccacacctgcaaaaaaaatggggggatcaatgatgccagtgagtgctgtgaatgatcaatatcgccctaaatgaaaatataaaatgtcagattctgaatgtctgttgctcatgcaattctactatcctgtatcctgtatgtatcctgatacaatgtgcgcatttgtatcagcaattttaaaccgtaaaatctttagcatattgcaacaagaactgtgcaacgttcttcaaatgcattatcttaggcaacactttgataacttcatgtcatggataataatgctccctcattgagcaaatgagtttctgagtttagaaatataatgcaagatagtcaatagtactcagtttggaaacagccatattttggattcctgatgctgtttattgccatgtaagcttcatcttttaacttctcttgtttttgcttatttttattgttgtttgtgtttattgaatatatgtttcatccagaagtgacagtcactccattgagggtaaagattagggaggtttagcctcaacctttacacttttctttgaatacatataacaaagtgaaatttcagttttgaattttctctaaaactcttaaatttcattccaggctcattgatacaactataatgttggctccaacaataaaatttcaccacatatgttcagtttcatttgaagaacatggggatttaggaaatcaatgtctttctatgaattccactgtgagtccaacatggttctccaaacttacacattatctcatcaacctacacagtggcactttgttagaataatcatctttagcatgtatatgagaaacaggaggcaataggaataaatttgttagaagttgaataaaaccaaaatttaattttactccaaatctccttctttagagaatgcaatttattggttacatcctgaaatatatatatatacacacacatcttatatatgcaaaatattatgcataacattacatatataactatattgcatatgtttatatacatatttacatactctatatttacatatgtaatatgtatatgtagatatatgtaatatttatgtatttaagtacttacatatataaatatgtgcaaatacatattaggtattacatatataggatgtatatatattatatcacagaatgaaaccaataaattgcattctctaaagaaggagatttggagtaaatttaaattttggttttattcaactttaacaaatgtattcctattacctcctgtttcccatatgcatgctaaagacgattgttctaacaatgtgctaccatgtgggtatgtaaatgtagatatgtacatatatacatataaaacatataatattacatattaatatgtagtagaattatatatgtgtatatgtatattagattatatataattatctatgttctctaaagtccactgatactcaatgtcatgactcagggtatcagtagaatttagagatgaggacataaaaatgtgttaggagagaaacaacctcacaaggggaagacagaagggaagacacaagggaaagacaaagcacctatttatagtttcttcctgtggcttggaaattttcaccacgtggtggcctaagtttaggaagactactttacatgatcgctaaaagttttaggaattgctgttctagtgagtgaagcagaagttgcttcatctttataacctagtcttggaagttacaaagtatattgtattggctcaaacagtcacaaaaacctgactagttttaaggagacaggtcataaaatgatgaagatttttataatctttagaaacatcaaagtgcctcaaaacccaaaataggtaaaaatagatttagacataaaacaataagcaaaatactacatttaaaatgtcacttttgagagataatatcatactatttgatatatatcaggagccaaaaacataaatttgaattttaaggatccatgtccatcagtgcaaattatcatagtactaggcaaaaagaggaatttcatatggctttcttagcataaaatgaaaataacttggtaatattctatatatatatatatattataataagtcatagaacactagacaaagaatggaaataaagtccggtgatgcttaacaatgggatatatttgagaaatgcattgttagataattaagtcattgtgtgagcatcatagaatgtacttacacacacctagatgacatagcctactacacatctaggctatatggtatggcctagtattcctaggctacaaacctgtgcagaatgttcctatactgaatattgtacataattataaaaccactgtaaatatatatatatatatatatatatatatacacacacatacctaaacatagaaaaggtacaagaaaaatatggtataaatgacataaaatgatgtgtatacctgtgtagggcagctccattatattcttatggggccacttcgtacatgtggtccattctggacagaaatgttcttatgcagtgcatgcatgtacttaaggtaccaaagtttacataaagattgatacatttattttacaattagaattaagatgggaatgatcactatgaccacaattgcttaaaattttgatgaatgtcttttagagaaaaacactaaattaacagatactctattaaaccaagaagatagtttatcaagaccagtctataaaattatgtaacattttttctatgccagcgataatgatttgagaaacatataatagagtacttgataacaaaaacaagtgtataatatataaaaattaatataacatagaatgcaaaaatctgcctcaatagatacaatttaaaagtgtaataaaagacttactagaatattggaaaaagtaggcattctgtattcaaggatgggatcacaatataaccttgtaaattccactcaatacaaatttctaaatatttattttaaagacctaatacagcttactacattattccttattataaattaactaagagataataaatgtccaaaataacttagtaaatgttgaaaagtaaagaacaaagatgagtagttttcctaatacctattgctatataacataaagtcatatttataacatcatcctgatacatcgtaatatacacatctctataatcaaatatagagaaacagttgggacactattgctctcaaaagtcaacttacaatatatgaaacagtatctaataaaggagaaattttatattgaaagaacaaaacatgctattactcgatgtaggaaaaacttgctcaacaactaaagaaaaaaattatatttctatttaaaaatatatagaaactagacttcagattaagacttaaatacataacgtaatgctatagagttacttgaacgtaatagaaaataatctctttctcataaagtggaagggacacataacttcaacagcaaaagattaatgaaatatatttaattacataaaaattaataatatttatctagtgaatgacatcatgggcaaacaacatactaatacaaattgaaagaagataatttgcatctcagagacaaataagccaataaaacctaaaatattcaatgtattcctacacatcttaggatgcccattttaattagtaatcagataattacttaatcagagaattaattacttaatcagagaattacttaagatgcccagtttaatttgtaatcagagaaagggcaattaaacaaaataaaatattactttagatccaataaattagcaacatttcaggagctgaataatgctaaatggtgcaaaagatgtgaatgaataagaacgcttggaactacatttgaaaacatgatctgatgttggtatctttcttttttttttttttattttgagaaagtctcactctgtcatccaggctggagtgcagtggcacaatcttagctcactgcaacctccgccctctgggttcaagcgattctcctgcctcagcttcccaagtagcgaggattacaggttcatgctaccatgcccagctaatttttgtatttttagtagagacagggtttcgtggtgttgatatcttgaagagcaatctgctggtgtctaggaaatttatattttcatatcaattagaagtcagcaattctgcctaagcccatttataccaaacaaattctcagaaaggtccagaataaagaaaataatccaaacaagttaaatattatttttagttataaataagttatcaataataacatggaattaaagcacaaaattgtgattttttaaaaacaaagccaagatttaagtagcttacgatggaaaataaagcataaagaatgcttaatgcatttttttttgacatggggtctggctctgtcactcagcctggagtgcagtggtgagattatagctcatggcagcctagaactcctcagctcagtctcctgagtagcaaggactgcaagtatgcgccaccacacccaacacatttttaaattttttttgtagagatggggtcttgttatgttgcccagcctggtctcaaattcctggactcaagtgattctcccacctcagcctccccaaatagtaagattatagatataagccactgtgcccagcctggaatgcttaatactgtaaaagcaaataaaataatgacacaagataacacatcttcagtaacatcaagatttgtttataagctacagaaataaaaaccaggtagggggttgggggaaagaggagggaaagcattaggacaaatacctaatgcatgcgggagttaaaacctagatgatgggttgatgggtgcagcaaaccaccatggcacacttttgcctatgcaacaaacccacacatcctgcacatatatcccaggacttaaaatacaataaaatttaataaagtagaaaaaattattaatatatacacatgaaatataaatatatatgcacatacacatgtggaaatagaaaaaatgcgcacaggatttgacagatatttcacaaagcaacagttaaacacatcaaaagtcatgtaaacattagtaatcaaaaaggcacattgaacaatgatgcacctatcaaattgactaagacggaaaagtgcatagaattcagtcctggtacatgtaaagtttattgctgtgatgctgtaacacaagttgaaaacatttttggacagggaatttagtttatggatattaagaaatttgaaaactttgtatcttcttgcaaatcactttaggaaaaaacacacttagagaatgctatctgggaaaggtggcgggggagagtatacggaaatgttggtcaaagagttaaaagttgcagttgtgtaggataaataagtctagagatctaatgtatagcttgatgactatagctaataatattgtattgtacactgggaagtagccaagagagtaggtttcaggtgctcttagcacatgtagacacacacacacacacacacacacaaagtaaagatggacatgcttattttcttgactgtagtaatagtaataatttcactatgtatataaaaatatgttgcataccttaaatatatacaataaaaagagaatcctttgtacataagctattaaaaatgtcaaacaatttatcacttagaaatttgaacacaacctaaataaccactatttggattttaattgtggtataattaatttgataggatatcaatgtctagtcacatatatacacttaacctattttaaatagaatagatttaatgtacaaaagtggttacagggtggcacaaagggctggagggaaggctgatgcagcaaggagccgagtgttatcactcacagaccaggagttgtcaccagtggcgcctcatatgctcctcagtgctgagctgatggagaccgcacgcccagggctgcttgtgtgactttcccatgctgatatgcggcaacttagatgccctgcatccccacaaatgcagctgaaactgactgtaagcccacaactccctcaggacccctgctgcctgcagttgctgctgctgccgccacagatcatcaccagaagcaggaaataagacacagtttccttctttctcctgctctccagtgttccaccagggcctgccctctcatagccttacaggaaaccaggtagcacaggagtcaggacaagctctctgcgggctgaagccctagaagtcagcggagacaccagccctaaagtgtgggcccaacaaacagaagacagacaccatctggacaaacgttttcatgaaaagacttccgtgacatggtaacatgatcaacatcattctagaacacacgcacagaaaacggttcagaaatacttgtctgcaagatccaagagggtggagttgcttccacctagttacctattttattccaactgtctgctacatggtgtacacttcataaatattcatagtatgaagtcaagacatgaattttaaagttttgtttctatctgaactattacattatggttgatttttaaattttatttgtactagactgtgattttagattttttagtcatatcaatatttaaaataaaaacaaactttaaaattaaatgcatcactaaagtaacagagcttgcaggtgaataacagaagaaagaacataacaagctaatgaagagtgatagcaatgaagatgtgaaaaagacaacctcaattttagtatggagttcattactgatcagcgatactctctttgacacatcaactgaactctgagtttcaaagcctatatttgtgaaagattggaacacaaatagcaatattttataaaaatttcctaaagtttaaaggaggaggcacatacacatgaaaatattgtgtaaaacacaaaaggccatatataactaactcatatatcataggtaaaaattcattagtaatggctaactttgagattattgttaatatttgttgagattttcagtttaacaataaaagaagattaaataacaacaacaaaacagctgggcacagtggtgtgtgtctgtagtaccagctattcaggagagtgatgtggagggggttcacttgaggccaggaggtcgaggcctttgtgcactgtgatctcacctgtaaaaatctactgcactccagcctgggcaacatagtaagattctgtcgcttaaaaaaaaatgagaagaaaatcagaaaagggcaacagagatatctattagcttctttagctcctttatttgcattcgtcttcaaaaccccagagaggacttattaacagaaaacttttatctacacccctaatggacacagtgaagccagggatgatgtcacttttgtttttctttgcacacttaagccagccacacaccatgagcccctccaaatgagggtcaagacatcatctgatggtgagttacaccagataggtagacagtattgcaggaacaaaagatggtcacggttcttgacttgttctgcttttgaaacatttctattagttcttgactgtatttcctcatttccctctatcatctatttttatggagaaaagccaatctgttttatttttcctttgagtctcattttatataatacttatttactgcaacatattagtaaacgggtttttcatttccaaagtatttatggacaaaatcatatatattcttcctctgttattgaatgatacatttgttttagtgggatgaaaattttgcagaggaaaaacaactaatttttctttgaatggaaattaggtcttagagttagaaaacactagcaacaaatgtttcaatcatatttatgtttccctggtgaaaccaatagtgagttatctaaaacccaaattttagtctacggaagcaggactgtgtccccaagagaactgaggtaagtgacatgctctgggtcccgcacctgcaccgatgtacttactccatggggttagctgtgtgatgttagatagataccccagaacttgaacttttaaatctgtaaatggtgaaattagattatatacctcataggttcttgaggaaaattaaatgtggtaaactggcattaagaacaattcctaggatactgtaagcttcacataaatgctcaatattgccctaccaccactattaattattccctgggttaaacatgcattgtgctgtttggaaactcaagcaatgtgatcaagaaaaataaaagaaagaaaaagtccagttgtgctgcatgctgcagtcacagttttccctcactgatctggtgtcccaggtcagctgttcagcgtggcttaatgacagggacttccatttacaaaagtgcagcagagatttgcccagcatccacctcccatcccgcactgccctcttggtctccctccattcacttagcaaacagctgcccagtctccgcatctaattattattctccaaaacttgaaaatattaataagtctaattagaattattaaaagaattcaaaatgtatttgaaacttggaaattcttcctgaaatatgactgtatgataaccactgctaaagtcttccctgaaaaaggaccctatattttcttcctattgataaatactaaaatttaacaacatgtcagaaatcgaaaagttgcaaagttttaatcttcttaagagaaaatgtaggagttatcagtgattctcttcagaaaggttaaatgtattttgcttctattagccttgttaatgtagctcatagctattctaatctgaagttgtactttaaatcatgtttatatgttttttcctgaatagactgactgtgacctcctcaagcttaatcaaatataatttgtctttgattcctgcactagctaacacagagtcaggctgtgagtagcaagatagaggaaggaatttaattgaagtgagagacatcttagtgttttattttcttttctgcctcacagtttccgtgaaaaaattcactgtagcaggcaataaagcagatatttgcaaaaacaccaaaagccttacctggtaaatagcagggagtttctaaatcccagttatgcccccctgagatttaatgcgaatgacaggagctttaaggagttaagcttggagaagcatgcactagtcacaaagaaggtggattctgcataaatctctgctcaacatgaaaataagagacataccttacattaatatatgcatttctatttgtaaatatgcatatacaatgtattcttatatttgtaaatctgcacatatataaaaatgcatatctataaatttatataaaataaatgtaaactgtatacatacaagttgtctgggactagagaaattatcaaatccaaattcttacaagtctgactaaatgataaaatcagcaaactgaagtaatgaagctcatatcataagatgattatagtaatacagtctgcagaataatttgtgtagatattaactctttgacagtgtatgtatttgttcatttgtaactggtaatattctaagcactttcattacttttctgcatttaatcttcatcaaccctgaggtcaaaccttttcttaccatctatttttatgtgcagtaaacagaggaatagcaggtagaggggaagctgggtccaccctgcagtccagccacggtccctgggctcctcaccccatgcgactctggtttctgaggagtctggtgtgtaggaggaccctggcttgctcatggggatgtgtggggttttgctccacgaaaccacagagcctcacagcattgtccaatactgtgggtagaagggtgcaaatgtttggtatggattttccacaagtgatattttagtcatgttctaaatcattcctatatggaatacacttttgggagtttttaagattccagatggatccttaaaccagagaatgtaattcactttagacttctctaaacaactctaaaaacagggggacaaaattctcctttgttttcaataattcactattcatgtctgcataaggcagtgacactgccagtttccaggacttgtttataacagacactctcatcgggaaatctcatgactcagaactgtggcaacttcactacaaatcacccttttgatccacagttgtgaattcttagttcctggtaaattttttgaattgcagataatttataacacccaaatctacaggcccatgggcctttctttggttagaacacacacacacacacacaatttgtttcagaggctcaaattactttaaccccaagctttcctttgtggcctaggtgaaacctcatggacaacatcacctggatggccagccacactggatggtcggatttcatcctgatgggactcttcagacaatccaaacatccaatggccaatatcacctggatggccaaccacactggatggtcggatttcatcctgttgggactcttcagacaatccaaacatccagcactactttgtgtggtcatttttgtggttttcctgatggcgttgtctggaaatgctgtcctgatccttctgatacactgtgacgcccacctccacacccccatgtactttttcatcagtcaattgtctctcatggacatggcgtacatttctgtcactgtgcccaagatgctcctggaccaggtcatgggtgtgaataagatctcagcccctgagtgtgggatgcagatgttcttctacgtgacactagcaggttcagaatttttccttctagccaccatggcctatgaccgctacgtggccatctgccatcctctccgttaccctgtcctcatgaaccatagggtgtgtctcttcctgtcatcaggctgctggttcctgggctcagtggatggcttcacattcactcccatcaccatgaccttccccttccgtggatcccgggagattcatcatttcttctgtgaagttcctgctgtattgaatctctcctgctcagacacctcactctatgagattttcatgtacttgtgctgtgtcctcatgctcctcatccctgtggtgatcatttcaagctcctatttactcatcctcctcaccatccacgggatgaactcagcagagggccggaaaaaggcctttgccacctgctcctcccacctgactgtggtcatcctcttctatggggctgccatctacacctacatgctccccagctcctaccacacccctgagaaggacatgatggtatctgtcttctataccatcctcactccagtggtgaaccctttaatctatagtcttaggaataaggatgtcatgggggctctgaagaaaatgttaacagtggaacctgcctttcaaaaagctatggagtagaccattttgagagtaatttacttttccttctctctgcacttcacatatgagaatgttataccagtgttatttcccagactccaagactgccatggtgtttgatctcattttcacacctcttttagaaatcgctttcctgtactagaaacttttcaatttacactccgtctcacttcaaaatgcattattcagtcatattatattgatgttacagttactgaagttcataactactttctaattctataggatattttcatattctgggaatacataatgatactacttagaggataaaggttataaggcataaaattgagagagagggagaaatgaggaagaaaaagggttcatatagatgttctttgtactacttttatttatgctaattttctgtaaaattgaaattaattttaaataaataattaaaatatgtcccctccctcccaccttttttgagcagtacacatgatataatatcttagaaaacttgctgattgcaatgtagttattcactgctgagacaatccagccatttgtccacccttattggaggctgtcttggcccacatggttggttcctgaaagattaaggtctgttattgaggttaacagtcttcatcaagtgctgggttttgaatcccgaattccgttaagagactgtggaaaacatattagcctggggtgaaaagaagctttagagaagatttccagcacaaagtgacatctgagctgagttttgaagtatgtaatttattagacaaataagaagaggtagagtatcaaatatccaattgttcatttatccagtaaatatttgttatgctatattaaatctaaaatattcactaaagaaaattcaaaggtgaatactacatactgctttccccaagaaatttgaactagtaattctgtgtgcaaataggtgctataaagtgtatgaaatgctttgatgcacatgtggaaagggtatagctcattctggcacctcgcttcttcctgtgctgtgcacattcaatcaagcagaagatgctgagtgcagccccaggagctcagtgttaaaggtgcctagctgttcccctcagataactacacatggctggggaagggggagggactttgtcagggatgtgattatgcctgggaaaaggcacagcaagagcaaaggtcagacaattgaccaagcaggagtggcaaatattctaatcgtgccttctttcctgttttattttgtggaataattccttgctttctgtgacccagatgtttacaaacagtagaaaatgatcagtcttgcatttcagaaatattactttggtgacaatagattggagaagtgcaaacctggtggcaggcagaccaggtgagtgaggatggtgaaatgcacgaactcagtggaacgatgtgtaccttaccaccaggagggacttagggagaggaaatgtttggggtatgcagggatgtgagactttgtcaaaccaattggattataattacagacctagttgcaggtgtatcattttccaattgcctgtgtccaacttgtgaaaaatcaagtggcttcagatttacagattctgctttcctcttgacaatatgatcctaaacatgtaaaacttaaaatctccacaaaagctctgttagaacaattgaaagccttcacataaagttgcagaaatcaaaatcaacatacatcaataatttttctatgcactaacatcaaactacctgaaaaagaaatttaaaaacaattttatttataatagtgtcaaatcaaacaaacaaaaactttgggataaatttaaccaaaagggttaaatatctacactgaaaaacataaaacattgatgtaggaaattaaagaagacaccaataaatgagaactatcccatattcatggattggaagaattaatatgttaaatttttcatattacccaaaggggtctatacatttaatgacattcttgtcacatttcaatgtcatttttcacagaactggagaaaaaaatgatttatatgaacagtaagaacaaaaggggagcatcacactactttttttctaaatatattacaaagctatgacactcaaaacagcatggtacacgcattacaaaaggcacattgaccagtggaacaggatttagagccgagaaataaacccacacatttatagtcaattgatttttgacaaatgtgccaaaaacacacctgaggaaaggactgttccttcaacaaatgatactggaaaaattagatatccacatgcaaaagaacaaaattgaacccttttctcacaccatatacaaaaatcaattcaaaatgaattaaacttggatataagacccgaaactgtaaagctactagaagaaaatatagggaaaagctctgtgacattggtttgggcaatgtttttctggatataaactcaaactcccatggaacaaaagcacaaataaacaaatcagattatgcaaaactaaaaaggttctgcacagtaaaggaaacaatcaatagagtgaagggacaacccacagaattagataaagtatttgtaaactatattatctgataagggattaatagaaaaaatatatcaggaactcagaaacctcaatagtaagaaaataaataacacaatttaaaaatgggcataagacctgaatagacatttctggaaagaagacagacagatggccaacaggtatatgaaaaataatgcttattatcactagtcatcagggaaacacaaaacaaaaccacaatgagatatcacttcactcttgttagaatggctattatcaaaaagacaaaagataacaagtgttggtgaggacatggagacaacttccctccctcccacctccaactttgagggtacagtgggctaaactgaagaatgcatgagctgggggaggcagaggatgctgggtcctgtctccccactctcggggccgactccttgacctgatacaggcagaacaggtgaggccccgaggctttaccttgactgagagctctagctgtgagtaggatctaggcatgttagtaacgactgattctggactgaatgtgctgggaggtcatttgaaagtctaggaaggttgaaaaaacctcatagcttgaacaggcatttgaatgaaacctcaaagttcttttgtgcttgtaacttgaagacatttgctctttggaaatagcatacacatatacagaccatctatatggtatacacagatgacaaaggtttgtgctctccatagtttcttttcttctttatttgatggatttattctttcttgcacacctgtaattatatttctcttgacaccttgctgtatatcaacttcttgagttacactccttgtcaatagttgaaaagtttctgtctttcagcttccaacaaatttgctgacgagtcagttgctgctcagattttttaaaaatcaattttatataagtagttctttctatctggtgactgcaaaatgttaacttgcatttactctgaaaataattcatgtacatattttaacttactgttacaattgctaactgttgttaatgtataatttctataaatgtatatctattgcgttgaatatcagagtattaatttaaaagtggtactttttacatatataactaggagtggaatagcagggtaatataataattctatactttgtgttttgaaaagctgtcaaactgttttcaactatggctgaaacattttgcatttccaccagcaatgcatgagtcttaatttctccatattctcaccaacacttattactgcttaatgagtaaggggttttacagcttgggatcgtggaaatgttttggaactagaggttgttgttgcccaatattgtgaatgtataagataccactgaattgttcactttaaaatggttaattacattgcatgaagttcacttgaataaattatttttaagtggcgctgtttgtttggaagactatgagagaaatttattttcacatagggttatcccatggaactaggcaaaatcttgagaaatagtatttccaaataattcacaataatttttcaacttattccaagaagacaacttctctaaaaacatgtaacataatgggcctggtcagttcttggttgatgctttgactctttcagtgtttcttattttaaaacatgattttaagtttcagttttggctgggagaaaataccctgtctaaagctgtatttcagcctcttgctttcagatttaccaaattgtctttgtttgacttaaaaaaaatttttagttgtctgtttccaacatatttgcattgttgatttaaaaaaactttgaaaagcatgtgtgttcatttgagaataattttagctcatttttgataggggaagtgtataatttattttattagttctaagtcctccttatttctaaattttatttttatgaaataacattttaaatgtgcttcaaaatatttccacagggcagtgtgtgtgtgtgtgtgtgtgtgtgtgtgtgtgtgtgtgtgtgaaaaataatcatacattttatttagagtcggtttcctttcacagaaaattttcattagctcttatgcatgaaaataaatagtcaaatgatttacagttttaaaatgtgacctgtaaattcaaaaatgtttaaaaatcattcagagttcctattataatagatttgtatgataattttaaaaaaaatttttttttgagagtttcactcttgttgcccaggctggaatgcaatggtacaatctcggctcactgcaacctccacctcccgggttcaagcgattctcctgcctcaccccctcactagctgggattacaggtgcctgccacaatgcctggctaattttttgtatttttagtagagattgggtttcaccattttggccaggctggtctcaaactcctgacctcaggtgatccgcccactttggccttccaaagtgttgggatgacaggcatgagccaccatgcctggcctgtttgataattttaaaaaatgttgttaccatccacattttactcaatttttataaaacttatcttttattttgtttttcagaataatttgttcaatttaggcttgtttcaaaacatatttatttaattttgcaattatatttcggtaaaggaaggaaaaagaacaatgagcattccagtgtgacaggagacatgtaactgcagtaaacaaacagctccatgatggtgacagagctaccgggtgtagaaggtacacattctaatagctatggttattcccattccacagatactgattaacgagtttcacaaaagatatgttgagaatgaattacttcagtggtagagtaagcagagatgaattacaaaagcttttagtaaatacagtcagccctctttatccgagttctgcatgtgtggattcaatcaactgcagataaaaaatattcagaaaaaaatgttctgaagttccaaaaagcaaaacttgccatgttctgagcactatgttgaatcaattccaatgaagtgatatatagaccttgcatgaggtataataagtaatctaaagatgatttaaagtatgtgagaggatgtgcatagcttacatgcacataccgcagcattttatataaggcacttaagcatcctcaggttttggtacctacaaggtgtcctggaaccaaaccccacaatgaataccaagagacaaatgtgtttttaaaacaaatgagaattggtcttgcagggtcctcaccaagtgaaagatcactccctgccttatggaggtgggagggaaataggaaaaattgtattaagtaaatgtctaccatgaagtcataaatacgatttgttcaaaatacttaacagtgaaatttatattttgaaaacatcatttaatattgaaaagaaaaattagggaacggctagtggaataaaaattacatagaagaatcaggacaatgaagtaaacttacataggggaaaagggaaatcaaaatcatttggggccaggcatggtggatcacacctgtaatcccaacactctgggaggcggaggtggaagtattgcttaagtccaggagttcaagactagcctgggcaacatactgagaccccatctctacaaaaaataaaacaattatcctggcatggtagcaggtatctatagtccaagctacttgtgaggctgatatgggaggatcagttgagcccagaaggttgagggtgtagtgagccatgaatcataccaccacatttcagcctgggcaacagagtgagactctgtctcaaaataaaaataaaaaaaatcatttgtaaaacataagtgaaatgaatttaaatacaagtttcaaatcagtatacatgaacgctaatacaattttcttgaactagagagactgtacaaggaaactgtgcatctggacattgctgtaatttttttttaacagggtcttgctctgtcccctaggctggagacaacctccacatcctggcttcaagggattctcatccatcagttttcagactagctgggattacaggcgtgggccaccacacccagctaatttcttgtatttttagtagagatggagttttcctatgttggccaggcttgtcttgaactccaggtctgaagtgatccacccatctcggcctcccaaagtgttaggattacaggcatgagccacggcatctggcctattgctgtaattattgatcataactgtggtcattaatgcatatatttttgttaagttgttttcttggtttaattcaatatggcttagggatatggactgcatatttcaaactttgtagaattctcttgagttttgttatgtggctgagaacattttatattgtacaggaaattcataacttttgggcaatgattttatcattccttgaagacttctgccctgctcctcttaaagggcacattgcctgctccatccactcctgagtgttcttttcacctggagtgacctgatctgcctgctctaggctttagaagggcagaggtaatgtgggtcatttctccacttctaccccaggctcttgagtgcatctcaatgtcaaggtttattaaacagaacaagaaaccgttcttcctttcccgaaataaattaattctccttttagatctcacaaataagtgagaacatgcaatgtgtgtctttctgtgcctggcttacttcacttaacatagtgacctccagttccatccatgttgttgcaaattaaaagatctcattattttttatagctgaatagtactccattgtgtataagtaccacattttctttatccatttatctgttgatggatacttaggttgcttcaaaatctcgactattgtgaaaagtgccacaacaaacatacgagtgcagatatctctttgatctcttttcctttattttgggtatatccccgggggatcgatggatcatatgatggctctgtttttagtttcttgaggaacctccaaaccattcttcatagtggttatactaatttacattctcaccaagagtgtacaatggttttcttttctccacatccttgccagcatttgttgttgccttttggatgtaagccattttaactggggtgagattatatctcattatagttttgatttgcatttcttttataatcaatgatgttgagcacccttttctatgcgtgtttgcaattcgtatgtcttctttggagaaatgtgcattcagatcttttgcccattttataattacattactagatttctagacagttgtttgagctccttatatactctggttattaatcccttgtcagatgggtagtttgcaaatattttctcccattctgtggattgtctattcatttcattgattgataagtttcctttgctgtgcagaagctttttaacttgatgggatcccatttgtccatttttgctctgttgtctgtgcttgtagggtattacttaagaaatctttgcccagaccaatgtcctggagacttttcccaatgttttcttgtagtactttcataatttgaggtattagatttaactctttaatccattttgatttgatttttgtatatggcaagagataggggtgtagtttcattcttctgcatgtgaatatccagttttcccagcacatttatagaagagactgtcttttccccaatgtatgtacttggcatctttgattgcaaatgagttaactgtaggtgtgtggatttcctttttgggtctttatgctgttccattggtctgtgtgtctgtttttgtgccagtatcctgctattttgtttatatagctctgtagtataatttgaagtcaattaatgtgattcctctagttgtggtttttgctaaagatagttttgtctattcagggtcttttatgggttgctataaattttaggattgttttttccatttctgtaaaaaatgtcattggtatattgatagggactgcattgaatctgtatactgctttagatagtatggacattttaagaatatttatttttcccattcatgaacatggaatatctttccatttttttgtttcctcttcaatttgtttgatcagtgttttatagtttttattgtagagatctttcacttctgaggttaagttaatacctgggtatttaatgttattcatggctatgataaatgagattacattttttcatattgttcactgttggcagatagaaatgcttctgacttttaaatgttaattttgtatcctgcaactttactgaatttgttcatcagttccaagaggttttggtaacgtctttaggtttttccaaatataaggtgatatcatccacaaacaagaataattttactttttccattccaatttggatgccctttatttcattctcttgtctaattgctccagctaagacttccagtgctatattgaataatagtagagaaagtggacatctttgtcataatctagaccttagaggaaagggttttagtttttccctattcagtatactagctgtgtgtctgtcatatatagcttttattatgttgagttatgctccttctatcttcagttttttaatggtttttatcatgaagggatgttgcattttatcaagtgcttttttttaacatcaatttaaatgatcatatggcttttatccttcatctgttaatatgattcatcacattgataaatttgcctatgttgaaccatccttgcatctcagggataaatcccacttggtcatgatgagtgatctttctagtgtattgcatgccaattgtattctccagctctagaatttctgcttgattctttttaatgttttcaatctctttgttaaatttatctgatagacttctgaatgccctctctgtgttagcttggatttccctgagtttcctcaaaacagctactttgaattccctgtctgaaaggtcacatatctctgtttctccaggattgttccctgttggctatttagtttatttggtaaggtcatgtttttttgaatggtgttgatgatagtagatgtttagtgtctgggcattgaagagttacgtatttattgtagtcttcactatctgggctttttgtacacatcctacttgggaaggcattcaagatattcaaaagtacatgtgtgttgtgatctaagctgtgtctaccttagggggcacactaagcccagtaattctgtagttcttgagactcattgaggtaccgccttgatattcttgaacaagatctggatgaattctacagattaccagacaaagattcttgttctcttcccttactttctcccaaacaaatgaaatctttgtctgtgttctgagccacttggagataagagtggagttatacaagcaccaccgtggcaaccaccactaaaagtgccctggttcaggcctgcagctagcacaacactgaatctcagccacggcctgctgtaaccacttcctgactaccactcatgtttgctcagggcactgcagctctaaaatcagcaggtgacaaagccagccaggcctgtatctttctcttcggggtatcaaggtcccgtaggccccaggaaggtccagaggtgacatctgggagccagggacaaaagtaaaaaaccttagaaatctacccgatattctgttgtattgcagctgagctggcactcaaaccacaagatactgtctttcccactctccccttccctttcaaaagcagaggagcctcaccctatggccacggccagcacatgcccatgggaagtgttgccagtctactgctgatgttccctcaaggcccaagcgctcttcagtcagcttgtggggaaggctccttggcttgggactcatccttcaggacagtgggctcccctctggcccagggaaggaccagaaatgctgcccaagagccaagtccgagaattgaggaaaccaagagcccacttggtgctctaccctcctaaggccttgctaatacctaaagtccaagacgaagtcccgtttactctttcctccactttttttttttaaagcagaaggagtttcaccccatagccaccacatgtgggaatgtgctgagtctcatctgtgagccagtaatctcagaggctcacctaaggtcctcaacgtggtacctgggtatcactgctggttattcagggctcaagggcccttcagttagcaggtgatgaatgcttccaggattgggttcttcccttcataataacaggttcccttttggcccaaggagtgtctagaaatgtccacaatctggggcctggagctagggggtggagcaatgattagatcaatgatgaaattctcaaagctttggcacagtggtactgattagttgtagcgatttctgatgactctgattggtgccctctcctgctgtggctgagctgattccaagatgcaagaaaaagtcctcactctttcttatcttctcaagtggagggaaggggttttttaggagccacaaactgtgcagcctggggctaggggaggggttccagcacccccttacttgctctggctggtgtctcagtaggttgtgtccccccatagtccacaggctctgggccaggtcagcacttggactcatttaggagttgtggtcattgtggcctggtttctttttctcatgtttcttttaaggccccagagcactttagtccatggtggaaaggcttgcaggaactcaagttcagacggctgggattggtaattgccctcgggctagtctaaatgctccctccatggatgggcatcagctgagtttggtccagctttgttttctgctccagcagagcagcgctgagttcaatgactcacgattgctgtgctctccctctccccagagcacagaattgctctctgcaccatgctgatgctgctggggaatgaggcaagggtgcatttgcaattcacaattgtttttctatctcttcagtgcttctttcagcaatataaagttaaggccaggtacagtgagtgctcacctgatttttgtttgtataaaggtgctttttgtgtgtaggcagttattaaattggtgtccttgcagtgggaacaattgggggagccttctattctgccgtcttgttcctcctccttccaaattttgattcctttaaaataacataactgagcttattatgcctgtcatgattctcttttgtacatataaagtgtttccagttatggctacctaatattgtcattgtctatgtttgcattttttactttacaactcatatcctctctttctctatatacacacacacataaatatatatttatgtacatataaatatttgttacatttatatatatgtgtgtatgtgctaaaactaagatgtaggcattttcacatgagtagtatcccttaaaaaaaactaatagaagttgccatgtatatgaataaggaaatctgaggtggatggtggaaggcgcagagagaggcaatctgaaatggaaaagagtcaagaatccattaaacctttaagtcacattgtttccttttcttggaactaacattgacacaaactattttacatgctgtttcgttttctttaggttttacgattaaacacatttaaagcccagttgatatctctacagttaaaaattgaatgtgtatgttatgatgtgtcacaagataagtagcaaaatataactaacaaaacttagcaggcaaaaaaatagaatgttggaaaacagcacatatgcacgtgttaatttcatcttttaaaccaggcatagatttatcatttaaagttgatacatcggtaatacaatataatttacattcatatatattactatgagaagactaaacaaaaatgattcataaccgtacaccttatgcatcaagagaatgcaaccaggccggtcacagtggctcacgcctataatgccagcagtttcgggggccgaggcaggcaggtcgcctgagctcaggagaatgagagccacccatcgagtataaagtgattttcatcaacttcatctcttatcatgtgttcaaaagggttttgtagcaatagtttccataagttggatttttacactaacctgttcatcaagagcctgcctgatatattttcttaaaagattgtttggtacctttactgaattggcaattaaaagtttttcttagtgacatttagtaaatgagtgatgtttattgggaagctgcttaatgcaagagaaaaatgaaaagattagatcatgactattgttaaagtgagaaattaaatgaccacataaaaaacttctcttctcttccttgggtatttttccaatattactcatttgccctctagggaaacaaacaacagagttttgtgatgaaacatgcattaaacagctgttctcaagctgttaattaaaaacaaaacaaacaaacaaactgcagaggaggcagcccaggcatttgttgtggaacacattctctgcttgccacttacatgttttgagtacagttttcagtacccatcagaaccagtttagttgatattccttctggattattagaaggagttttctccatgagaaatctcaggatgtttatgatgtcacatactagattacttaaactcttccctctttggttcctggagctgtgtgcacagtgctgaagtatgacatccatgccttcagttaagtggtcatcttcaaatacctctaactggcactctctttttttttttgaagcttttgccttttaacctggatctcctctcatcttttcaaggaaagatactaatatgaagacagaaaaaaagaagatcaagaaggttcccttttatctcttgtttctaaggtctcacctcttgtgaagttgtttgtaaacaattttgtctttacctaatattcctctctctggatatattatacctgtaagtgatccactatcatcaacttatatctccatactcacagtaagaaagccatttggctctcttagataatgtgtgtgagtaggagaaaaacaaatagggaagttcactcatttaagataattcagatattttgtgcatgttcagttcccacaaatgtgatatcttctaagttacagggaattaggtaagatgatcaaaataattaaatcgaatgggattggaaggtaggaattttggtggaggtatgagtaattggcatgtttactttaagaagatttgattgaaggaaatgaattaagcataatccaggagtacagaggtaaatacttttaactgaactaacaaaggaaagactagacaaaaacttagttgtcaaaactaaaaacataggttactgttgaactgttcctgaatactgtcaaactcttcatttagcacacttaaaaatacatttttcagggaaaagtggaacttttacaattaaatggagtcaccagttgggcatcaataaccatggaaacacttgaggaaggctgtacattttctgttgtttcatctataaaatacccactcatgtatgtatttaatttttttaatttttaaatttttttcaacttttattttagattcaggtggtacatgtgcaggtttgttagctggtaatattttgtgacggtgaggtttggggtgtaaatgatcccatcatacaggcacctagcatatacccaatagttagtttttgatccttgcccctctatcttccttctagcagtctctattttctgttgttgccatctttatgtctatgagtatataaatgttgagctcttattcataagtgccactcacttatttaaaacaaacatcactttcttgaaaaaatgtttaaaaatggtcaactaccctgatagcattttgatagattcagtcactcttttgtgaacttattttattgattgctttttgtgacccattttggacacactaagagacagtatctgaaagacaggaacattcttgctatcgtgtgatggttggttggtcagatgttgtcagtctggctatgttgaaagcacgggcataacacttcctgtgaggttagaagggaccaagtggcctacatattcctattgccttctggactgcgtcattagcttgctttcttttccaaagatcagttttatttgcatttaagtggtcttcaaagttagccacttgtcacaatgcaatatcatagaagatatcaaagcaaatcttctgtcatttgtgctctcaaattattagtatgagtttgaaatgggaaaagataaagtgttctaggagtaatcaattgatgtatagaccacctaatacatacaaggctgtgctaatggctgttgatataaggactatttagaggatgactctaccctcaaagagctcatattatatttgaggaggcagaagcatgcagcaaataaaaacaacaaagagagttgtagaaacaagttgaagaggtgtcatgagggcaagggcagcatggggctcgcccctgtcagagcgcgtcacagaaagactcaagatgtcttcattaaactctggtaaccatccgagtgtggtccatcttatttggaaaggcatgaaatacaaagttcatagtatgtgatgagtaaaataaataatcagattcacggatgctctggtaaagtgtattcctgattcttcaatctccattcagttcagcaaaatctcctgattgctctaccttgagcttcatttctgcctttgggcgcatttttttcctatcccaacccaaaactttccaggctgactacacgtgattataatttatctatgcacatatatgtttgtaaacaggcagtgctatgtttcctacttaaaaatatattatgtatatctttacatgaaaagacaactaagctacaccattatcaatgagtataatgtaaattgagcaatgtttgatttagtcaacccattaatgttgatcattaagattgtttctagtttattttcacaatcaatggcaataatttatttaatgtcttcatatattattcccacttcatactatttatttcctcagaataaactgatgaaaatggctaaaagatggattttttaagtttgctaaatgccagacgcttacagaaaaaaatggtttcaatttgtacttacactagcagtgtgtgatgttccccgcttcttcacaataaaaatcctaatttattgtcattactttagcattttttcagaatacaaacaacataccttttcattaaagagactcaaacatcataaaaaagttttcataaagaaatgtatttatttcttgtacttaagtttttgagccacttgatctggagtgtgcgttttaaagtcttactctttacctctaagttgcaattttgttttcttcatatatataaactctacctttcccagttatccgaattctcatcttacttgtgtgaaacatttgcgcatatgtgggtttttttgtattttggcgggagacagcagtgtttatttccagatactcttccgtttagttgttgagccttgttttttctattcagttactcatcctttacatttcacactggtcctacagaggtcaaagtcaatttttagcattgtttttccccagacaattcatatgtgtttgtcctttcagatcaaatttataatcattttgacaaattcctctagaataattttctattgctttttaaattaatactgaattatttagttttataaatgttctccaaaagtttagcatattaccagttattttaccatttttattgttattatatagaaattttttttgtgtctgggtgcggtagctcatgtctgtaatcccaatactttgggagaccaagacaggaagatttcttcaggccagaagttcaagaccagcctggacaacatggcaagaccctgtttctacaaaaaatacaaaaacataagctggatatggtggtctgtgcctatagtcccagctacgcaggaggctgaggtaggacaattgcttgagcccaaaaggttgaggctacaatgagcagtgatcgtgccactgtgctccagcccgaggaacagagcaagttcctgtctcaaaaaggaaaagaaaaagaaaaagaaatatttttgttgatatgttgttgatattatgagtaactacttgttcatatatgctggggcatttgacattgttattaaaaccataggggattcctgcaagaagtataagtgacctgagacctgggtctacagtaaccagatgaagagagaattgtgctccaggcagagagagctcctgagtcaggctattttctgggagagaggtgccaggaattgacagagtgctgcagagtagagagctgagtatccaggtcacttagggacatacaaaccacaatcaaaacttgatctttagctcacaaacaaccaagaatctttgaagggggatagaatgggaaaagagggagtttatatgaacaggtttgaagatgtgttgttattaatatacttctgagttcaataattaatattcatttgggaaatatttatatatgtgaacttggtttataattatgagagttttctgtcttttgaaggctatatatatttataaaataaatgattaattaattccatttttttgtgtacaaagatttttaaattttctgtccttagaagatttttatgggatgttttctgaactaggaattttgggaaagcagaattccattaaaacttttaaattgttccaaatttagagatcttctttggtattttcttttttttgatttatttttatcatactttaagttctagggtacatgtgcacaacgtgcaggtttattacatatttatacatgtgccatgttggtgtgctgcacccgttaactcgtcatttacattgggtatatctcctaatgctgtccctccccccacctatatgtgtgtgtatgcattatatctacttataattatatatgaatattaagaattttaactgtatgtgtgtatgtattatatctacttataattatatatgcatattaagaattttgactatatttgtgtgtatgcattatatctacttataactatatatgcatattatgtgtatgcatgcactcatacaaaactatactttaaaatcgtcttcttcattaaaatttcaaactatattaatataatgttaaaataacttctcatactataaatattttatcactcttctcatatctgtagttggatcatttttcttacttttaatgatgttttgtgtcatcctttctgccctcaaatatcattagcatggccagaaataggtctattttgtttcagttttaaagaatcaactttaaatattcagtctgcttattttaaaatccattaatatctatttaagtcttttatatggtctttctcttatttaaatgtattttgcagatatttttctaatgtattgggttgaatctttattaacatcacatattttttctataagaattacattattagaggttataaaattttgtctggatacatctttagctatatcctataggcttccatacataatatatttaatttaatgaaagtttgaacttcctttggtctaagtagtgttttaggcatacgttaaagtatttcaaattctctgatttagatgtgaacctattattatgattttagaattctaatatattttagtaaaaaaaaaaaaagagattgtcctatggaagctaactgaatatattaagcacataatgcatttccatttaaaatccaaattacagaattgttctctttgttccatttataatatcacctcatattgtagtttatatatactatgtcattcctttttgcatttttttagttttcttttccattttgtacattttgttttgttttctttgaagagtaaatctacactttgaaagcggatgtttactctgaatgatgttgtagccatgattaacctagttgtttctatctcatttcatcatatgcttcgcgttaatttcctgtgctgttatgcctttttttctttcattattttaaaccattttaatagacacccaaacacacatgtacacacatacaaacattcttttaactcattttaataccagtaactgatttggttaatctttttcaaaattgttcttattcttatagttgcctctgtgttggagtcataggctccagaaaaaaaaaatgtatttttttttctggctcatttacttagaaaaaatgttagattcttcataattgtatatgtttttatttataatcagccctttgccctgtatgttccaagaaagagggaatattgttaatggtatcttctgctcctagaaaaatgtctagtgaatactggatcacaataaatacttgaatgtataaatacataaatgaatgaaagctgctttctggtacttcttaattttacattctatttaaatagaatttgttttgcatgtatagtattagcattccattttcagaccctgttttctgtatagacagagataggtatgtctgtgtctacagattagatgtcatagatatatatgtatctatctatttctacatatatatgtctttgttgataagaatcttttgagttctatgcaataaggcaatcatatttacattatttttaaatatatatatatttaacctgaattcaacgtttactgttagtaatattacagtttcttcccttttcttaattttgtttcatctacaaaaatattcagctgtatcttactgtttatcccccctaatttatctcagaatgtcttcctgtttgagccacacattactctcaactaaaatgtatctaatgatatcgataataagttttactgaacagatagcacattctagatactagtctaagaaactgatgtgtgtgaatgatgtaaactttgaaacttgggccctttctattattacagagcaaatgggggaaatggatacaaaagtaatttcagtatccgtggccacacaatttggtggtggagaaagggtcaaacccaaggaaattctggctccagagctctctctttttactgcaacattgtatatcttcagtttagacattttttcacttttatttggaatttatcaggaagacacctgtggtcagtgtgaattttagcctgtgtaggtgactgtgttttccttttcttgtgttttgtttgcatgcaactatgtttttattagatgctgccagatgcttttacttcaaataactttcccagacacacacagtgtatttattaatgaaatgaaacatccatatacagagtctttttgttcctttcccaagttttccttttcaatttttattaataattctctcctatttgtgaaatcactctttttaaaacactgattatttatattttgcttttgtaattccaatactccatgtctacctttctttctttctttttttttttttttagatggagacttgctttgttgcccaggctggagttcaatggtgcaatctcagctcactgcaacccctgcctccctggttcaagcgatcctcccacctcagcctccagagtagctgggactacaggcacccgccatcatgcctggctaacttttgtagagacagggtttcaccatgttggccaggctggtcttgaactcctgacctcaggtgatccacccactttggcctcccaaaatgctgggattacaggggtgagccaccgtgcccggcccatgtctatctttcttaccatttaatatctgcctttctgcatcctggagagctactcaagttttatcctccacaaccctaacaaaattttatgtcttcagcgctcttctttgcagcctttcttgtaacgtctcatcctggaactgtttttaattgtcatgggtaaagcaccgcacttgcctgagtgtgttcaccctctcctgaagtgtttcctagtgttatcatcatggagaaagcactgcactagcctgagtgtgctcatcctatcctaatgtgtttcctagtgttatcatcatggagaaagcactgcactagcctgagtgtgctcatcctatcctggtgtgtttcctagtgttatcatcatggagaaagcactgcactagcctgagtgtgttcatcctatcctgaagtgtatcctagtgttatcatcatggagaaagcactgcactagcctgagtgtgctcatcctatcctgatgtgtttcctaatgttattgtcatgggtaaagcactgcactagcctgagtgtgctcatcctatcctgatgtgtttcctagtgttatcgtcatggagaaagcactgcactagcctgagtgtgctcatcctatcctgaagtgtttcctagtgttatcatcatggagaaagcactgcactagcctgagtgtgctcatcctatcctgatgtgtttcctagtgttatcatcatggagaaagcactgcactagcctgagtgtgctcatcctctcctgaagtgtttcctaatgttattgtcatgggtaaagcactgcactagcctgagtgtgctcatcctatcctgaagtgtttcctaatgttattgtcatgggtaaagcactgcactagcctgagtgtgctcatcctatcctgatgtgtttcctagtgttatcgtcatggagaaagcactgcactagcctgagtgtgctcatcctatcctgaagtgtttcctagtgttatcatcatggagaaagcactgcactagcctgagtgtgctcatcctatcctgatgtgtttcctagtgttatcatcatggagaaagcactgcactagcctgagtgtgctcatcctctcctgaagtgtttcctaatgttattgtcatgggtaaagcactgcactagcctgagtgtgctcatcctatcctgaagtgtttcctagtgttatcatcatggagaaagcactgcactagcctgagtgtgttcatcctatcctgaagtgtttcctagtgttatcatcatgggtaaagcactgcactagcctgagtgtgctcatcctatcctgatgtgtttcctagtgttattgtcatgggtaaagcactgcactagcctgagtgtgctcatcctatcctgaagtgtttcctagtgttatcatcatggagaaagcactgcactagcctgagtgtgctcatcctctcctgaagtgtttcctaatgttattgtcatgggtaaagcactgcactagcctgagtgtgctcatcctatcctgatgtgtttcctagtgttatcatcatggagaaagcactgcactagcctgagtgtgctcatcctatcctggtgtgtttcctagtgttatcatcatggagaaagcactgcactagcctgagtgtgctcatcctctcctgaagtgtttcctaatgttattgtcatgggtaaagcactgcactaccctgagtgtgctcatcctatcctgatgtgtttcctagtgttatcatcatggagaaagcactgcactagcctgagtgtgctcatcctatcctgaagtgtttcctagtgttatcatcatggagaaagcactgcactagcctgagtgtgttcatcctctcctgaagtgctccctaatgttatcgtctgtttctgctcccattgacattgcgggaagctccttctgattcatcaggtcctcacgaggagctcgttagatgagatgctacccattagatggaggatctgcattttgggtggacagtggacagaataaatcttcagcccgtttttcccctcaccacctgatccactcagcctcttctaaaccggtaagcaaaactgtgcagttatgtttgaatttttgttgaaagagaaggaaaaacttagaaaggaaaagtttcgatttcttgttagctagcatttttccttgtgtctgtgtatttctcactttcctaaatgaagtctcctgttcactgtgctgagaacactccttcaagaacctcctttgttggtctacttgcaaaactctaccctttttctccataatttcttggctaggggagggtaagaatggggaaagcagagaagcagaccctgctgcagagaaaatctggcacagagacacacagccaatcctttttctgagtggttcacgccatgagagaccttgtacatgtgctggccaaaaccgaagaggcttttctctactgaggagtcgctagggttcatctttttctagtactcaagatttttaattttcagtatagataaaaaattgaatcgtttctgtggtttcgtgagcatgtactgagaagtttgaaacaggccaccctggagaatatgtagacacttgcaaattattttttaggccctgttgttcatgtaatgctattacctaacatcttgatagtcactgtttaatctgagagtgaacttaggaaatgacagtcttcttcctggaatcagttttcccagaaactagtcttttacgagtccatatcttttgctaaaagattcctctaatggcaattatttgcatgatcaggaagaatgttctgagattttatcattttaaataactcacaagacaatgcacaagcctgcagccctgcctagttagtgttcaacaggtgacacataattttagagtgtgtcccctagtgctcaacaggtgacacgtgctttttagagtgtgtctcctattgtttgtgcctgtggtatacacacagtagctaagaaatgcaatattgccttcggcaagatattgtgtgtcctcattatcagcattctctcacaagcgcaacagcttatcatagattagcatttgaatttactcagctgtggtcctttgcatatgttacatgacgtttgatcatgacaacatcccgtaagtttcctgtgatatcctaattatagatcaggaaacgggctctaagtttttaagtaatgtgcattagggcacattgcaaatgatgaagccagaaccccaaacaagcattctcagtgcaagtatttcagaattgagcaaccccctactccaaaacggtgttctggaagctggctgccggctctgtgcacttactgctacatcatctgcctctctgtctggtgtaacacctgagtgcacacagaagggtccaagaattcgaaattcaagttggatttcaaagagtgttaaacctgatgaggaaacttttaaaagatattcttatattcatcgtgtattcaagatgtgaatgcaccacccatagctatctaagattgtgtatggtttcctgcctctggcctacaagatcttttatgcatttccttcagtcaccatctccaaggcttacgactgaccaaccaaatcaggaagttttgagtgaaatgaggaggacattaggacagaaagcacaacctggtctatcccagtctaagccttcaagacccacaaaaatacaacactaagcaaaaacaaaaaatgactcaaatgtaccaaagagataaaaagaaaaaaacagaaagatcataatgaacatgttaaagttaaactgttacatgttacaaactgcaactcaattctactgataacacttagaaaataattctgttctctttaccccggcctgcataccttgaagaactgatcactaatatctcactgtcttcatcacttgcaattctcttcctgaactgacttttgtttcctgactatcccaaactcctttttgctttagggatgtcacatttgctatttattttgtaggaacaccctagccctaaatcttcacatgaattttcttttatctttcattgtctgtgttgaagttttccgcaaagcccttatttgcattacctggaaccatggttcccacttttgatttactgtgcttatttcataactagaatgtaagtcacatgattcatattctttttatttactacagtatccccagagcttagaacactgcacagtactctctccataaataaagattaagtgtgcaaatggatgagaaattgacaaatggtgagggaacacataagaatgaccaatgatcaggcagataatgtaatcatgtttattacagttcaacatagttttcagttgtgtctacaatttatggttatttctggatgagaccaataggttttaaaattatcacagaaattcccaatttgagccaatggcctattgaattattttattgggttgtttgaattgattggatcaatagtctttcagttgtatccacattttaagtaaatggagccaactccaaatgaaggatcctctctagggcccagattttcttcaatcataatgaaactcccttaagccaagtatcaattgccaaacattcattcatcttcatcccatggggtcctaatgttgaaattattcttcatcaaaaagaaatagccaagaaaaaggaagctacaaatctaccacaccaaaaaaagttttatattagctacataaaagattttaatctaataatgtttacacagacatgtttaagtgatttatcttttgtcattttcattgaccctgcttctcttcttatgcctccatttcaaactcagtaccatgaatgaaaacaatgaaaccttgaccagaggctttaccctcatggggctcttcactcacaataaatgctcaggattctttttcggtgtcatttgtgccgtcttcttcatggccatgatagctaatggggtcatgatcttcctgattaacatagaccctcatctccacacccccatgtacttcctcctcagccacctctccgtcattgacacattatacatctccaccattgtgcccaagatgctggtagattatctcatgggcgaggggaccatctctttcatcgcctgcactgctcagtgctttctctacatgggctttatgggggctgaattcttcctgctggggctcatggcctatgaccgctacgtggccatctgcaacccactgcgctatcctgtcctcatcagctggcgggtctgctggatgatcctggccagctcttggttcggtggggctttggacagttttctcctcacccccattaccatgagtctcccgttctgtgcctctcaccaaatcaatcactttttctgtgaggcacccaccatgctgaggctggcctgtggggacaaaaccacctatgaaacagtgatgtatgtgtgctgcgttgcaatgctgctgatccccttctcggtggtgactgcatcctacaccaggattctcatcacagtgcatcagatgacatcggctgaagggaggaagaaggcctttgccacctgctcttcacacatgatggtggtgacattgttctatggggctgccttgtatacgtatacgcttccccaatcttaccacaccccaatcaaagataaggtcttctctgccttttataccatcctcacacccttattaaaccctctcatctacagtctgaggaacagggatgtgatgggtgccttgaagagagttgtggcaagatgttaggggacatgtggtgtgatgaggaaagaattctgatggtctaaaacctccacatcctgttcaggcatatatggggtcgtatcatggataccacggatgatgctgacaggaactttcaataccagctgtgctaaatggtgtatcaacagtacccccatcaaaaatgggaagttgctgtaacagtcacacacaaataatgccagagttctagaaacaccactcatgtttattcttcttttgtttctactgattccaagtcttctctcatatcacttctctgattgcagtttgtgtatatgaatgccccaaaatgttgagttaatattacatattctgcccattttcaatggctccataagaactggtgattttgactatattgtttaaacaatccatcaattggcttgtcaaagatttagggatgccaaggtttgaaagacatatgaaagagactaaactgtcataaaactgtaaaagaaaaatctacatagacttacaccaagatttagaaaatccaaatatctcttctttgagtaaccactgaaaacactcctcctttatctacatttggagctaaaaaaaaatgaatcatgtgttttgtagaaatgccaagactaaatctttatgggggagggagtctgtaatgttagttttttaatatggtaactaactgttacattggaagacacagcaaaaggtagttgagaaagaaatgccctattaactagcagtttctgtaatcactttacagcttcttctccaattcactagcatttttaaacttttgggatccctgtgcagatgttagtgttgttggagctatttctaccaacttttctcttttaaaaaagtagtagacagcgtcatatttttccttctctatagcactggcttttgcattggatagcattgcaaagtgggaaggaaatacccagcttttcatgtgaaaattagaactggaaacccttgtaaatgacttagtgtcatgagcggtgcaaagttagaaataaccaggaccacaaatgcttgtgtctttccacaatgtcaggattttattgatgctgtttcaatcacaaaagccaccatgagctacatagagttcccaagggggcaactctccttagtacttttcattcacttggtagtcagcgttgtgggcacacagactcaagccactccacaagtcagtcaatattgcaaaccatacataatagtatacttaatcaatatgtaaatgttataggtttaacatttcacaacaaacaaactaacatttaacacaagaaggaaaagggataggagaaaggatcacaaaccagtccaaggggagagaagaagagaaaagcggtcctggtccaggccgggtggtccactggtcttgcaagaaagagtctctgaggtggcagagacttcagcagcagatgccaagttttcatcaccagtgactgcaagatggcatcagttaacatggctatttcgagctgctgaaggcctgctcttttacggttacagagtcctcccatgagaactgatcatggaagagtgtgcttgtttgagtccttatctggttggatacagtcttttattttttaatttgtttagtagacaacacatcttatccttgttggaaaagtgctctatgaaatataaaataaagtctttttctaagatggagttggctacgtcaagggtgttctatacacttagtatgatttctttttaagtggctaagaactggagaaaaaatgtttggcctaaactgtagacacagtagtaaaaaccaggaccacatcccaaacccctcaggccacctctacaagctgctgtgccaggctttgtactgtcattggtttaacaaaatccaagccgggttcagtgacgttctgcagcgactgaagatggtgggtgaatgaaagatagccacacctccttttgtactgaaaaaagctgctgggtatttgacaaaatatttagccaaatagaacagctcaacttggcattgggctgagcacttaatcaagaaaatagaccaggtcttgcctaacagagcagggttttcagttgaaatccaggaacagcttttccgaggctcttcagctggaggctcaacatctcctcaatcttgtcagactgtcttggacaacagtatgtgccagataatatgagggagcatttccaaccaagaagatgttgaggtacaaaaaacacaacaaatcagaagagaaggagagggctggcccataagaactgatcatcagtttcagctccacgtaaacaccatgtgaatttctgtcaatcatacaatgcttctgaggaccaactttcttttttataaaatttgacttaatacatactttttttcttgtaagattttaaaatcaagtaaaatgatgaatgtaataaaaccttataaatgctagtcattatttcagctattctttgaaaagatgattgacttttatattcagtttttacaatttctttcatttctatcgatccgttacagacaaaagcacactctcttgtacagccactttggaatacagtttgacagtttcttacaatattgaacataatcttatcatatgatctggcaattgtgtttcttggtgttaactctgctgatttggaaacttatgttcacagtagatttttcatacattccaaaacatagacttaatcagaaagtccttcagaaattaaatggataaagtgtggcacatgcatacagtggaatattatttagtgttaaaaataaatgatttatcaagccattggaagacatggaggaaatttaaatgtatattgtgaagtgaaagaagccaatctgaaaaggctgcatactgtgtgattccagctgcatgacatcctggaaaaaacaaaactgtggatacaggaaaaagataagtgttgcaaggggtctgggggaagtatggatggatggacagagcacagaggacttttagagcagtgaaactattgtatatgacacagtaattaatgttacataagattatgctacatggtactatgtatttgtggaaaaaaacatacaactctggaacagaaagactcatccttatgtaaaatatgaactattaataataatgtatcaaaattgattcatctattgtaacaaatgtactacactaatgccagatgttaacaatagggaaaagagaggggatatataaaaactttctgaactatccattcaattttttggtaaacctcattgttctaaaatataaaatttcattttaaaacagttttctaacaattatataactctctgatactatatttcttgattggatttcagtcaataaatcattaggagttctcatcaaagaattgtggtgtttgtagaagttaggatgggggatggggatgaaataataaaagtttgttaatctaattggtcttgttttgggagtttggttatatgttgttttgaagacgcgggagcagtgaggctaatatttcctggaaagttagaagaacatgggccaaatattaattagttttatgcttggggcatatggtaggagcccctcattccaagttagcattccttccctgttctgcatatataagaaaatactggaaatgcatcatctgtatatggaagagggggggaaatgtctatattacctcacaccagaaaaccaaaacctattaaaagagggatgctgcttcaggagaaggcctttttagagtgagtgaattttttttaaagaatttgattattcatgacccatcattgggaatttcatctcgagttcagatattcagcctttgatggaatgtgaagccacttgtgggccatttggccatccctgcaggaaaatcagttcaaaactcagcctgactctgcgggaaacctcttagaaacatgtgcttcccctggttggaaccagctagcaaaatgcataatttgtgctcaaagaagaattagtaatggctagaagagagattaatttttcttttagctctcctagtaactcagtctaccatttggatgactctgttgccttagcctgagtttctacttaagtgaatagggaatactctcctagatatggttgttgattccctcagaacaaaattaacacggcaactatcaagtcatgcacaacccttttggaaacttgaggaagaacgtgagcaacatttctaaaggtttttgtcactattctgaaattcataatgtcataaatatatgtcattttattactagactttagaaatatgtaggcgttgtgtagcacagagtgatttttgatatgaattgatgttctcaagaagtcaatggttttacattaaaaaatgcaggactgtgcatgggaaggagtgtaggtggaatgattggggaccatagagcaacaggagtctggcgccttctaggacctatccagagatattcagcctgacaagcatcaggcattcacaatgatgctcaaatgaaatgtgaagaattattaatgcaggagaagaattcaaggtagttttgtcaaactgatgagtttttggtacatgctagttgcaaagatcactgctaggtttttggattgctgtgctgaggatttttctgaggtcacatgtaggccctgtgggaagagtgatgtaaactaattagccaggatggacacaggtgggtgcctcgggatgagttctaggacgtggggtgccacattggctgtagtcagctcttacccccaagtgccatctaatggtttatagcatagcagttgcacagcaagaagaaataaaaagcatctaaataaggaaaagaagaaggcaaactatgtctgtttgctgataatatgattcaataccccccaaaaaccaaaagactttgccaaaagattcctggaactgagaaacaacttcaagtaaagactcaggatacaaaattaatatacaaaattcagtgacatttctaaacaccaaaaacattcaagctgagatccaaatcaagaactcaattcaatttacaacagccacaaaaataaaaaatctaggaatgcagttagccacagaggtgaaagatctctgctaggagaaccacaaaacactgctgaaagaaagtaaataagactcaaacaaacagataaacattccatgctcactggttggaagaattaatctcattaaagtggcccaaggaaatctacagatttaatgttattcagaaaaaactacagactttatttttcacagaattagaggcaactattataaaattaagatgaaacaaaaaaagagaccaaaaagccaaagtaaccctaagcaaaaagaataatgctaaagatatcacaatacctggcttcaaactatactataatgttccagtaaccaaagcagatggtactggtataaaaacagacacatagaccaaattgaatcaaatagagaacaaataaataaagccacagacctccaccctgtttatctttgacaaagttgacaaaagcaagcaatggggaaaggactccctacctaataaatggtgctgtaatagctggatagccatatgcagaagaatgaaagtggacccctgcctttcactatatacaaaaattaaatcatgatgaaataaagatttaaatgtaataactcaaactaagaagcctagaaggaagcctacaaaaccccattctgaacattggccatgggaaataatgtatgactaaatcctcaaaagcaattgcaagcaaaacaaaaattgacaagagggacctaattaaactaaagagcttttgcacagcaaaagaaactatcaactgggtaagcaaacaacctatagaaagggataaaatagattttctagtttatttgcatagagatgtttatagtattctctgatggtagtttgtacttctgtgagatcagtggtgatattccctttatcatattttactgtgtctatttgattcttctctcttttcttctttattagtctgcctagcattctatctgttttgttaatcttttcaaaaaaccagctcctggattcactgaatttttgaagggattttttgtgtctctatctccttcaattctgctctgatcttagttatttcttgtcttctgctagcttttgaatttgtttgctcctgcttctctagttcttttaattgtgatgttagggtgtcaattttatatctttcccactttctcctgtgggcatttagtgctataaatttacctctaaacactgctttagctgtgttccagagattctggtacattgtgtctttgttcgcattggtttcaaataacttacttatttctgcctttatttcattaattacccagtggtcattcagaagcaggttgttcagtttccatgtggttgtgtggttttgagtgagttttgtaatcctgagttctaatctgattgcactgtggtctgagagactgttacgattttcattcttttgcatttgctgaggagtgttttacttccaattatgtggttgattttagagtaagtgttatgtggtgctgagaagaatgtatattctgttgatttggggtggagagttctgtaaatgtctattaggtctgcttggtccagagctaagtgcaagtcctgaatatccttgttaattttctatctcattgatctgtctaatattgacagtggggtgttaaagtctcccactattattgtgtgggagtttaagtctctttgtaggtctctaagaacttgctttatgaatcagagtgctcctgtattgggtgcatatatatttaggatggttagctctgcttattgcattgatccctttaccattatgtaatgtccttctttgtcttttttgatctttgttggtttgaagtctgtttaatcagagactaggattgtaaaccctgaattttttttttttttttttttttttgctttccatttgcttggtaaatcttcctccatccatttattttgagcctatgtatgtctttgcacatgagatgggtctcctgaatacagcacactgatgggtctttactctatccaatttgccagtctgggccttttaattggggcatttagcccatttacatttaaggttaatattgttatgtgtgaatttgatcctgtcattatgatgtaagctggttattttgcccattagttaatgcagtttcttcatagtgtcaatggcctttacatttttgtttgtttgggcagtggctggtacaggtttttctttttcatatttagtgcttccttcaggagctcttgtaaggccggcgtggtagtgacaaaatctctcagcatttgcttgtctgtaaaggattttatttctccttcacatatgaagcttagtttggctggatatgaaattctgggttgaaaattttttgatttaagaatgttgaatattgacccacactctcttctggtttgtagggtttctgcagagagatccactcctagtctgatgggcttccttttgtgggtaacccgatctttctctctggctgcccttaacattttttccttcatttcaaccttggagactctgacaattacatgtcttggggttgctcaatcatctaatctttgacaaatctgacagaaacaagcaatagagaaaggattccctatttaataaatggtgttaggaaaactagctagccatatgcagaaaattgaaactggatcccttccttacaccttatacaaaaattaactcaagatgaattacagatttaaatgtaagacctaaaaccataaaaaccttagaagaaaacctaggcaataccatttaggacataggcgtgagcaaacacttcatgactaaaacaccaaaaccaattgcaacaaaagcaaaaattgacaaatgggatctaattaaattaaagagcttctgcacagcaaaagaaactatcctgagagtgaacaggcaaccaatagaatgggagaaaatgtttgcaatctatccatctgacaaagggctaatatccagaatctacaaggaacttaaacaaatgtacaagagaaaaacaaacaaccccatcagaaagtgggcaaaggatatgaacggacacttttcaaaagaagacatttatatggccaacaaacatataataaaatgctcatcatcactggtcattagagaaatgcaaatcaaaaccactgtgagataccatctcacaccagttagaatggtaatcatcaaaaagtcaggacacaacagatgctggagaggatatggagaaataggaacacttttacactgttggtgggaatgtaaattagttcaaccattgtggaagacagtgtggcaattcctcaaggatctaggactagaaataccatttgacccagcaatctcattactgggtatatacccaaaggattataaatcattctactataaggacacatgcacacgtatgtttattgcagtactattcacaatagcaaagacttggaaccaacacaaatgcctgtcaatgtcagactagataaagaaaatgtggcagatatatgccatggaatactatgtagccatttaaaaaaatgagtcaatgtcctttgcagggacatggatgaagttggaaaccatcattctcagcacactaacacaggaacagaaaaccaaatgccacatgttcccactcataagtggaagttgaacaatgagaacatatgggcacagggagtggaacatcacacactggggcctgttgaagtgtggggggcaaggggagagagagcatcaggagaaatacttaatgtagatgatgggttgatgggtgcagcaaaccaccatggcatatgtatacttatgtaacaaacctgcacattctgcacatgtaccccagaacttaaagtataattttaaaaattcgtttaatccaaaaaagaaagggataaaatattcacaaactgtgtatgccaaaatggtctaagatctgcagtatataaggaacttaaataattcaacaagcaaaaacaaacaccgccattaaaaagtggccaataccatgaataaacacttctcaaaataacacatataattggccacaaacatgaaaaaatgttcaacatcactaatcatcatagaaatgcaaatcaaatcacaatgagataccatctcataccagtcaaaatggtcattattaaaaagccaaaaacaacagatgctgctgaggttgtggagaaaaggtaatgtttatacactgttggtgggaatgtaaatcaattcagccaatgtagaaaacagtttgtaggtttttcaaagaacttaaaacagagctaccatttgacccagtaatcccattactgggtatatacccaaagaaaaatagatcattatgccaaaaagacccatgtacttatatattcaacaccatgctattcacaatagcaagacatggaatcaacctagttgcccatcaatggtagattggataaagaaaatgtggcaaaaaaaaaaaaaaaaaagaaaatgtggcacatatacaccacgaaatactatgaagccattaaaaaagtatgaaatcctgtcctttgcagcaatatggatagagccagaagccatcatcccacgtgaattaccacaggaacagaaagccaaatactggatgttcctactcacagatgggagctaaacattgaacacctggccacaaagatggcaaccattacatcctagaggtgggaggaagggagggggtaggtgttgaaaaactgctgggtaccatgctcactacttgagtgatgggatcatttataatccaaacctcagcatcacacaatacactcaggcacatgtacgccatgaatctcaaataaagtggaatgaataaataaataaataaaatgattttttcaaaagaagttaaataaatgaatagtaaaaatataaaagttggccgagtgcagtggtgcatgcctgtaattcccacactttgggaggccaaggcatatggatcacctgaggtcaggagctcgaggccagcctgtccaacatggtgaaaccccatcactactgaaaatacaagattagccaggcgtggtggtgtatgcctgtagtcccagctactcgggaggctgagacaggaaaatcacttgaaccctggaggtggaggctgcagtgagccaagatcatgccactgcactccagcctgggcaagacagagtgagactcttgtctcaaaaaaaaaaaaaaaaaaagttgaagttaaaaaaattaattaacctttctaggaaaaacaacagaaaacattaaatctagtccttttacatcagaatttccagatctgtgtgtttgtgtttatttatttatagatagatgaaatgattgatatatagatgtgaattgataatataaaaaatgataatatttttgaggtgcaacttaacaaaatcaaaactttaaaaatattcacacaaatgaattaaataatattgactgaggaaaagtcgatgaagaaaacttccaaaatctatactcaaattagacataaggatttaatcagcacattattttttagtcccctgaattaaaactgtatgtatgttataaaaatggagcattaattaaataatattgagcatatccataaagtatagtactttgtggatagtgcatgctacgtttgggagaatatttcacatcggggcactttttatgttgtattttgtgaacaatgcaaattgtggaattacatgttaacccacagacactcatcacacacacatatatgttgttgtgtaaatgccatatctatttatagtgtttaagtttctgcatgtgtctctctgttggttctctacctcttgtttagttacataaagctcttgtagtttactggtacatacacacacatacccacgaacatacacacaaacaaacacatacagtataaatgcaattttgtaaggataatcatctctatgatgtgttttcgataaccctatctggtattatgtttttcccgatgggtatgcgttacctttatgctcaaataaaataataattattaaactaccaacaaacataacagatgttatgttattaaaatataatagaaataaagctactttttatctttttaatggctttccacatttgttcccacatttctctgtgaggaagagctgctggcagaactttctgatgaaacactcaggaaatcagttttacactttgaagcacaggagttgaaacatgttctcaaagcccatgtcacttaaatgttcactgttttccaccccatcaatacacttctcattagctgtaataagtccgtctcattaaagtctcctgagatccaaaaggaagaaacttgctctttcccagagcacttcattccatgtccctcaaagaaaactatttaaactcatgcctcttttcaatctgggcgctcccttgtcgctccagggatctcaaaagcagaacacccagaataattcggcactctttactggtctgctgctttcttcctgcatttttagtttttcagacctgtttagttgctaaatatttccctgtaaagataagaaatagacattattacatgtttctagaaggctggagaatttatgcaatttgtcctggcaatgcaaattgtttcaaggatttctaaggtggcatttatttgtttggcttaataatacttccttctgcagagttatattacaaaaatagctcctaataaacttgttgcatgtctctctttgtcctaactccatcatcagttgctaaggataccttcagtcatgccaagttcataaatccaaattagaaatctatgcatactggatcttcagggtaacatgctgacagcactttggcatccagatggcctagatgttgaaggatttcctgttgtgggtaccaatgactatgaattgctttgtgtgttttcttcttggtataagttagatgagaatttaagtctactaaatctaatcatttttccttctagcaaaatatcaccttcaaccttctaaaaagtcttagttcttcatcgcttgtttagttacataaagttgttgtagtttgccagtaagtttttgatttactaaattatacataaccttctctatctactactctgaatggctatcctgacagattcagctctctgtaagtgacagataatcatcttttgttggaatacagtttggaataaaattagatatttggataatttttatgaaaattatgtatattgtattccttgatgtctacttagtgatgtgtgtcacatgctgttttgagtgggtggcattcagattgcatggatgagaggagatatgagaaatgtgagaacatatagaacacatgaatacattactttatgaagctctttgaaaattaaataattggatttaatagttaaggttttgtctaaatgatgcaacatccctcagtaaaattaggcaattaaaatggatcatctaggagcttctgctgtacttagactcactttgtttgttccactcttcctattcccttaatgaaaatccaggtcttttggaattatgcaggaatttcacaggtaagaagtcaaatgctgatgagcacctagactgactcctcctcatagtagcactttaaatatttggtgcatatgcaaatgaccgggttgccagaacatttcattgtggtctgactgaatttacgttctttatatgacataaacaagatttacgtaaactggatctaagaaagttgaggcagagttgtctgcaactcctgggctggaaatctcaggcacaagtataatgaggaatgactgtcccattccctccatgccaaatgcaagtgcattgagaaaaagagtgcctgtctgattatctgtgggaattacatggagtgagtgttgtaaatctcaggtagaaggatgccattgagtgtaacagtgcaaagaatcttttcttaaatgtttgctgcttttcttaaaaaaataatttaagcaaactttagtcttatgaattagataggataaggacaatactgttcgaaaggcacaaaagatctaaaggaaaaacctgtacttactcctagtttctaaagtacagactatgaaccaggcttcctgaatctctgaacagtgcattgtctttatctccttcccctcgttttacagataagaacactgatgattggagagttgaagatgcttgcattaaagacacagagctgacgtaaggcagactcctacaggcattctaatttccaacatagactcgttgcctgactgtcaaacgtgcaagcattttaaaaatccttttttccacaatgatttcaaagaatgtgcagacacctggatttctcagatccactttgccagtgattcacaggcatttttttagtgtccatcacaccaagcataaaataaactctcatcagaaataacaggtctctctagtagaggggtttattctagtgtgtagtctctttatgggtcttgtaggaggtgtgtgtgggttgaagaatgtggttctaagttactctaaaattgtcagagtacattagtgctttattatctaataattgtatgattattatttcaatatgagttcattcttaatgattccaactttttgaaatactaaacagaatttaggaacacggagaaaaactaggaacatatatttttgtatttagtctcaaaattgcacagcactgtattgacctgtcttgagaacttctcatgtgaaaaggtaactgtaagtttgaatgtgtatgtaatgactcaatgtgtctgcgataacaacagaaaagtaatattgccagtgtattctgtacaggaaaaaccacacctacagtaatctgttgaaattgaggtattatattctaaaatagacattgcaaaagctatccccagtaaatacctggaagttgagcactttggaaaaaaattcatacatgaatgcataaaataactggagaagtgtgaccggtatagagaaggaggacagaaaaccttgtagtcatattcacattatgaaatgttgaatgttgcaaagagagaaaactggttccaagcagattcagaaggcaaggaagaatcctgcatgaagcagctttaatttaagctaatgcagagcttcctaacaaggctgctgcattgaaggagcatggagcttgctcttttctttggcagaaacttcaccagtggtcatagggaagcaagcaaaggctgcaacttacaagttaggaattatcttgtcacttgatttaaaggatgggcttggagatcatcacagtcctgggcaagcattgtgtcctaccttcaaactgtagtgatgtgggaggaaaatatttgcggccatccctactcaaccaacatgcacgccttataaaatagtacagaatatttacaaatgtcaggataacataaatgcattgatttatctcttggtgtacggtattatgcaataaaaaatagtttaggtaggcctaaaagacaattttatccaataaaattatgtctattttatccactaactttttaaaaataattttctcaaaatttgcaggccaagcatacttctgctcttcaaaggcatttagatgttctgcaagcttaattgaaatgcacagttttttctgagaatttctactaagtaacaatcctttcaagtcaaaggatacttgggggaaaagatagactttaactgctgatgtaacttcactgggagcacctgggtttacagaccttttctgaagatcaggaggtatttgcaatttaaattcatagattttagttgaatatgtagattgcttaaatgagagattgagaatttgcacccatttaccaatagttttgaaataatttgcagatatcttacattttacttggtattgtataaaatatttgcacctgtaactataaatttcttatttgattcttaaagtaaccctgaatgtttattatatcaattaatataagcagatactgaggctcagggtgtttaggaagataatccaaggtcacagaattaattaatgtcgtgaccagaggaagaactcaattcatttaattctaaattttgttttactgtatgttgccttcatcatttcagaaacaaatgcctatataaagtcacagaatcattccaaacattttctgattatttttatgtgtactaaaccatagcaaagctgtatgatctatgcccaggagatattcaacaagtatagttacttattgtgctcactctagtgagagagcagataataaatttaacaaaacattttacttaaaatcataatttactttgaggagggcttgttctctgataaattagatcttttgtatgcagataggaaaagtaaggccacttggctgcaaaatggagtagactttagaatttccctttgcattgctaggtttgcagggctagctggccatagaaaaagctagaaccacagaagagttacatatatacatatataaatctatgggaggaaattatgaatgtatatacttatatatatatatataatggataaaagatcatcctttatattcttgaagtttgttgtggattttactgtaacctgaaattgtataaaacagtccctcagtttttcttaattgccagagctacggaaaaattccaatttccaaaaatcatcggtgagttatacctcaatatgtatgtccctgtgctattacatatacgtgtgtgtgtgtgtgtataaaatgggagtaagggtgaacagacagcagagaccactgtttgactttgtgaagcagcacatgattttccctctgtttctggtgtcttatcgcatgataaaagtcaaaccgaaaatgtaggaagtgtggaagtagctgaaatactgctaatatttaggctgcgacataaactggagaggagtttccctttagaaatatatttttataggttccattaatgaaacctaaaaaaagtaaaatgagggaggttgtaagtaatgatgacattgtacatagtatcataaaaatgtataaaacctgacaccaaatattctgaattagcaaaatatacattatatatatatataaaatatacatatgatgtatctatgtgtacatttttatatatgtgtgtatatctgtacacatagtttatatccataaaacagcaatcctgattataataatttatgtgatctactctcaagtatgactaattttcattagtcacattagttattacattgttaacaatttagcaggttcacatgcttggtacattttatttgctaattacagtaaatgtctagctgctattcccatataaagcttcctatatacacaatgccatgtgtatgaatatataatgaattgagactatctagtccaaacactcctggcactaacagaccccgtgaccaccaacacgttaccctcaatgctgtcattggtgagaggggcttttatagctcctcacttcttagttttattgtgaagatcagggagtcaatagttacaaagtacttcttagcatgacactttgcaaaataaactccacgatgtcatcatcattattctcaatagcaacttctttttctgggcaattgactcaaatgctaatatttttagaatatttagaggagcactagactagtttgatcaattttactcccaaatatgttggtaaaatgtctttcttgggacacttttagccttaaacaatgtgaaaaatcatcctttacttccatgaagtttgttgtggatatttgtttctttattgtaacctgaaattgtataaaacacactcagtttttcttaattatgaagaactatgaaaaattctaatttccaaaaataatcagtgaattatagctcaatgtttacgtccctgtggtatttcctctgaatattaattgctaatactgatttctaatggtcatgctaatcataatcctaatgctaattcctcatcatcttaaaattgaaaataaataaaattctacaacactgaatgcctcttgtattgagaataatttttatgtctaaatttgcaagagtagtttccgttgagtttctgttgccctttttatttcatcccttataatttgtctgggacatggataaactaacaccaagtatactctcatgatgtagacagtgacttgtgacccaaatggtagataacccgtacttgtagctaaatggaagacatgagctactcacagccagcaccaaagatgttttgaaagtagtggtgatgccaaccatacaaagacacattaaataataatacaaatttaaatgcatctaaggtaatacacacacgcatacaccggaccatggtatgcgtaactgctgtgtagcatggtatgcaaccttaggcattgttatgcacatcatcgtaatacagtatcatctgctgacctcatcttctccaatgtatttaagcaattattgattaataatgaccaattttatttaaaaaccttctggaatagagtaaatgctagatatcagtctcaatgtggcaagaatactattttttaaatgttttcttcccacttttaaaagtttgctgcctaacaattaattcacatgttgttattttactgccctgggaatgctatcatcttatttggaagatattaccttatatcggcacaactgtaggatcaatggaagagtacaacacatcctctacagacttcactttcatggggctgttcaacagaaaggaaacctcaggtcttatttttgccatcatctctatcatcttcttcaccgcactgatggccaatggggttatgatcttcctgatccaaacagatttgcgccttcatacacccatgtacttcctcctcagccacctttccttaattgacatgatgtatatttccactattgtgcctaagatgctggttaattacctgctggatcaaaggaccatttcctttgtggggtgcacagctcaacacttcctctaccttacccttgtgggagctgaattcttcctgctgggcctcatggcctatgaccgctatgtggccatttgcaaccctctgagataccctgtcctcatgagccgccgggtctgttggatgattatagcaggttcctggtttgggggctctttggatggcttcctcctaacccccatcaccatgagctttcccttctgcaattcccgggagattaaccacttcttctgtgaggcaccagcagtcctgaagttggcatgtgcagacacagccctctacgagacagtgatgtatgtgtgctgtgttttgatgctgctgattcctttctctgtagtccttgcttcctatgcccgaatcctgactacagttcagtgcatgagctcagtggagggcaggaagaaggcatttgccacttgctcatcccacatgactgtggtgtccttgttctacggggctgccatgtacacctacatgctgccacattcttaccacaagccagcccaggacaaagtcctctctgtgttttacaccattctcacacccatgctgaaccccctcatctacagccttagaaacaaggatgtgactggagctctgaagagggccttggggaggttcaagggtcctcaaagggtgtcaggaggtgtcttttgacagtcgactccttcccatgcatatggtaaatgggggactctgtggtcactgtggctgtgctttcatcaaaagatgaagcaaaaagggagggagtcatatgattacaatattggttttttggctagggtttctggttcataactccatagttatgatgttgtggttttttaggcctcagaaaactgaatctctctctgtgatcttcgccttccctcttttcacctgcttctttttctccccaaagaaagccttagaaactaaaaatataatccaatctttccccgcttttggtcacaaagaaattatctgactaccttgtctgactgtatgtcataagacctctgtttcaaaagaggtcttctctcataccctgggggagggaatgctatacagagaggccaagaaaaatccgatcagacaggccttcgtgggtgtccccactcactctatcaacattaggtcatactctttgttcaatcatatttctgtgcaattgtccatgcttcaatcatgactattcaataaagtctccatataagggccaaaaggagaggacagaaaacttctggacagctaaactcatgaagctgaacaggagggtgataagaacccatccatgtgcctggagggtggcatgtcccaactccacagaggcagaagctcttatgctcttccagacctcaccctctgtgtcttttcatctgactgtttctgtgtatcctttgtaatatcatttataacaagtggtaaacataggtaagtgtttccttgaattctgtgagcctttatagtaaactaactgaacccaaggaagggccgtgggatccccaatttacaatcacttggtcaaaagtacaggacaacttggggcttttaattggcactggaaatggaaggcagtgttatgggactgagccctcaccctgtgggatctgacactatctccagatagatagtggcagatggtcatgggagtttagcttgggctagagcatttgactgtagatagtggcagatggtcacgggagtttagcttgggctagcgcatttgactgtagatagtggcagatggtcacgggagtttagcttgggctagagcatttgactgtagatagtggcagatggtcacgggagtttagcttgggctagcgcatttgactgtagatagtggcagatggtcacgggagtttagcttgggctagcgcatttgactgtagatagtggcagatggtcacgggagtttagcttgggctagagcatttgactgtagatagtggcagatggtcacgggagtttagcttgggctagcgcatttgactgtagatagtggcagatggtcacgggagtttagcttgggctagcgcatttgactgtagatagtggcagatggtcacgggagtttagctagggctagagcatttgactgtagatagtggcagatggtcacgggagtttagcttgggctagagcatttgactgtagatagtggcagatggtcacgggagtttagcttgggctagcgcatttgactgtagatagtggcagatggtcacgggagtttagcttgggctagcgcatttgactgtagatagtggcagatggtcacgggagtttagcttgggctagagcatttgactgtagatagtggcagatggtcacgggagtttagcttgggctagagcatttgactgtagatagtggcagatggtcacgggagtttagcttgggctagagcatttgactgtagatagtggcagatggtcacgggagtttagcttgggctagagcatttgactgtagatagtggcagatggtcacgggagtttagcttgggctagagcatttgactgtagatagtggcagatggtcacgggagtttagcttggactagcgcatttgactgtagatagtggccgatggtcacgggagtttagcttgggctagcgcatttgactgtagatagtggcagatggtcataggagtttagcttgggctagcgcatttgactgtagatagtggccgaatggaattgatttggaggacaccaagtggtgtccactgcagaaatgattgtttacttcgtgtgtatcaaaaatcccccactcatttggtcccatacatcttatatgttggttgttgtgtggtgtggaagcagaggaaaaacagtttcatgtgtttttttcctcaaagagcgttcaacttggtgggaaaaaaaaactaatgtaaaaaaacgtcctcttgatctcttttccttctcttttctttttttcttataccttccgtttctcctgccatgttcacatgtattctaaataaatacaagagggctccataaacacaaaaatgtgtttccatctgcaagctggtagaaagagtcattgaacatagtcttcttaaacaggtattgtactcactacaatcaggtgcttattactttcagtaaaagtacggtatttatctttttttattttgcaacacattagtgaaaactatttgtcagataacttaaaataaatggatgaaagcaaaggacattgcccagaaaagacatcatgagaacactgcatatctgaggggtaacggggtttctaaaacactggagaaacatacagggggatgggttaggaaggcagtaaaatgcttttcaaatatctcatgagatcatcaagattaagcatatatcagccatgtaatagtattagggcatagttaatattcatgttccatatggatccaggaattgaggaaagaaagcatgtgccgatacatggttagtatcccaattatataaagagttcactcatcatcaaaagggtgactttctcaaaattataattcaccatgtggggttatcattatacaaacatcatcatggtcataatcataatcatattcatcaatctctatctaaaacttaaaaatttatgtgccttgccaggttcatcatcctttaacaacttcataacaaaggaagcagaacttgttatgagtcatagtttacatgtaagaacagtaagtttcagggaagcaagaaaattctgtaggataataattctaattaatagactagatggcagaatttcaagaaatgtgattgatagaacactatattcttcagatacagcttcctcattcattcattcatgctttatagctgtgaccaagacaaacaaagcaattgcacttgagaaatttgcattccagtgtggaaaagacaatgaacaaaaataaatacaacaagtgagcaagcaaaaaaacacatatatccaccatgttgtgtgtggtagctgtgactaaagctaaacatatccatatcctgcacccctgcaggtccattcttgagtgaattcttaatagatatattatagtttgaatttggtttattttgcccccaccaaagcttatgttgaaatttgatccccaatatggtgttgttgggaggtcaggcctagtgggagatgtttgggtcatggaggcagacccttcatgaatggcttggtgctattcttgtgttagtgagcgagtcctcaccctggcaagtctgaactacctcttggaggaattaattcatttctgggagagtgggttgttataaagccagtacatccttcaggttttgctccacctttgaccttctccaccatgttttgagctagcatttgtccctcaccagaagtcaaacagatgctggccccatgtttctcatacttctcagccttcagaacgatagtcaaaatcagcttctttttttttaataaattactcagtctcaggtattcttcaatagcaacataaaatggactaagacagaaaattggtaccagggagtggggtgttgctataaagatacatgaaaatatagaagtggcttggaattgggtaatgggcagaatttggaagagtttggaggagggggctaaaaaaaactgcattaccatgaagggtgcattaaggacaattattgtgagggcttaggaaaagagaaggctcaggagaaaataaaaagacaagagaaaatttgcaactttttagaaatcgttttagtggttctggccaaaatgctgttagaaatgtagacaagtaaaggccattgtgatgagttctcagaaggaaatgaggagtatttatctgcaaactggaggaaaggtcaacctggttctacagttgcaaagaacttgggtccatgatgtccatggcctaggactttatgggagactgaatttaagagtaatgaactagaatatctggtggaagaaatttctaagcataaaagctctcatgctgctatgtagctacttctaactgcataaggttaactgtcaggaaaaggggaagcagagtgtacatttttggaaaatttgcagcccagctatgtggtaaagaattcgtgttttcaagagaggaaaccagaggtacagccaagagaccctttgctaaagagattagtgtggatgaaaaggagccaggtgctaatagtccaaacaaagggaacaaaatcccaaaggcatttcaaagctcttccatgctatccttctctttgcagtcccacggcctgagaaagcagagttattttgaaagactatcctaagcctggtgccctgtgttgcatcaggaccctgctttgtacatctagcagtggctcaaaaagccccatatgtgtctctggctactccagagagcccaaatggtaagccatagcttccacatggtaatctgcaagtgccaaaattaaaagagccatagagatattacatgtgctacctagatttcacaggacagcttggaaatcctgaaagtccagtcagaaaactgccacaggggtggagccactgccaagagcctctactaaggcaattcccactggaaatgtgagcccagagctgccacagagagtccctactggggcaatggttaacagaaccatgggggcagcatgggagtggggccccagaatgttgcagccaccagcagcatgcaatctcagcctggagaagtggcaggcatagaactccaatttgtgagagcagatatgtgactatgcccagcaattccataagggcggaggtgcctgaggccttgggagcccatcccttacaccagtgtgcccaggatcatggagtccagtaagatttttctggaactttaagatttaatgtgtgccctgctgggtttcagacttacatggggtctgtcatttctttcttttggtcaaattctcctttttggaatgagaatgtttaccaaatgtctgtcccaccattgtaatgtggaggtaaataacttgctttgctttcacaggctcatagttggaaggagcttgccttcagtctcaaatgagactttgtactttaaacttttgagttggtgctgggacaagtcaagactctagggactactgggatggaatgattgtatttttgtatgtaagaaagccattggtttttggagtcagaggcagaatgctatggtttggatatggtttgtctctaccaacatacatgtcgaaatttgattcccgatgtggtggtgttgagaggtggtgcctagtggaagatatttgggtcatggggtcatatccctcatgaatggcttcatgccattcttgtgatagtgagtgggttctcactctggcaagactggattagttcttataaaaatagattagttcctaggagagtgggtggctataaagccagatgttcctctggtttttgcctctctcttcacacatatctgctttactctgtgacctttaccatgttttgaccaagcacatggcccttaccagaaactgagcagatactggcaccatttttcttgtatatcctgcagaaatgtgagctaaataaatctcttttatttaaattactcagcttcagatatgctgttacaatgacaaaaaacagataacatgtatgcataatgttaccaaaagacatatggtaacataaaatatggaagcaatcaaaagcccactgatggcgaaatggataaattgtgacatgttcataaaataagaatagatgttctaatactacttacaaacatattgttgaactaatgaagcaagctacaaaagagtaccttcatatgaagtacagatccagcaaaactatcctatactgttggagggacggtggctggaaggatgcatgagcatgttcttgaatttctgtttattgatgtcaatgctgattgtatacccaatgttcagtttaagaaaatcaatcaagtctaaattttttgtatattgaatacctttttgtgtgtacattatgctctgatacaaatttaaaatataactcataataatgtggtaaatacaatagtataatgggatagtggaggtaggtggagggttaccctagatatggtgttcaagaaggtttctgaggctgtatttgagaaaaaaaaagagacaggaatagaaagatccaggtgtagagccttccaggtaggaagaataacacgggccaatgttctgaaatggcaatgatgtgttcagaaggcttgacagtgatgcagatcccgaatgagtaatgggtggagaaggcaagtctgaaaacatgggtagtgaccagatcagaaaaggcctttcatgctgtggtacagaagttggaacttgacttaatttgcaaagaaaaaccattgagaggtttcaaacaaagaaaagacagattataaataacattctgagaatgctactctagctgctttataaagaatgaactaaaaacacctgttaggaggcttttcctgcgttctaaagagagacattttcagcacgggttagagttttaggagtagaggtgacaggaagtagtatcactgggatgcacttgaaggtgtgaataacaggcgatgattaataaagtatgaggtctgaaggaaatagaatccagaagagtgcccaggttttaagcttgagcaacaaaattgatagtggatctatttgttgaaatggagtgaagacatttctatacttttaatttattttttatgtttttgaggaatattgtgctttgattgtatcaagttaagcaagagatgataacagcatgatgagttttgcctttcagaaagcagtagcatttatcgagcccgagaagttgagtctgtagtgagccatgatcgtgccctgcactccagcctggatgacagagtgggaccttgtctcagaaaagaaaaaaaaaagcaaaaagcagtagcatttagaaagcagttattactatatttgactctcaatgacggaagatatcataagtcaacacctagaaaaggctagcgatagatacttttattgatttaaagtactttttaatggctagtgatggatacatcttatgaactttccttttgggttatgcatcttggcatttcaaaaataatctttgggtaatgttttcaaaactttaacattttcaaaaagctctgtttgaaataccatttgacccagcaatcccattactgggtatatacccaaaggattataaatcatgctgctataaagacacatgcacacatatgtttattggggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatttcaaggacaaaaagccaaacgccgcatgttctcactcataggtgggaattgaacaatgagaacacatggacacaggaaggggaacatcacacaccagggcctgttgtggggtcggggggagagggatagcatttggagatatacctaatgttaaatgaagagttactgggtgcagcacaccaacatggcacatgtatacatatgtaactaacctgcacattgtgcacatgtaccctaaaacttaaagtataataataaaaataaagaaaacacagaaaaaaaccccaaaaagctctgttttacctcaatccaatgattttatgcatcaatattctttcttatgagcacggtcatctgcaggggaatgtggggtgtgtgtataagattaagagctttattatgagtatgttaagtttgaaatgtctattgaatatctaaataaaaatgtcaagcagctagatattttagtctagatatcattttaggtggtagatgtgaagacaggtttcagaattattgatacgcagattatgtgttaacagaattaaagaataggacaagagaatttcaatatttaaatactagaccacaaaaaaagtgacaagaaagggataaaaaagatgtggagcacccagaggagtgtggtgtggtagaaacttagaaaagacagtctttttaatagaagggaggggtctacatgtgagtttttgggtaaagtttaagtaatgtgaaacagaaagttgattgcctgagagtgcaagataacagtcgttcctatccttcacagaggggcttcgatggagtgattggacagaatatcttgtgaagtagactaaggagaaaggaggctcaaaaattgaagaaaatcacaaaagtttgctctgaataatggaacaaatataaagttatacatggatagtgacatggggttaagggaatattttttatatatgtatatgtacatatacatatatgtgtatgtatttttatatttattatgtatattacatataatatatatgtatgttatatatatttttatatatgtatatatatgtgtgtgtgtgtgtgtgtatatatatatgctgttgacaaaagccaaactctctaaaatatttgaagaggtttattttgagccagatatgagtgatcatggcctgtaacacagcctcaagaaatcccaagaataatcttaccaaaattggtcaggtgacagcttggttttatacattttaagatgacagaaattacaggcaatatacattttaaggagaagacagaaattagaggcaaagacataaatcaatgcatgtaagatgtatgttggtttggcacggaaaggcgggacttcttgaagtgacaacttataggtcataggtggattcaaagattttattatcagcagttcgttgaaagagtcaatccttgtctaaagacttaagaaatcagtagaaagaaatgcttcagttagggtaagatggttttcaaaaccacagttcttgttatatagacgaagcctctaagtagcaggctgcagagggaatagattgtaaaatgtgtaagactcttagttaagtatcttctgggtccataaaagacccagaaacggaaggagattctctagagaatgcaaatttcccccacaggaaatggctttgcaggaccattctaaaatgtgtcaaaaatatattttggggtaaaagatcttgattttcttcaggacctgctatctgtcatatgatactatgccagagtgaggttagaatttggtatcttgttgctgcagagagtctgttttgtcagcctcaggacctctattttaacattactgttgctcagttgtgcctaaactccaaagagagggggtagaaagagtcatgtctgaactctcttctagttgtttggtttctttgcgatctccttaaccaggagagtgtcagttggggtgggggcttagacttttatttttggtttacattattctccctcaggtcaagattttccagaggcaacattgatggccaaagttttatttgtcctctattgttgccagagtgtgtggctatggctatctgccccaggtgcatcatgttctttggtgggatccgtatggccaaggggcttagagccaaaagacttatagcaaatttaaatgttgtagggctggatgagaatggagatgggcaggcatttatcagccgttaagatctttaagcaatataagagcccaaaaccaaaagataaggttacaaaattgacttatcaatacattctgtgcattgagcaatacaataatcttgatttttgttacagacttctagcaattagctgtaaataacaaaagcattttgttgaaaccatttaagctaaagaacacagaggcttgttttgtgctgcagtgctttttcgtggtctttttcatcatttgtcctgaggtggctgatttaaaaagttacatatatctgcataaatctcacagctaggagcagtatatccaggaggctttgtgacgaggtttcttgttatgctcttggtaattttcttttaatcctgggacaagcataaaattctttatagttgggatggatggaaagcagccatgtaatagcccaggaggaaaaggcccctaccttgccagctgtttaggcatctggatgtctgtccttgatttggaggctctgaaataattctgtctctgaaattaatcccttacaagctcacctgcccacctcttccacagtagcccctgggtctagagggaaggtgcctatgtagccttagtagcaaggtgttagcaatgaagacagatcaggcccagtgagagtctaagcaggttttacatttggcagatattaggtagagagacaaaggtaatctatctgtgttttaccaattttgtaagctacatatagctcaaaaggaaaaggcatttctttttttactctggaaaacaaaatgtaaggaatcagcaacattttaaagaaaaagagcttaattcctgccttgctctgacagaagacggaaactcacaggtagctagcatttattatctaacattaaggcatagaacaaattatattaatttagatagagaaaaaattattaaatgagtattcatgcctttgtatacaagcctggtttagtgtcatacaaaagcagtttttttcactctcatcttctcccagctctgaagatgaggctttggttaacttacatttgatgtcagatactgatagcgacaggaagcagaaaaattctgggccgaagagggtgggtgagggccccaccctcaaacctggaactgtggcccagagtgagaacatacattcctgtttcccactctaatgttgccttttctaaaactaccaatggcctgtccccaccatcatcctgtgcccataaaatcccaggctcagctggcaaagaagagaagcagcaggacatcagtgactatgcctggatgttggagcaaattggcttcatttcagagagacagcttgatggtatagcttcagagctttaggggaagcttaccttcccaatccattcccttttctgctccccttcccactgagacccactttcatcagcaatgaaatccccgcatttaccatctccaatttgttcctgcaacctcattcctcttggatgtcagacaagaacttgggtgcaggtgcaaaaggctgtcacatttaccctccactaagctgttaacacttaagccatctgtggatgtcaaagctaaaagggcactgactgtaacactccttctggggctttgggggtcacaggcactcccctagacgctgccatggggccagaatgaagttcgttcctgccggcacccaaaagtgctagccccagctcctgcacctgctcagctgcatgcttcctcccgtgatgggttgatcacagcaggtttgagtgaacagagtttgcacctgctggcaccgtgcactccagttcctgcccacaaaggactcagggaaaatttctcgcttcaatgtcagcattgacatttaagattcagtaggagtcagtgctcctttttaaatgagatatgtgtacccagaagtcaaatacctgaaacttaagagcaaaaaggttagtaacaatatttgataaagacccttttcaatgaggctggagggagttttttaggtgagatctaatcatcaggctggaggtggtgatagtggagtttatgacttaattgaaaactgtaaaaagatggtatagcactgggtaattaatttgtatagttttgatgaacccccggcaataagtctaagtcagagacttaacttagaatttgatttttgaggatgtttgtcaaaagatattgaaaggctcaaaacatttgattaaaatgaatcaaaagtcattgtaaaataatagttattcatttaaccagaatggtaatcaaaagacttcaaaagcaatatagaaagttacatgaatataaaaccctacctggttttaaacctatacttttaggttttaaaatggttaagggttttataacaacacagtaattatcttaaaatctgtatttcctaggctagctgtcaaaaagtaaagaaaaaccttatgcagagtgattgttttgagtcattggaagcccatttggataacctgaaagtcaagcctcatgaaaagataatgtgaattaatcagacacaggaagagtgtgttccatgtcatgagtgaacactgttatagagaccttgagcaggggaatatgtgactcttagcaacagcatgggatgttgcctgggtatactgagcacttttaaacctatgttagagctcagaaaacaatatcccaaaatgaaggatttagaggcagctgcagaagtaaaagtttttctttggccttcttctggcttcctgtttgcaagtcccatgctccctcaaggcgggtcatagcaactagaatctcgctttcccaagatgagtcctcaaaactgaaactcctttttctcaaagccagccataaaacctaaaaatattactccaatattttctctgcctttctgtgaaagaacataaggatattatctgatcttccttttgaactgtagagtgcaagacccccacacagagaaggaagaaaatgaatgttcaaggaggttaagaagaatctacacaggcaggtcttgctggggtttccccacacagtccactaacattgaattatacccttttccatcatatttttagatggatgtccctaattttttgaacctaagcataaaaatgcacaatttcccccatttattggatctttgttctgagcacacccatgtatacatgcccaaaaaactgcatatctgcttctcaatgaatctgtcttttttgagttgatttttcagtgaaccttcaaagggaccctggcccctacacattttaagaaaagtcaagagtaacaaattaagttacaacagaggaagacatcacttttttaaatcttcaaaagaaaacattttagtatcaggctataacacagttagaattgaagaaaaaaatagttataggagacaacaaaagttaaaagagggagttaccattccaggccttctcaaagggagaaaagctgaaaacagtggggtatatcaggagttaagcttctgaaatatcaatctgagagatttctttcttttttttttttttttttttgagatggagtctcggtctgtcacccaggctgcagtgcagtggcgcaatctcagctcactccaacctccacctcctgggttcacgccattctcctgccccagcctcccaagtagctgggactacaagtacccgccaccacacccagctaattttttgtatttttagtagagacagggtttcgccgtgctagccaggatggtctcaatctcctgacctcatgatccacccacctcggccttccaaaacactgggattacaggcgtgagccaccatgcctggcctcagagaaatttcaaaaagagattatagaattaaaaatgtaaagctttttgtaatttcatcaaaagtaaatcaatactttaagaaaatatatttgttctaaccaattcgtcagttttatattcatgtattttatgaacttttattttaggttcaggggggtacttgggtaggtgtcatataggtaaattgcatgtaacaagggattggtgtacagattatttcatcacccaagtaataagcatagtacccaataggtggtttttctatttgtgtatttttaatattaaatcccaatctctaaaaacactaatacgaataattctttttaaattatcaccagcttaatcacatacaaaattgttttgcagtgagcaggtctatacaaacctatccaaagttggaggaagctgagatgctgaagaaagaggctgataaatacagtttcttaggcagaaacaattaatagggacttatgaacagaagccatgtctgtgtctcaggcagcagtgagataagatggtaaattcctgtgccattaaccccagaacccagggcttatatgccatagagaaggaatgattcagaaggcatatgtgggacaactgaagtatgataatgtaaaagttgtttgtcctaagggcaggatttataataagtacctgttcttacacaaggagcaataaataaactggaaatcttaaaggtcttcccacctggagttaatcagaagccaacagggcagatcaccattcaagatggagttacttgagcctcccatctaagaaagagtagctttagcctccaaaacatttctttcataaattctctttataaactttatcatatcttacacagactatttatgacatacttggactttctgttttgtccaaaatttccctctttcttaaataacgagttttttttttttttaggactaaatttactatacaagactctttctcatacaaaattattctttttacccaatttttaaaataaatacatctttggatttgtataatagcctttgaatttgacaaagattattttccttttaataagaacatatttttatgtctttattataatttctttttcataaaaaaacttactttggcactctttgaatacagaattatatattaacaagaatttttattcttagtaaccttaattttttgtgaaaacctaggaagtagtaaatcttgaattgtctgtcatatatcagtattttatagatgagaaccgttttatattattttagaaatatgtttttctgttttttaaattagaagtgatccagacactaaatgagtattatttaatttaactttaagattttaaattatatgacaagttcatttataagcacttatcccattaaagttaactaacttattttttaaaatagttttcctaggttacttataaaaactgacatattagacaaagctagtcatcattagttattttcagctaaccattcttataggctgtgtttatttcaggtgtttacctacataagaacctaaatgttaaatatatgtttatttgatttttttttttgccagctaaggttttacctattttcaataaatcaacaatattaaatgtcttatttataaaaaattatgcaaagatcattaagggatgggttttatagttttataaccttcatgacaaagtttggtactttataatatcaacacagctaaatacaaaactattttaccaataaatccagacaaaaatgtacgctgacaattctgaaggcatttcaaattttattttactaataattataaaaccagattacttattgaagatttacttgtcatgtgaacttgaagagcatttggactttattagtttatgagtaatcctttatttttaagcccatttgataccttgcagttacaacatataagaaaatacatgtacatgtaacataaacacaactcaacatagatacacggatacaaagatcccatagattttatttcagaattctagtcacaagacagcaatacagattcaccagcttgcaaaagatggtttaatttaaacaatgggttttatctcaataccagtagaaaagcaacaatacatttaaaacagaaaaagaaaagagagaaatcaagaactaagcagatgccatatttaattctatagttgcaggtcaactttgagctctgaatttacccatcagtttacaaatgtgccagaacagactataatacataaccagccagagtactagaaaaccaagcatgctctcaaaacttcacatttacacaaacaattgcgagtgccataaaacccccaggggtgccccaaaggaggtcatctccttgtcttttctcaatcttagaggatttgcttcccaggttttcttttttttaatggaggagccagactgtagtgtgggtttcagtgcagtggggctcagaagctgtctctcattcatttacacaaagtcaggtttttcaagcaaatgcacagatgaaccaattgagactaatttttggagaaaaaagcaatgagaagactctagaatgaacctgtgaatccaaaattagaatctgaaacaacaagttcccaggaaaagaccagctcagaataaaccaaagtactattaaccacgtaagggttctgtggctcaggaagacttacttaccagttccacctatggagaagctcaaagtcaggaggctttcaatgagcctgcagcaggagaatatgatctggagacctggagacagggaacttaaggccaatttatgctaacttcctaaaagagaaaacaccaaggtctggaagcaggacctggacaacttgtagtcaagaccctccactggtaacaagcccatattggtaccttatttccaagttcacacaacttcttttggggaggagagtccttagtcttctctgaggtcctgcattgggcaccaaataatgttgatgaagaaaagtgaaactctaaaatatttgaagaggtttattctgagccatgagtgaccatggcccaggacacaaccccagatgttcctgagaatatgtgcccattgtggttgggttatagcttggtttgatacattttagggagacaaagttataatcaaagagataaatcaatacatgaagggtatatattggttccagaaaatttagacatgttaaagtcaaggctcccaggtcagaaatagattcaccaattttctgattggcaattggttgagttaagctttgtctaaagacttaaaacgtcagtagaaaggaatgcataagattacatagttgtggaagccaaggtttttgttatagaaagaaacgcttgagttaagataatggggttgcggaagccaacgttcttgtcatgtagaggaagcttccatgtatcaggctttagaaacaatagttggcaaatgtctctctttcaccttaaaaggtgtcaggttcttagttactctctcctggatctggaaaaggcttagcggcattaataaagtttctctacagatgcaaaatttcccccacaaaagatagctttgcagggccatttcaaaatttgtcgaataaatatatttcagggtaaagtatttttatttacttcatggtttgctatctgtcatgtggtgctatatgagagtcaggttgaaatttagtatcttattaccacctataatctgttttgtcagtctcatgatctctgttttaatgttaatgctggtcagtcatttagcactcaatggaaatgctagagaccacaagtatttagcttaactctttcaacaaattgccagtcaaaaaactttttaatccacctatgaaagcttctcagtagcaggcttcagagaggatagatggtaaaaggtgtcagactcttagttaaatgttttctggatccttatgagacatagaaagggaagcagattctatacagaattcagatttcccccagaagagttggctttgcagggccattccaaaacatgtcaaagaaatacattctgcggtaaaatacttttatttccttcagggcctgttatctgtcatgtgattctatatcagagtcaggttggaatttgctattgttgccacagtctgttttgtccgtcttataatcactgtgttaatgttaatgctggtcagttgtacctaaactccaaacaaacggagtacaaggagtcatgtctgacctcccttcctgtcatggcctgaactagtttttcagatttctttgagatctccctgggcaagagagttcccattcagtcaactacagggcttgggatttattttattattattattattactattttctgaggttgcaacacagagcccaagtaggaggtctaattttggatagaggcagaaacactgtctcatggaatgcaagagtaaatacaataaaatcagagagatggaaaatagagtacactcaagtatgttgcttattttcagtcttctgatgcctaatccctcattgttttgtagtcacatggttatttcttggttcttttataacatttttcacaactggattgctatgattgtgcagacactgtctactagagtcaaattttgttttgaaatagttcattattttatttaactgcgtaaactagtttagtctatgatgaattaatagacagatgtgaaaaattttaaactcctctgtcagggctcagaacaagatccttccaaatatggcttcttgatgaaatctaaaagtaaaaccctaagccccccaatcaactgaatggattccccttcttggccagtggagctgagagcaatctgaaaaagtaaatttcaggccatgagggaagggggattgggcacaccttgttgcactccctccattgtggaattaacattaaaatagagatcacaggactgacaaaacaataagataccaaattccaacctgactcccatatagcatcacatgacagatagtagacactgaaagaaataaaaatattttaccacaaaatatatttatatgacagatttcgaaatggccctgcaaagctatcttttgtgggggaaattttgcatctgccattagtgcagctaggccttttccagatccaggaaagatagactgtgaggctcacaccttttaaggtccaaaaagagacatttaccatctattctttctgaagccagctacatggaggcttcatatatgtaacaagaatcttagcttccacaaactcccttaccttaactcaaacatttttttctactgacttcaagtctttagtttaactctttcaaccaattgccaatcagaaaaatctttgcatccacctatgactcataagccttccacttcatgtcctgctttttcaggctgaaacaatgtatattttacatgtattgatttatgactttgcctgcaagttctttccctaagttttagggagacagaagttaccctgggcacactttctcaggatcttctgaggcttttccccggccatcgtcactcatattggctcagaataaacctctttaaatattttacagtgttcagctttttcatcaaatgcaaacttgacatactaaataagctgaagaaaactgagaaaaccgaagaggtagaaaagtcactttctgattttttctgcccttctcccctgagagctgtccacaaaagaattctcagacctacctgttctgagagaaggtaataagccctttattccagaggggccctgaccaatgcccagagggaaaaaaatgtcacatggggaggccactaagaatctgaacaaacctcgctaagtcctcctcctaagtttatttccattatatcatatttttaaatgttctaatcatacttttaaggctcgcatgcctcatgaaacttctactaagtaaatttgctatacttttctgttgctaatctgtcttttgttagaagttaccaaccacgaaccttttgatgagcaaggaaaaaatgtcttacttcccccccacccccgccccctgtaccactaattataaactttgcaaagttttgatactatcatcttatggtgtgacccatctcattcacagggaagtcacaacacagctcatgtggtccatgcagtccatttatacgggattttgctaaagtttctatactcctagattcttaggcttagcatcactaagagggatagaatgtgtgtctgaactgtatccgttcattatatcagggacagaatgtgtgtctgaactgtatgcattcattatatcagggatagaatgtgtgtctgaactgtatgcattcattataacagggatagaatgtgtctctgaactgtatcagttcattatatcagggatagaatgtgtgtcggaactgtatccgttcattatatcacggatatgaggtgtgtctgaactgtatgcattcattatatcagggatagaatgtgtctctgaactgtatcagttcattatatcagggattcaatgtgtgtctgtgaactgtatccgtttattatatcagggatatgagttgtgtctgaactgtatcagttcattatatcagggatacaatgtgtgtctgtgaactgtatcagttcattatatcagggatatgaggtgtgtctgaactgtatcagttcattatatcagggatacaatgtgtgtctgaactgtatcaatacacataacctacttctgaaacacagtaaggacagggcttggcccccactcctactatcacattttttttcccgtacctgccaacttccagaccttgcaccaccacctccactggcacgatacccactgcatggataacttgaagaaactaagataagcagcattccaccataaatcttattcaagggagttaaccttatcactcacatgtgcataagaccagaagaatgactgatctttaccccttgcttcattataatactaaaatctccacccagggaagggcttacccaccattttttgatcatgcaatgtatgtgttcacataatttctcactgtgcctgcatatcctgtgctccactccacatgtataaagagcctcccatacctcatgattatccatgtcactcatcttaaaacacagcaaaggcctagccatggggaaccagccagagaactgtcattccagtgctgtctcccttgtgttcgagcacaagcccttaataaagccttgtctggaaaacttgcttggtctcatgtccatttctattgcacaggagcccaagaacctgtggttagtaatactttcacattttggcctgaatgaatcaggtactgtctgtttagctgataggtgactagtttcctttattattttcatagttttacatcttatgtatcaatatggtttggctctgtgtccccacctaaatctcatgttgaattgtaattcccagtgttcagggaggtagctggtaggaggtgattggatcctggggtggatttcccccttgctgtactcatgattctgagtgagttctcctgagatctagttgcttgaaagtgtgaagcacttcccctttcactctctctctcctgctcagccttgtaaagattgtacctgcttcccctccaccttcccccatgattgtgtgtttcccggggcctccccagccatgctttctgtaaagcctaagcaactgtgagtcaattaaacctcttttctccataaattacccagtcccaggtatgtctttatggcagcatgaggacggactaatacggtatctatctgtaaacaacagagtttactcttgcctaattttgaactttaaaaatgaagttactttgaatatattattttgacttttttgctaaatataatttttgtgatattcagctcattatcttgtatagtttgctcattttccttagcatatgcaatgtcattgaatatcttaattgatatatttattctatagttatttggtatgtatgttattttcagcttggggctattatgaatgtttttgctattgacatttatgtccttatgttttcatatataaatgcaaaaaacatagtgcatatacctatgggtagaattgatgggtatatatttttctgacttataatgaggttgagtaacttttctttgatttatcagccatttagagtttctcttttgtaaagtacctattcaagtatttttcccatttgctatcaaattttggccttttgttatagacacataagaatttttttatacatgtgctggatattttgttttcagttttgttacacatctgctagtttgtgacctatccaagtgtttaaattttatttatttgtaaattgaattaccaacattttactttatattagttctttttgtgtcttaactaatctgttcacaagctgaagtcaagaaaatattatcctatcttatcttctaaaagctcatagtttttttttttgtttgtttcttcaccttttagtttttaacccgcctaaaacatatctgtggtatgtgactttaggcaaattttccattccccatatgaacaaacaattttcccaatacaacttgataaatttatttttcccagatctgcagtgacatctctgtctcctttatagtcacattccacaaaagctttgcctgctcttggtctccctaattcctccactgtcctctctattcaggatatttacctctcatttcaatgatctttatgtggataaatcaaatctttcagggccatcagcacagtttttgtttgtctgtttttttccttgttttgatataactgtctattccctcgattgaagatgtgtgttttgttttgttttgttgcattttcatctgtcttcaagtacaccatactgatggcttttcctaactcattgttttgtttttccttttaattttttttctccttgtgtcatttctccaggcccacttcttaatactggagggctcctagctcagttatgggtcctcttcttttttttcctgtaccttttctctgttaagctcattggggttcttagctataaacatgtatctatataataatatctatgtattaatgactgcagttcaaagcaaacttggcattcaccaaactgatctgtgcctctgtcttcccaccctaaacttcctgcaactgcgtctttccttaggcccactggtaggaggtccataatttcagttgctcaatccaagcccttagagttgcccctggtgcttctctttcccttgaaactgacatccaactagtaaaggaatcctgttggctctaccttcagaagacacctaggttccaaccatttctacaatatgttcctgctttacctaaatcctctaagggttatttctaaagcagcagttgaagaaacgtcagatcatgccactttggtgattaaaaccccactgcagctcaccgtttattgggagtaaaatctaaaattcttacaggaagctctacagggcccttttacatgctcctctgccccattgcctcttagatgtctgcttgtgccactgtttccctcactgctctagccatcctggccttcttgtcattctttgaataagccatgtacactctcacctcaggcctgtcctaccagttttgttttgtttttttttctccacttgggatccctcccaccccaacactctcttcagggctaaattctttatgtcctcaagactgcatgaatgttatccttccaaagagatctgtactatcgatgacattgtaaaaagcaacaaacattaccacagcttcagcaattctttctctctcttaatctactttttccctttctctataccatttgacattgacagactatatagttaacttctttcttctgtttgttattgttcactgcctctgggctacatgggcagcttcatgaggacaggcacctattttgcaaacaaatatatcccaagggtcttaatagttcaacagatggctgtacatagtataaattcgacaaacatttgtcagatgaaataaggtttcataaaatttctgtagatacatggacctatttctgaactctttattctttttttttttttttttggtttatttgtcttgtgatgtgtgagttgtatactgtttaacagtttaactttgaaagtaaatctgaatttctggtatgacaatttatctgcattgttcttatttaacattatcttggctgctattcttggctctttgatcatcattttaagaatcagcttgccagattgtattcatatcctccggctatctatctagctatctgtctatcttgggagagagagaacattgaatctatatctctaactgtagttctggctctaagtatctatcttcattaatctctgaatctatttctatttcttcagtatctcaaacaatcagttcctttttaaactccctttattattatgttaaagtatttcaaggtaaatagccagtgttttgtcattctagccccaaccatattcctatgcatccatgaaaagggagaacagtgcaccagtctgctcacactgagtccttcataggacttacctacaacaccccaaaatctcagtgacttacacaacaaatgtgtatgtctcaacttatagaagataccattcaaaagaatttcaaaattatttttgaaattcaaaagaattaaaatcacgaactcagaaaattgtacaacagagttcatagctccattatttacgatagccaaaaggttgtgtccatcaatagacaaataaatgagcaaaatgtgatatatacaaacaatgtgatactattctgccttcaaaaggaatgaaactctgatattttctgccacatggatgaaccctgaaaatgaagtgaagtaagtataaaggcaaatattgtatgattctactcatttgaggtaccctgttggaggccgaaagagtgagggtcgtgatcaactgagtaccccactggaggctgggtgagtaagcagcaaaactgcttctcataaatgcagaatgttggcaaactgacaaactgcgtttgccacacagaggttatgctgagggcggtcacgccccaggcacaagtgtttcttgttattaggtacgtctgaaagtctgatagcaatgatgtgaacctgtaatcaatcaagtagctgaccaattgtgacatcctcctccctgctctttctacccaataaatacggagggctgagaagctcgggcggctgcctttactgactagcagctgggatctctcttcttcccctaagcgagcctttccttaaaaccattttcttctgtcttttgttactatttctacgttcatttcttcattcagtcctgtaatgatggtctcaagtagtaattgtacaagtctgtcacaagtggtgcctgaacaggggcatctagggacaagtatagacctgaagaggcctggagggataaatagattagcagggatagagagaaagagtataggtagggaaagacaggaacttgcaggaactaacagggaccatggggacagatagggatagataaagactagcagagaccagcagaaacttgcagggacagacagggtcctatagagacttgaacgaggaaggtctgctggaacagaaactaaaactagccagacaaacgagaagccccattacaagtctgccagcagcaacataaggctagtgctctaaaaaggtacttgtcagtgccccagaggtttgaagaacgggaagtttttgaatcagggtagcatggggaagaatttggttatttttttctttcatttggagtttggtacataccttttctgttatttcagggccggagagactattttgccccacttagagcacctatcaaaagtggtaaacgagggagaatgaaaactggctggcagcatcttttgtggctacagaaatgctcactttgactatggcttatgaggctacaaatgtggattgggaacgtgcagtggcacctgtgaggtgtgcagaaagttcaggaggttttcttagtttttcaagatgtgggaactgagcttcactactttataatgttgattcaggcaacggataattttggtagttgacggatctaaaaggagccaagggttgagccctagagtggaaaagctgtaagtgtagagaatcggacgttgcaaaagagaatgccgtcagacctctgggcagaaggggtctttaaaacagttctcttctcaacagaaaaagtgccaggactttgccctcgttgaaataagggaaatcactaggctaatcaatgctactctatatttgaccagaacggcactccctgtggggaaaccagaagcgggcctggacctgggcacctcgaacaagggggcttccccagtccaggccgcaactccgtttcaggggggtttctggaggtgctttgactccccctcctcaagcaccaggaagcccaggattagatctcccaaatgaacgggtttaggggaaagcaaccggccttggagggggaaagcaaccggccttggcggggaaagcaaccggccttgggggggaaagcaacctgactcacactggcgtttgggacctttgccaacaggataggtgggattaattttaggcagaagtcatcttaacttgcggggcattactgaagtcccaggagttcttcggcttatggagaaattcaggtagcggtcatgtcccaagatctctgggttttgaagcaggagaatatattgcgcagctgttgctcatcccctgtaaattgtacccttctctacgtaagaagcgaggaggtcaggcatctgcaagtacagctgggagaaagctatcacaacccacagcatctaacagacccgcctgtgtaagtgcaaatggaaggtttaaggattgcttttttgctacactgttgcacgagaaggataagcctcaacttgttttctctgtgccttctgttcatcagaaaaagctgctttcactatcaacggaaagttttaccccgcagcaattaggccaagaggcagaagctgcgccgcagcttgtggagcggaggcctcggcaatggcctggctcccggctgcagccccagaaagctttttgcttttgtagagttactaacgtggggacaggacatgcctgtgtctttacaggagatgaaccgtgtgggtgccctcgggaccgagggccgaccgcagtcccgctgacctcaacccccataatacagggacagacataatttaaaaaagggttggaggccgaaagggcgagggtcgcgatcggctcggtttaccactggaggccggacgagtaagcagcaaaactgcttctcacaaatgcagaatgttggcaaactgagagactgcgtttccgcgcggaggtggagcggagggcgtcacgcgcaggcacgagtgtgtcattaggtgcgtgggaaagtccgatcgcaaccatgtgcacctgcgatcagtcacgcagctgatcaatcgtgcgtcctcctccctgctcctactcgatccatgcggagtgctgagaagctggggcggctgcccttgctcactagaagctgggagctcttcttccccgagcttagccttcgaacagtgtttttcccccacttctacctcccttcgctcagtcctgtaatgagcatctcaagcagtaacagtaactgcggtagtgaccgtctcaagtagcaattgtacaggtttgctacagtacctagaagaggaaaatccacagaaacagaatacaccttaccccagagatgaggaaaaggagaaaatacagttaatgtttaatgggtacagaagatttgtttgggatgaggaaaaagtcctggagatggatggtggtgatggttgtatcaacctaaaggaaaaaactgaggcaaagttaacacgcatatttggaccaagattgggaaatgcaatctgaggagacagattctagtagccttaaataaatgctccaactaacagcagttataatggggcctctaagggaaaagggaagttctaagctgacataaactattgatcaactagacattgttcttttgtagctattgataagctatacactattctctgtagggaacatgaagatggttggtaaaggtcatattgtacaacttgtaacattttaggtaacttatcagctagtctggaaacttcgggggagcggggggaagtataaaattcctttaaacaaccccaggtgcgcatgtgtgagcagggctgggtagggaagttattgaattctcatgctcgcgtctctgagcctaagacgttttgtaaagctcacattcttcagactgctctgaatcatttttctcagtttcaaatattttctaaggtcagcttttggggaagctaaggcaggtcatatatgaaagtaatttaacagtggctttctcagattggacctcaatcctaaacaaaggggaaagacccaaagaattttctaaactaccaaaaaacttaaaaaatttcaaccaaccatactaggattgaatcatctcttcttgcttatagaaaatattagagtacatagtaatgtagccagttgttggaaaaaatggtaaaagtggtaagttcaaccagttaagatttaagttgaggtgtttatgtatttcttcgtggtattttgtcagctttctaaaggtgtaattttgttggagtttcactgaagagaatattatacctgtgcaatcatgatttgtagcctgttttcttaagatgccccagattgcataagcttcagcctcagaaaacctgaattccaacccccactaacttaaacaccagtgaggtaaatatgaattacatgaaagccaagatcatgcaggcatagattgcagcacaacaagactgcagggtctaaaattcccccccacccttcccgctccccccaggaatcgttgtgggcccttttgagaatactggatgagaaaaggtctgtcttcttgaagtaactcaaagatcttatatacactgagattagtaaaatgaatatttttaaatgcttgcaatgctgaaagttttatgtattacaagttacaagaaagacaggatgattacatactaatacttgagtgatggggaatggcccaaaatgtatcttttgcaagacaatacttccttagaaacattgatttctatttcaagagagatgcctgaaagttggaagtgtaaaaagagaaactttcaaaacaatgtcgtgaacaaagtaaaagagaaaaaagcaatttaagttgcagctgccagcaacctgacttatcttgggtgtttactttgtaaattgagaggttacatttttcttaaggagtctgtcacattttatatgaactgtaattgcaggctagggacaaggaccccagagacagtgatgtcaatgtatctcctgaatgggagtactagccatcaccatgatgcaagctctatttgtcactggatctctatcttaacagcctgcataatgcagctgctgtcaactgacattaggcatttacagattcaggctgttctatttctcgatcttcaaaggattcacctatcactgtattttaaaaagtctcaataagttagggactgacccttatccttctgccaacaagatgtaattcccacgcctaatccactgtaccttcttgtttgaattcatactctccctgcctgtactcccctgtttcagttcagaaaacaagtttgaaatacagaacatagaatacctccagtttagaaagtctgatgtatgcctcttagttccccatacttactacataaaaggaaatgctgaacaattgcatgtactaccttagttctgtaaggtttctctctaaatattcagatcatcgtgtttggggaagatactgtgtaaggtaagtttgcagtcttgatgctgatcaatcgcaggatgctttaaatagattctggacttactagaaagttttggttcaaaccagagaaatactggagaatgttgaagtttgatacatctgattttgaactgcagatacttgtggatagtactaatatacaaatcttagataattcaatctcgtttcttagtagttatggactcttatcttttctgtacatcagaatgtagcagattacttgaattctatgcagatctgtctgcataatgattccaacagtttttatcattgcaacatatattcacctataattttaaaatctttataaagagcttatctaaatcgtagtattccaccttgttaggtacctcataagcatctctaaaaatggtttagttaggaagaccctccatatcctgctccgagaaaccattgcagcatacttaatacttagaagttcccagaagctgaaaagaatgtgagtggcttgccagacgtccagaagcttatcagtgatgaagatagaatataaagccagctttgattaaaaaccatgtcatgtagcattgtgaacattaaacatgccaagaatgtttcaagggttaggaatagacaggggaagaactcagttcaacttctgtagagactgaaggtgatcatgcccttggtctgcttcaagacaatccctcggccttaatcaaaacttctctatcgttctaaagattccccaagtgattttactttagttgtggaagaaaagccattttctagaagtgacacttcatgtgaaaatactgctggggaggaaacataatgaatctgattgtacagagaattaaatgtcttatagtcagggtcaccatttagccctgttttctcaagatattccctttcttatgcctgttgtcctcatgtcctgtctagcttagccttttagcactcaaacgtattctgagttagatggtcaccaagaattgtgccaatctttgatgcagagcagggtctgacagaacgacaacaaaaatgaaaaagtagaaaacttggctacctgctgctggacctgctattgaagagaaaaacataatggacagcaaagggtgagattcccaaagctaactgtcgctatcacagtcttaaggttaacctggcactcatttttagtactcgctttttataccagaatttgtacatgcaacaagggtgaaaactaattttacccatgacagtgttcccacatttccaacagttctccttgttacttaggtcattcctgctcatcattcacacttgaactcctgcttatttgaagaactccaattagatagaattcactggcatgatcttaaagtacaaatttatcatggttgatctcataaaccaatggttgcatagttttaatgtctagaccaaagattttaagtgcatagaaaattacattaaaaattttaaattgtatattaatcacatacctcgatggaaaatattttttttcaaaaatccagcacacagaatgaaaatgtctgaaatatttcaaaactttttggcctaaacatcaaagttacaattacatgtatgtaactcggggggcaaaatagctgcactaaattgaacaaaagaatagtctatagatttttattttttattaataatcttgacaaatcacctatatagaaaaggtcatgaaaaatcaaaatagccaaaatatacactatgttcaatttttttcataatcaaatccatattgtgagtttcgatactagtgctaaatgctggggcaagcatgatgctgccgcaagtgtgttctcttactgttaagcatttaacaacttggtgataagcttctaaagcatagtaaaccattgtccatgaattatgccagagaattcacctcataatactgcatataagcaaactcaacaacgtgaatgtgaaccaagctgagtgtctcatattcaatcacagcaatagtctctataaagactgggaaagatgtgctaaatattaagtatacatagaactggacgtttactaaggtttggaattatgcatagacaattattacatggggcatggtataatccagttgattcctttattttccaagtattcttaaatgttgctatactgggtaactcttaaaatacagtgaatgaatcaacactaccagagttggaagatggttgtaaaatctgagtggttatggagccactcatatctcccctttccctttgtgaagtaagctggggagatccccagagtctcattagcaagtttcagggccaggagtattcatggtcagggttcaggacacagctgccctgataaggatatttttggaccaattttttcgtcttgggctttaatattcccagtggaccaatagcagtcactgtggctggtccccagtaggtagccaccattctctgaatttactgtgaaataacaagcacggccctccaaggatcttgttcttattaaattatggacaaccaggtctgggtgagcattcagcactctccatcatacgaattgctactaaatgtttgcctttaattttcccactggcttaacagtttttaaaataataaagatacattataaatcagctgatggaaagccctggcataaagctggtaatatttcaagaatgagaactgaaaaatgcataaggatataatgtgggtttcatcagtaaaaatctgaattttcatcgttttccatccatccactgtggcatggttgtggtggaatgtactgaggggccctggtgtgaagttcctgtctaccagccagtgggctgcagcttccatcatttttattgtcctttgttcacataccaagtaagtcaaaactgctgaggtcttaaaaccattctgaaagtgcacctgtggtcacacaacacacgttcatgtgcctcaattctaggctcgaagacagatgatgtcttacattctttcagggtctttcagaatatcaaactttggcttacccaatgtgcctctcgggaaatatttacggaatgaattgatgtctactttgtcctgttggaaaacagcatagaacaaattatactgtcactgtttaaagaacaatgttcctccttggggaagtttccttaagcctcattttcaactgtagaatggtctagtatcttacacagttgtttggaaatgtaaaatttacgaatcagttattaatgttcttactgctatttgcaggtgaatgcatatacaagtaaagccatttttctaatttggtacacacctaaattttttggctcaattctaatttgtggtgtttaattctggaggacttgtttggatgaaggtaattggagctgtcatattcccaggaataactctaaccagtgctgcctagtagaaatcctaggggagccacagagaattctaaattttctagtaaccacattaaaaatgtaaagaataggtgaaactaattttaatctatattatccaaatatatctaaaagttaccataatataaagttttaagaagacgtgttgcatatatttttaacaggtgtttgaattgttaactttgtgctgatggcacatcttgatttggagcagtcgtgtttcaggggctccacagcttcataagcctcatggctaccaccctggatagtgcagatctatatgatgcagggagaagctatccaaataactcataagtggtcctaaattgtggtaaaatatttaactgatatggatacatatgcagaatctaacttcaagtttgagagatcccttcttttgggatacactagctctaatacttaaactagtttattttttcataagttaaatgggattctaacattttaacgagttgtatgttaataatcggtagtttgctgctgcaagaaggaaagcaaacaccacttgaccctcaacgttttctcccatgatttttcctcctatgaattcttggatgacttctcagaactcagctctttttattcaacacaggctcattctgcaatactccacctgatacatgtaagttgagcactcaaattttacaatgtacaagtgtgtcaagaatggtgtaaattaggtcaaataatgcagttattcttccataggcaaatatatactcgtggtgatcttcaaactggattctaagtgtgagaactagagtctagtataaggagagcagtgtaggatgtggacaatcctcctttcctccccaccaccctatcctattgaatcaggctggttccattcttatgtcttatatgcatcctcaccaatgtaaggtggtactcgaaagacagaaataaatggtcatgaacaaaaagattgtttgatcatgaactctaaatagtaatcaccaaatcaagaaaatccttaaatgaacaatgatggtataatgagatgtagcacaatcctgctcaggcagttctctcagggaaattatgagcttcaagaaataagattttgaccttggtttcatgactacatcataatgttttatgtaaatcagatacctttccaactttatcatatctctttcgtgtaccctacagagctatggagcagagcaattattccgtgtatgccgactttatccttctgggtttgttcagcaacgcccgtttcccctggcttctttgccctcattctcctggtctttgtgacctccatagccagcaacgtggtcaagatcattctcatccacatagactcccgcctccacacccccatgtacttcctgctcagccagctctccctcagggacatcctgtatatttccaccattgtgcccaaaatgctggtcgaccaggtgatgagccagagagccatttcctttgctggatgcactgcccaacacttcctctacttgaccttagcaggggctgagttcttcctcctaggactcatgtcctgtgatcgctacgtagccatctgcaaccctctgcactatcctgacctcatgagccgcaagatctgctggttgattgtggcggcagcctggctgggagggtctatcgatggtttcttgctcacccccgtcaccatgcagttccccttctgtgcctctcgggagatcaaccacttcttctgcgaggtgcctgcccttctgaagctctcctgcacggacacatcagcctacgagacagccatgtatgtctgctgtattatgatgctcctcatccctttctctgtgatctcgggctcttacacaagaattctcattactgtttataggatgagcgaggcagaggggaggcgaaaggctgtggccacctgctcctcacacatggtggttgtcagcctcttctatggggctgccatgtacacatacgtgctgcctcattcttaccacacccctgagcaggacaaagctgtatctgccttctacaccatcctcactcccatgctcaatccactcatttacagccttaggaacaaggatgtcacgggggccctacagaaggttgttgggaggtgtgtgtcctcaggaaaggtaaccactttctaaacaaattgcatatgctgctagagacttgaaatgaaggatacaagactttatcattgcccttgagtttaaatattctctgcctggaaacaagtgacccacatgccagcaactgtggggcatttatgggatttggaaagctgcctgggatttttaaggatttcatttttttgaaaggtatgaaggctctgaacaatgaacagtttgggctggggtaggcataaagctgaggtttagtagtcacccatgagctcttaacaaggtgtgtattccactaaaaatcatggactagcctgtttctggctctgctcagtcatggcaaaaacggtcatcttcaactacttccctgacttctctcgacttttcccctttagacagtctgtccattgaccattataaagaatcaactcaaatattatatttcaaatatagcagtcaccatcttatcctcaggctgtgttctaagtcttttgggggaagcctgaaaccatagtatagaactatagaacctgactgctgtcagtcacaacatatttgctcatcttctaccataaatgtaatacgttttctttcttacctaagcacttatcacacactgtggctgtaggttttgcagtttgaggtgtgacagcaaaattaccacaaatgtgtttttcctcctacacaatttcaaagaagattcattcttactgtagatcttggcaatctcagcatatttttcttgccagaacctccagttaagaacttattagaatgtgtctctgataatggtttggctgtttccccacccaaatatcatcttgaattgtagctcctataatccccatgtgtagtgggaggggcctggtgggagttaattgaatcctgggggtgggtttttcccatgctgttctcatgatgaataagtctcacgagatctgatggttttacaaagggtggttcccctgcacatgagtcttgcctgctgccatgtaagacatgcctttgcttctccttcaccttccaccattggctgtgaggcctccccagccatgtggaactgagcccacttaacctcttcataaattacccagtttggggtgttttatagcagtgtgaaaatggattaatagtctgtttttcagagacatgagcagagggccaatatctttagaaatatagaacacttaaaaattaagtcttataggagctagcaaggttttgccaaatacagattcacccaaaaatgtcaagtggcactttggaatggagtgagagtgggcaggcagaattatctgaaattaaaacaatctaaactccaaactgtgggagtcagtcttggcttgtagcaaccaagtctatacctactgatgatataaaaaggattacttcctgaagagagttaaagggaaggaaaagagaaaaagtgaataagaaacatggaagattgagacaccacaaaatacctcttgtaaaaagtctaaattatataagataactaagttcaacactagacaaagtattgtgacacatgaacatgagttagaaactaataccaatcaatacactgttcacaggtctgttttttccttaagttgggcttgtattaacaattttccaaactgatacagcagcacttctcaaacgctttcatgacataactataaaaattagtgatatggcaccttgaggaaaactgatgtggctgttgacagcaaaatcaactcccctgtggctgtagccaaatcgggcactgaagaccaatccagggttgagaggatcaatattggttgtaacccatttgtggctctggagaaagacacatcacaccagagggaagagtgtatccaatcaatccaatagttagttggagaactttatttatggatgacatataaaatattcaggaattattgaataacattctaaaggctgaaaaagggtatgggttttctgcttatctgcaacagagggtataaggtatgtgtccaatggatttgtgatgactagcaatcataagtaatgttgcccattagctgacttaatgcatgaaaagcattcaatgatgttgtttgggaagcagaactttagtaataagaccaccttcttttccccattagagaaataaatgttaggaagttcaattttcctaatgtttaaatatcttaatgtgctctggtgaaaactttagaaaatgcataacttgtattaccctcacttttttctctaccaattgcgttatttccatcatttttcttatgtctcctttattcctactgaggtcaatattcttctgtagtacacgtaagacaaataattctgaaaaacacttaacctaagtgacaaatgccacttttgtgaaaatagaagataggagaaagtagaaggaaaatctcttgggacccaaactcactaagccaaagggaaaagtcaagcttgggaactctgtcatgcaaaactatattccatatctgttcccgactgtatggctacagattccatactgttccggaatggacagctacacaggtagaaggctacatacctccccaagggacctccctcacaatctgctagcaaggaaattccttgctggcccaaagatctttacccgaaaaccattctcttgaattgtcatgctgacaatgtaaatgaatggcttatcttgacaggcagtggacaaagacaggcctgggagtcatccctccactcccctgaaacaaatgcatatttgactgcttcctctactgtgtaccttatcttatatacaatccagattcactgagcaggagatgaacgcccagttgagtgttcctctaaaccctctcctgtcacatctaaagtgcgaattcagtcaacactgattaaagcctgcaaagaaggaaactacttcatttattcacacttcctttttcttttttttcctctaatgcccactgtttcccttttaaatattgaagtctcccaaccgtctttggaagaagcacaaatctcagatgctcctgtcatattgtgttcctttttcccaggtgcatcctcaaccttggcaccagaaacatctacattgattgagacttggctccaatgctttttggttcacacttatttataactttaaagatttctccccaaacaagaggccagtgacttttgagaaagagcttttttagtttgtcatagcctctatttctaaagaaatttaaaatctaattttcaatttagagcgaggctcttatccccacatcactgcctttaaaatctctctggagagatgccaagattcagtaagacattttcatgatgaaataccaagaaacgattccagtccttcacttgggaaaacaatgcaccctctgcaagaaaggacaggctgcttctaaagttcatggtaaacccagtcaacttggattaattgctaacccaggaattcttcctgggggatgtgggactctattagtgaaaagactttttgacctagcctcacccctacacaatgtatttaataagaagtctgacattccactactgctttagaaagacttggacccagcttctctgaggtaggatccttagatcttcatgaaaaacagaacatcacccagatactgggatgttttcttcaggtattactctgtaactattagaaggccacgttactactgtgagcttatctgctaataactgaggcagtggtcttctcaagattaagcataaataacatatattcactatctggcaagcagacaactggaaaagggcatttagcatgaaacgtgggaagctaagggaaatgtaatagtttagaagaacatgaatagatttactgaaggaaaatggcatgtaagagccgacagttagaagaatgtgcttggtattcacaatgagaaagtttcagaattaattggtagcaggggtgcatactattggataagcatagattgccctctgaatattttgttaaaattttaatttacattttaagttaaatgattaattgctccgttcatatgcatttaggtgtggctgaagacttcatgcttggagggaaatcatgatttttttttttcattttaacctccttcctcttttattgaacccataaggcatccacgtgtgccttaagatctttttttttaataaaactattagaggtctcctagaagccatcttagcatggcatataaaagcctgttgagctgagtaactggagcccagggggagatgtggacatgttggaagctcaggctgtaggggtataataatgagtgcattgtgtttatagttgcaggtgtctgccccttgcttcagctcacctcacctcaccactgctgttcctgtgtaatcctccatgcccttactctccatttcctcttccacagtattagtagggtggactagatgggctcgcctcgcctcacctcgcctctgctgctcctgtgtaatcctccattcccttactctccatttcctcttccacagcgttagcagggtggactggatgggccatatgccagatcctttgatttctatttgccaccacacgaactgacactgctgcccagaagcattcccctgcacatccacatcacagccctcctgctggcagcttggaatttagaccttttactctcaatgctccaggaaaccagatgtacttctttctttcttgtccattggtgatatccttgacaatgtagtttaggtaagttggcatgtagcattaaaacctgtattcttcaaactgaactaacttctggcatagtaagtgttcagtaaatgttcacctacatgccattatagtgctgattttttttttttttttaaagccaagaaaacttctatcttatgcctaattttccacactgaaaatttccaaattgtcagttgggatgggagggaaagtagactacttttccatgaatgaaaacagttaccatttaaataaataggcagataaaggggggtggtaactaaggcagtatgtaattagaactggagataaggtaagggaaaagagaaattcacatcattggatactacgttgctgtggagagaaggggataaaatctgattaatgtaggaagcaaggtccaaatgcgttcattcataaaagcagacggagtacaggagtagcttgtgtaggtagaagaagaaaaggagttcctggccaaagcccactgtggctatgaacacttatgagtagcaattaatattaatcttgctttcaagactaaaactgccaggtggatctttcataagtaccttatttcagcatgtaactttctgactgaaacaactcccatttgcaccttatttctcgacgctgagttctggtctccctgccttcactttccagccgcactccaccccacacacctcagctctccacgggctcttcagctgtagttagactggactctcccctctctcttccacccctagtgcctgctaattcccatttgcgagccttttgacattatttacattgtctctgatcatgtcctctctccttcagtctcgagtttcggaatcagaccggtttccctctctactattgcactgtttaactgaactgactcctgtcttctcctggttcttgtgatccactattttcaaagcagtgatcacttagatgctctttaaaagtttcatgctttaagatcctttcagtctctagccctagggttgaacctttgaggtaaagaattctgacatggtattcctctctttaacactttcatttccatagttttagttaacctgcaatccgccaggttgctatctaccatgtgtagaaaatattaaatgaaaaatctcaaattttaaattgcccaccattttgagtagtgtggtggaaatatcatccctctgtgtagttgattcacactgtctatgctaccccctgagtcattcagtagctgtctaggttatcaaatcgactgtggcggactcagtgcttgtgttcaagtaactcagtttttcttaatggctccaaagagatggagttagtgaagctggcgatttagatgtgccaaagagaggctgtaaggtgcttgctttaactaaaaaggtgaaagttcttgacttaaggagagagaaaccctcataagctgactttgccaagatctatattaagaaaaactttatctttgaaatcatgaaggaaaaaattatgcaagttttgctgtcacatcaaactgaaaaagttatagccacagtatattgtcttaggtattctattttattattgttaatctcttactgtgcctaacttataaattcaacttgatcataggtatgtatgcatgggataaaatatggtatatatatagggctcagtactgtctgcagttccagatatccagtgggggtcttgaaaactgtctcccactgataaggggaaactgtacctttgtccactactcaaactgatgcatagcatcttctggtttgctatgacttcatgtatgtaaaacttctaaagtacctggcacacgtaaagccctattggtttatggtttggggaataccaaacttcctgtttctcttcctccgtctcttagtgccttccacaccattatcttctctcataagctttaatcaaagcagaaagatcccaatatactatccttggccccctttttctcattcaggaacaaataatcgatgactcttagagctatgtggcacttaggattagtaacatgttggtgacatgccattcttttactgaaagaacactgaggtctggagaagtaactatgcgtgtcatccccagagcaatttgacagctgagcaaagcacaatggcattagctgttatttgtggctaaacacctttaaaaagtccccaatatattttcatttttagaaatccccactttagacttaaaatgatctgtttctatgaggatttttgatatgatacattaatcaaacttaactatgtgccccttaagaatattgtcagttctatcaatcttcatagctcacccagtgctaggtgagtgttttgaacacggaatgtgtttgtgcttcaggcattctgtctctaaggatggaatggaaaacccttccctttcaagctttacaggtacgttgtgtcaagtggagaagatcagttctggttagcagctttattgccacagaaaggacactggcagatacttctcatagctctagtcatgctgaattcccggaaaggggtgtcagaatgaattgctctaagctcttctccctggtagaagaacctgtgacttctcttggagatctcttcaattttcggtgagtcaccaattgttcttgatttctatggcttctcccagaacaactccagggctgttgtcctgaaacatacagctttgatcacctggcaccctgcagagattctcctttccctcttctccatgtggcagaccacaggtagaataaatgcctcttggcgagctcactcatccctcatccatcagccccaagtgtgcagataacagatgtggagctcctgtgcttggtgtcctccacctctcggcttgatcttcccaccctcccattcctgccagatgattatgttgcaacactgggtgatgttataactggtcctgggggtcaggggttctgggttatgttctaatctgcactggggagaaatcattcaccgccttgaagagcctgaagctttgatcacgcaaataaaagctttttctttttctttttctttttctttttttttttttttggaaagactagttgatgaaggggaacctaagtgtcttagagtggagaatgatgatagtgagggaaagatgacctgatggggaatggaatctaggatcttgtatgtgtgaataagtcaaaccacacatcgtaatgctaaatagcatcaactctaatgttaaaatgtagatgctcggaactgatgtaaacagaagtaactgatgacatgttttgtccataatgcagatattttccctgtctacttgcaatgcccagtagcctatggaataacattaggcatgcatttgaacatgtcacatttggttctaaatattggcttcattgaaatgggtgaattgctcgtttgtgccaagcagtgtagttctgctctttagcagggccttttccctacacatatccccacccactcacagatgcacacaccacacataccatgctcacacactcacatatgaacacactacacacacatgtacacacaacgctcacactcacaaggaacctctttttttttttttaacacggtctcggttgtataaaaatgaggtggctaaaatcatatctttctcctgtttcagcttttttactctcctcttctgggatcctacagtaagataagatctaggagttgaaaacgttcttatccttttatcatagacatttgaggcaatagtgttttacctcctctttgaataccttgtggagtctgattatttacatgaaacaaaatgctctggttcatgttctgattcaaaagtaattggttattttcttaggtcattttcgtttgtctcattcttgcctatttcagttcctcaaagtatatttttaaaaggatgattgtcagctaacctaacactatagtaattaatgtataatatccataatgcatttaactgaaacaatagatgtgggtcaagacaaacttactgtctgcgagattaatatttttaatttccaacaagctattgcaaaagccactgcaaatggaattgtatatttaaatagtctcttgacccatgattcgaagctgtggctatcacaagaaaatctttcacctgttagagaaggcaaaagtagctgacttttatcacgcttgacaggagttaatatttgatgctcatgtatttttttctcctcaaccaaggtgtgacaaactgaagtttcagcacagaccaacacaaaaattgcttttttttctttctccctttggatgtttattcatcttttaggcctattactcatatctccatctctgagcactaagaaggaaaactctactgttgctattgtttttgcttcaacataaggagagtttattccttgatgcttcagggactgtaaattttgactattctagaaccaaaagattcagatacatttgtagtattggtggccaaaacgtttgacagaaaacaagtttcttcagtaatcctgtcactaaaatgagaagaaatacaccataatctaataaagaaaaattcatccctcagtattcctgaacatataaaagggacacacattcatattactcaaaaaagcatgagaattcattccattgattcaaggaatgtttgatactgctgtgtcgcgtctgagttcagaaatttctttaccatctatagtttttgttttcttgttttgttttttgagacaaagtcttactcttgtcccccaggctggagtgcaatggcacgatctcagctcactgcaacctccgcctctcaagttcaagcgattctccttcctcagcctcctgagtagctgggattgtacaggcacctgccaccatgcccgattaatctttgtatttttagtagagatgaggtttcaccatgttggccaggctggtctcgaagtcctgacctcaagtgatctgcctgcctcggccacccaaagtgctaggatcacgggtgggagccactgcacccgactgtagttatttttacttataaacatgaaggatcagtaaaatggtagagaaataaacttgaggaaaaaacccaagtagcagtggattactaggatgatataatattaggacaggttcaggatgccactctgtcagagaaactctaacattttggctaaacaatattttaagatgaggtcatgattgaattctatgatgcagcatctaaattttagcagaattcattgtcaactggaaagaccaccaggataacgaaactaaagccctgttctgaagcagtttgtggtggttgtcctgccagatttatgatccccaaattattctgtgagaacaaatagacacaagttctcacagcagtccatgcctaaaagatgaactccttttgcaggacaaaagtctaaccacaagacagtgtggctcctgaccccaaatgaggtcatctgtactgctttgatgttcctgactttcataaagctgttcagtaacaacagcagccaaaaaagtcagttatctagatgttttctatcaatttaagtcacaaatagacgtctgtggatgactctagtacaatcatctcgatggagatgcagagagcaatttaaattcaaatcatttcgctaggcgaaatgggaaataaggcacagtaaccaccctcagaaaactttcaatctaaaagtgataagattatgaaatgtattcagaagatagttcaaagtaaaaatcagattctaaaccaggtactgtatgaattacatttacatctcacatccagcctgtagagtacagaactatgatgacctttcacagatgatgaaattgagttgagattaattttctgtccaatatcatacagatcattaatactgaaacccaggatttcaaatgatcctgaagtaggtgatcttttcttgatctcacgctgcttctgacatactattcctggtgggctcttcctacatatcaggtcgttaaataagctgccagatttctgcctttacagcccaaggagcttgtcatggaccatgggcatggagggtcttctccagaactccactaacttcgtcctcacaggcctcatcacccatcctgccttccccgggcttctctttgcaatagtcttctccatctttgtggtggctataacagccaacttggtcatgattctgctcatccacatggactcccgcctccacacacccatgtacttcttgctcagccagctctccatcatggataccatctacatctgtatcactgtccccaagatgctccaggacctcctgtccaaggacaagaccatttccttcctgggctgtgcagttcagatcttcctctacctgaccctgattggaggggaattcttcctgctgggtctcatggcctatgaccgctatgtggctgtgtgcaaccctctacggtaccctctcctcatgaaccgcagggtttgcttattcatggtggtcggctcctgggttggtggttccttggatgggttcatgctgactcctgtcactatgagtttccccttctgtagatcccgagagatcaatcactttttctgtgagatcccagccgtgctgaagttgtcttgcacagacacgtcactctatgagaccctgatgtatgcctgctgcgtgctgatgctgcttatccctctatctgtcatctctgtctcctacacgcacatcctcctgactgtccacaggatgaactctgctgagggccggcgcaaagcctttgctacgtgttcctcccacattatggtggtgagcgttttctacggggcagccttctacaccaacgtgctgccccactcctaccacactccagagaaagataaagtggtgtctgccttctacaccatcctcacccccatgctcaacccactcatctacagcttgaggaataaagatgtggctgcagctctgaggaaagtactagggagatgtggttcctcccagagcatcagggtggcgactgtgatcaggaagggctagcagggactcccacagcatcagagtggtgactgtgatcgggaaggattagcggggactcccagagcatcaggggtggtgactgatcaggaaggactagcaaggactagcgcaaacatctgcggtgctgcggccaataacgcagctattacagaaaatatggtattggttctgaagaatgttcagtgtcactttcagcaattcaaaattaacaggcaaaatcatcctgttgcaaggattacttaggaacagtagcgaagttggtgagcatctccgcattagtcaactttgttcaactggattcacaaacatttccagagggcattctcagtcaagtagccctacaaaccattcatggcacgccaagcagctcttggaagtgcccatgttaacatgtgaccatgagtccttcctgtctgtattgctaacgtgtgatcatgagtcctgcctgcctgtattgctgacgtgtgatcatgagtcctgcctgtctgtattgctaacgtgtgatgagtccttctgtgtctgtattgctaacgtgtgatcgtgagtccttcctgtctatattgctaatgtgtgaccatgagtcctgcctgtctgtattgctaacgtgtgaccatgagtcctgcctgtctgtattgctaacgtgtgatcatgggtcctgcctgtctgtattgctaacgtgtgatcatgggtcctgcctgtctgtattgctaacacgtgattgagtcctgcctgtctctattgttaacctgtgatcatgagtcctgcctgtctgtctgtattgctgaccaacttttgaatggaaattggaaggagcatttgccacctccttgatgacttaatttcaaacattcaatacaagtaaaatattttctagtgctaaatgtgtagcaattttattagaaaacatttaggaaggtgatactatttttggttccatgttcttagttacattttatgaatgttatcacttacctctgaaattaaatacttgccctgcctttattcacatggagtccaatatattcctggaaatattgattcattgattgaaaattgactctgccattaagattgttacatggccaaaaacctacaaaactgccatttatgctcaaattgttaatagataaatgtagaatgaataaaccaagacattttattagctaacttagttcccgtggaataagttgctcaattttcttattctcaacatcttcattgatatgctgaagacaagtatttttgtaattagttggagttaggtgtggtgctttgatagatgtgtaactttggtggaatactaactaagcaaagactacactgaccccaccattcatgtaactttagtttctcctgtgtgtaaggtcctgaaatatgagacataaaaaatattgacggacctggtgtttattttctttgttgatacgaggcttagaaaacattggacagagcggttacatagttgacaaagactaagcaaaggttactcagccttatgttgttctagtgtcaacacagatagaaggaaaaatgtttcctccattgttgctgacgtagataaagaatattcccttcaatatgctaacccctaggtggcttttcattcagaaggttcctaataatttgatctttaccctgaaatcaaacacatggaaaagagatggaagaatgtcctggagggattaagtgaagaaacagaccaggattcatttatgaaatatcctcggtgttatttcaattcagctccattcacattttattcttttgtgtctctgcactaatgccctccatattctccattctcctgccttagctagcaccttctcgatcttccctctacaaaactccttcagttcacattgcatttgtgctctatcctgggatatgtgttttctttcccatttcctcagttgctatgtattaaaaattaggacttttattcttatgtttccaagattaattctttgcatatttaactagaatatttaactctaacattgacagacatttcaagagtatacctgaagcaataagcgaaatgcattttgacaagtttctagggatatcatggacattagtgatcggggcatggaaggaggtgacttattcaatgtttgagtctatttaacaaatttcatggtggttacatcaacgtgttcttttcctggtgatttatcaatctttccactgttgatgtgtgtgcttttctgttaggctctactttaatacaacttaaaaaaaaattttaatctcattttacacatggtgtgtatccactcccttcacacataaaactagtcccactgtaaaagggagtgaccaaggatttttccccagtcatctcaccaaattcttacataaggtaatttgtggtcaccagatttgcttctttattaaaataatatataaattttaatattgagtaatacacatcatatttaagttactaaattatcagttgtatacctgaaacatggcatgcactaatccaggtaatgaggaaaaaatagaagactgtccctagttttgaaaacatttaactacattacctgattttgattctgatcttcacaaattcttataaagtatttagagaaagaattagccccatgggagatgaagaagctgatgttcacagcaaattattgccccattccagcaagaggcagatggggcttcagaaccacgtcttctaacctctggtctggtgttttgtgccaagccatgatactgataaacaatttacaaatgagagaagtggctgggcatggtggctcatgcctgtaatctcagcactttgggaggccgaggcagttggatcacttgaggccaggagttcgagaccagcctggccaacatggcgaaaccctgtctctactaaaaatacaaaaaattaactgggcgtggtggcacatgcctgtaatcccagctacttggtaggtgaggcaggagaatcgcttgaactcagagtggaggttacagtgagtcaagattgtgccactgcactccagccttggcaacagagcaagactgtctcaaaaacaaaacaaaggggagaagcacatggcacaatgtgtatctgccagcttgttaaccctaataatgacctggggacaaaggtcccttcagagcaacatgctgataaaagccatgttcatttgctgttggatgctagttaggctggtctagccaaggacctgatgacccacattgaggggtaatcagattccctgtggggtctttctgcaggtaagggatatggatataaaattaacttgcttctacagacttgttttatacaataaacatctatatgcaatataaaattgtaatagaagaaagcataaagtctacttattaaataccttattaactgctttattcaatgctcaggaagatatcaggcaaaaaggaatgatcagagaaactgaagataattagataattatttagcgtaaagaaaacaaaatgcagacctctgtatccacaaaaattaaaaatctgaaaaagtgacagaacatccctgtcaagttggacaactgactttaaatgaagtgaagttctgctaaagaattctgacaattctgtgaaaacaaaatgactgaaatgtcaggtcctgactctacaaagaagttccatacataaagcaattgtattcatagacaactttatggcatcgataggttatttagttaaaacaacaggctgattcacacacaaatgataaaaaccagatgcatttttaagcttctttttcagctgtgattgtactgaggatggatttcttaaacctgggtgactcccgtgaccatgtcacacacttagcagcatttcactgtgtgcttccttctaaatcccaggtaataaaggccaggaaaatacttggtttgttttgactacattcctttggtttatacaactagcaaagaatataaaatggtaaatacctgtagcttgaactctggttgtttcacattgtattttttatgagcactttaagcttatttggttttattaaatcatcacatacctaaaaacaagaattgttaggcatcgcaagcacttaaaatttttcctaatacagaatttgcccttaataaatactagtgtaataaatgaatgaaaaactttcattttagaaggcttagtaccttttaaaaatctttaaaagaaagtttccttggcatctcaggtttgaagagacgacgtggaaactgaagattaacaaagttagacttttataggctcacatagaactgcatgtcaagggtgatgctagaagcaaaaaaacaccaaaaaactaaaattatttccagcttcactgataagtggtttaactattttaaaattggagcttatgtaaaaaagtcattggcttttgctagattcttcatatattccttctttgaagcaaacaggaggtaagtcccattaaggggcatttctcaagggtagaagcagaaaacactttcatgactgaaaatttaaatgcaaagtttaggattacatatgtcagttgatgttatcaaaattgttctttccctggatttccaaagtgtttaattgaaatgaccagtgatgttaatgaagtattctataaacttggaaaaattaaaatcagaaaacatgtttgaacatagttaaaaccatatctttgggcctcagcttctgaatagctgaaggtttaatgaagagaactgcttttctgtctccctgtataaactggggaaactacttcaaagggagaaaggataatatagtcttggcccaaggcagggatgcttgcaaataatggctttgtgtaatttgaaagattgtaaaaatctttaccttttttgattatctttgaaatgaaatcccttaatacatacacagcatgtattataatcttgttcttagaaatagagaatacagttgtaaggagatgattatataggttgaaaatatgccaccttttcacttaagaatacaatgaacctgctataggatgaagaatgaacatagatcacctcacattccactggtcacttagaattctattatgtactaaaacctaaattatttagtacgtgtccagttagcagacgcttaggttacttccactttcttattgcaaataacaccggaatgcacttttttaataaattgcccactcatctgattatttccatactacgcttccctaggagcggaagcttgtacgtattttttaaactcctggcattgactcagtgcacgctctcaaaccagaaaacaagacagaaaacccattgtaattcccaccagcagtttgagattcccccctttatcctcgatgttgatacaacccagctctcatgtagaagttcaagttgaataagattgactgaaactctatttctgcactgtggcccttctacattgctatcctattgaggaagcttcgtgggctcatgctctaggtaagaataaaattaagttcaagccctctgcctctggcaatccaaggcccagctgagtagatctgcatgtcattgcatttcatcgccttgcaagagtaagaagaatgtgaccctaactgtgcagtgatagacacgtattaagagggagggatgagttgttttcatgactccacctaagagaggcctgaaaagaccgcttgattggcaagaggccaaaaacagcgttaattttccaaagatgtttagttcaataacgaagtctagataatctggctcaagtcgtgaataatcatttcagaaatggtccctcaactgtccccaatccacagcagggagactctcctgtaacttagttcccccaaactcccaactttagggaacttctaagaaagtgatctagtgtgttacaacaaaagtaaacatcaccataagaatataaagtctgactacacagttggcccttcaaattatcttttaaaaaaatctgtccattagaggtcttcagtacctaggaaaatataggatacgaggacaattatgttgaaaaattatcataatttaactcattgtttcattgctttggctaggactttcagtaccatgttaaatagaactggtgacaatggacatcctcactttgtaccagaccataggagaaacattttcattttttattaactgtgggcttttcttatatgatgtgttgaactaagttccttctatacctgtttttcagagtttttacatgaattgtcaaatgtttttgctgcaaatttttttattctcttaatgtgttatatcacactgattgatttgcctatgttgaagcattcttgcatcccagagatacatttcagttggctatggtttattctctttttaatgggctgttgaatttggtttgttagtattttgttgaagatttttacacctatgtttatcagtgatattgacctgcagttttatttgcttgtgattatctttgtctggctttgatataagtgtatgatggcctcataaaatgagtttggggcgttctctcctggtttttgaaagagtttaagaaggattgctattcttctttgaatgtttagaattcatccacgaagccatttggttctggtcttttctctgggaatcttttgtttactaatttgttcttattggtctgttcaggcttcctatttcctctttagttttggtaggttgtataaatcaagaagtttgatttcttatagattatctaatttataagtgcataattttcataatagtcttttatgatccttttcattttgaggcatttgttctaatgactcctcctatttctcattttagtttaggatactttttttcttagtctagctaaggtttatcaccttttaatttttaaatagttttgctgatttttctagtttttccagtctcctatttctactttaatattttattctctatgataactttggacttaggctttctgtttctagtttcttgaggtaaaaagttggttaatttgaattttttctttcatgtggctattcgttgcaatcaacttttctcttagtactggatttggtgcatgtcataagttttagtatattgtattttttgtttgtcttgagattttaattctcctttgatttttccttttgcccagtcattgctcaatttaatggtatgtatgttaacacaccaatatgtgatagagcacataaacctccaaattactaaagttataaaagatttatacaacatacttaatggcaacaaaacttgtagatatgaatgctcacaacaataagaaaagtccacgttattttctagtgcacatgggattctcaccaaaatcaatcacaggtgggcctttgacagaataatataaacacgacataaaacgtgtaggatgcagctaaaccagtggttacagaaaaatttgtccccatagatcattaagaagaaaggaagcctaaatattgactaatctcctaattcaagaagatagaataaaaaaattcaaattatatctataaaatgtgaaaaaaggatgaagtagacaccatctatatataaatgtgtgtagaaatcatagattaatattcatgtttctgatttcagttccagatcaaaatgtctataatcatttttccactttcatgttctttttgcattattttaaaaaatatttttaattgaaatattaaaatacatattttatggggtacaatgtgatattttgatacatgtatattatttgtaatgatggaattaacctaaagaacatatcaccaattttcatggtgagacatttaaaatgtacccacttagcaattttgatatatacaacacatatattacatatataattataattttgtattatatataatatacattatacacataaacatgtatatatgatatatacaattataatattttgatacatacaacacaatatccaactttgatacaaatgaacaagattttcttctatttaaaggctgaattacatttcactgtggatatatgtcttgttttctatatctattcacccattgatggatacttaggttgattccatatcttggctattgtgaataatgttgcaatgaacatgggagtgcagatatctctttgacatacccatttaaattggatacatccttattaatggaattcctgaatcataaggggttcatactattaaggcctgcatcaaaaagtctgaaagagcacaaataggcaatctaaggtcacacctcaaggaactagaaaaacaagaacaaaccaaacccaaacccagcagaagaaaagaaatagcaaaaatcagcgcagaactaaatgaaattgaaacaaaaaatacaaaagctacatgaaacaatgttggttctttgaaaaaaataagtaaaattgatactgttagcaagattaatcaggagaatagtcaaataagctcaactagaaatgaaacaggtgatatgacaaccaatatcacagaaatacaaaagcttattggtggctactatgaacacctttatgcgtgtaaaatagaaaacctacagatgatttaatttctgtaaatatacaatgctcctagattaaaccaggaagaaatagaaactttgaagagaccagtaacaagcagcaagattggaatggtaattaaaaaatgccaacaaaaaaagtctggggccagatggattcacagctgaattaattggcatcaatcctactgacactattccacaagatagagagggaaaccttcctagatcattctatgaagtcagtattgccctaataccaaacccaggaaaggacataacaaaaccatagaccaatatccctgatgaacatacatgcaaaaattctcaacaaaatactatctaacagaatccaacagcatatcaaaaagataaatcatcatgatcaagtgggtttcataacagggattcagggatggtttaacatatacaagtcaatacatgtgatacatcacataaccatgtgacttgtgtttttaattgtgtttatctcaatagttgcagaaaaagcatttgacaaaatccatccctttatgattaaaaccctcagcacaatcagcatacaagggacatgctgtaaggtaataaaagtcacctatgacaaacccacagcaaacattattctgaatggggaaaagttgaaggcattccctgtgagaactggaacaagacaaggatgcccatttttgccacttatattcaatatagttctggaagtcctagccagagcaatcagacaagagaaagaagtaaagggcatccaaatcagtaaagaggaagttatgctatcggtttgctgataatatgatcgtataccaagaaaaccctaaagactcatccaaaaagctcctggaactggtaaatgaagtcagcaaagtttcagaatacaaaattaatgtacacgactcagtagctctgttaatacagcaatagctaccaagctgagattcaaatcaagagctcaacccaatttacaatagctgcaaaataaaatacttaggaatacctaaccaaggaggtaaaagacctctatgaggaaaactacaaatcactgctgaaagagatcgtagatgacacaaataaattgaaacacatcccatgctcgtgggtaggtagaatcaataattgaaaatgaccatattgccaaagcaatggacaaattcaatgcacttcccatcaatacaccaccatcattcttcacagaacaacaatcctaaaattcatatggaaccaaaaagcccacatagccaaagcaagactaggaaaaaaagaacgaaaccagaggcatcacattactcgacttcaaactatactataaggccatagtcaccaaaatagcttggtactggcataaaaatcagtatatagaccaatggaacagtatagagaacccagaaataaaaccaaatactatagccaactgatcttcaacaaagcaaacaaaaacataaaagtgggggaaaggacaccctattcaacaaatggtgctgagaaaattggcaagccacatgtaaagaatgaaactggaacctcatctgtaaccttatagaaaaaacaactcaagatagatcagacttaaacctaagacctgaaattattaaaattctagaagataacatcagaaaatgttatcttgtagacattggcttaggcaaagacttcatgaccaagaacccaaaagcaaatgcaataaaaacaaaaataaatgagacttaattaaactaaaaggcttgtgcacagcaaaagacataatcatcagagtaaacagacaacccatggagtgggagaaaatcttcagtctctacatccaacaaaggactaatatctagaatctacaagaaactcaaatcagcaagaacaaaacaaagccattaaaaagtgggctaaggacacaaatagacaattctcaagagaaaatatacaaatggccaacaaacatgaaaaaaatgctcaacatcactaattatcagggaaatgaaattcaaaaccacaatgcaataccatctcactcctgcaagaatggccataatcaaaaaatctttaaaaaatagacattggtatggatgtgctgaaaagagaacacttttatactgctggtgcaaatgtaaacttgtacaaccactatggaaaagtctggagattccttaaagatctaaaagtatatctaccatttgatccagcaatcccactactgggtatctacccaaaggaaaataaatcattacacgaaaaagatacttgcacacatgttcacagcaccacacttcacaattgcaaaaatatggaagcagcccaaatgatcatcaatcaatgagtagataaaatcatatatattcatatattcacacatatactcatatattcatatatattcatatattcacacatatactcatatattcatatatactcatatattcatatatactcatattcatatatactcatatattcatatatactcatatatcttcatatgtatatagatgaatgctacttaaccatgaaaaggaatgaaataatggcatttgcagcaaactggatggaattagagaccgttattctaagtgaagcaactcaggaatgaaaaaccaaacattgtatgttctcactcacacgtgggaggtaagctatgaggatgcaaagggataataatgatacaatagactttggggacttgggggaaagggtggaagcaggtgagggataaaagactacacatcaggtacagtgtacactacttgggtgatgagtgcaccaaattctcaaattgccatgaaagaacttattaatgtaaccaaacaccaccggttccccaaaaacctattgatataaaaaatataaataaatatcatatatatatcatccaggggcagtagcttatgcctataatcccaacactttggaaggctgaggtggaaggattgctttagcctgggtatttgagaccagcctgggtaacatagtgagacctcatctctccaaaaattaaattttaaaaaatcagggaggcatagtggcacgtgtctatagtcctagctactcaggaggctgaggtgagaggatcgcttgagcccgggagattgaagctgcagtgagccacaattgcgaaactgcactccagcctgggttgacaaagcaagaccctgactcaaaaacagggcggtatatattttacagatacatcaaagtcttatctgtgctctcttgaattccctctcttagtgtcctcagaccaatttttttaaacaggtgtgtatcttccctatcaatttttaatatttttattgcagatatgtgtccaaatgtaatattttagtaggatgtatttgttaaatggtaacacactgatcattctgcaacatattttccttcaactttactaattgaaatgttcacaataaattggtattaatattgatcatgtgtgcattttctttatattaatatttaggtttaccactttttcatgctttataatgtaagagtatctatccttgtataatctccttggaagtcttaggtagtgaagaaagaacatcttcaatgttatgagatattactgaattcatctctaaaggagttgcactaatctctctaaccatcatttttccttcttcatttatttaacaaataatcaatttttactattatgttggtgcaaaagtgatatatgccaggcatagtgctaatgttagaaaacaacagagaagaaaataaatatattttggtctccttgtgcaataacaaaaacccaaacagtgaataggtaaaacatacgatgtggtcatgccagatgatgatatgttatgaacataaaatagggaacactgttgcaaattttaaatataattatggatcagtcagaatgcacaaggtaatgccatagtaacatctcaagctgcataaaaacattgtttatgtgatgttcacattgtaaatctgtcagatggtactcggggtccactcatcaaaagtccctcaaggacctaagatgatggataactttgttgaccattttgtcattttatgttctagaatatgtttatatttgtggctatacatgaagcttgtacaactattgaagtatatccataaaaaaaataagtgtacagctcattaaggatttcatagcagtacctaaaatgtatctagaattttgcaattttacatattaataaccctccacctgccatttttaaatgcttatttagatttctaactttcatacctatacagcatttggatagcccattaatttttaattatacatattcatgtggaattttcattgaaacttaggaataattaaaatacaagagtgagttgaagcttgtgtgaagagtacaaaagaaggattgtgatgtctgaggtgtgagagttctcactgattgagtagagcacgccttcataaagaaattgtcatattatctgagcatttatgactggtagtttatatagaaatgcatttggtaaattcacagcaaagaagcaggatacgagaagttatgaaggaatatgaaagtgtgtggtttaaagatactctgagatattggaagaagcaatgttggaagacagggtgggtaccagccaaggacagaatatgctcattctgtctcctggtgtcagtatctgcttctgcagttgggcttatgagttggattctgcatctgaggattcaaccaatcatggacttaaccaatcatggattgaaaatataattaggcttatcatggtcacattggtacagacttttctaaattttatttttgttgtgacataggtgtatacatttatggggtacatgagatgttttgatacaggaatgcaatgcataataaatgcatgatgaaaaatggagtatcctctcaagcatttatcttttgtgttataattttattatacccttttagttatttttaagtgtacaattaaattgttattgacgatgtcagtctattatgctagtacttattcattctaacaaatttgttgtatccattaaccatccccacctaccccttcaccacccccagtacccttcccagtatctgctaagcatatttctaatttatatctccatgagtccagttgtttcgattttaaggtgccagaaataactgagaacatgcaatgtttgtctttctgtgcctggcttatttgacttagcataatggcctccagttccatctatgttgttgcaaatgacaggatctcattatgttttgtggctatatagtacctatcatgtataagtaccacattttctttacccattcatctgttgatggacacataggttgcttccaaattttagctattgtgaacagagctgcaacaaacatggaagtgtagatgtcttttcagtatattgatttcttttcttttgggtatatacccagcagcgggattgctggatgatacgttagctctattcttagttttttcgaggaacctccaaactgttctctgttgcacctttaaatacaactttaaatgcaacttcacattcccacagagtttatgagggttcccttttctccatgtcctcaccagcatttatttttgcatgtcttttgtataagagccattttaattgggatgagatggtatctcattgtagctttgatcagcatttctctgatcaatgttgagcactttttatgtgcctgtttttgatttgtatgttgtcttttgagaaatgtctattcaatcttttatcaatatataaatcagattattagattttttcctatagatttatttgagctccctatgtattgtggttattaattccttgtcaggtgtgtagtttgaaaacattttcttccattttgtgggatgtctcttcgttgatttatttccttcactgtgcagaagctttttaacataatgtgctctcctttgtccatgtttgctttggttgcctgtgttatggagtattactcaagaaatatttgcccagacaaatatcctggagattttctccaacgttttcttctggtagtttcatagtttgagttcttaaagtctttagtccattttgactatatctttgtatatggcgagagacgggactagtttcatttttcttcatatagatatccacttttcccagtacagcttattgaagagacgatcttttccctggtgtatgttccttgcacctttgtagaaaatgagttcactgtaggtatgtggatttgtttctgagtattcggttttattggtctatgtatctgtgtttatgccagaaccatgctgttttggttatggtagctctgttgtagtataatttgaagtcaggcaatgggattcctccagttttggtgggttggttggttggtggttttgcttagaataattttggctcttctgggtgttttgtgctttcatacaaatgttaggatagtgtcttctatatctgtaagaaatgtcattggtattttgataaggataacattgaatctacagattgctttgagtactatggatattttaacaatattgattcttttggttcatgaatctggaatatgttttcatttttagtgtcctcttcaattattaatgctttatagtttatcattagagaactatttcacttctttggttaattcctatttaattttatttgtggctatcataaatgagattactttttaaatttgttttaatctatttgctattgacatatagaaatctgccttgtatcctgcaactttcctgaatttattagttctaataggtttttggggagactttaggtttttccaagtataaggtcctatcatctgtgaacgaagataattttacttttctttgaaatttgatgctatatctatatctctatatctatatctatctatatatatagatatatttacatatagatagatttatttatatttgtttctcttgtctgattgctctagctagaacttccagtaatatgttgaataacaatggtaacaatagttgcactaaagtgcaagactaagtctctcttaattttctttaattttctgtccactttcctcaagcagaaggagtcttgccccatagccaccatagctggtaatatgctgagtctcacccggagccagcatgcctcagagtttcacccaaggccctcatgactctagctggtatccaaccctgatgtggctgagctggtatccaagatgcaagacaaagtcctcctcactcttccctctcctctcctaaagcagaggaaagaggcctcttttggagccacaagccgtggaggctgaggttaggggatgagtttagctgccctggctggtgttttaacaggtcatgtgtcccccgagtccactggctctgggcccagattagcattaggatttgcagctcttgtggcctagactgcccttcaggtttgtctgtggctccagagccactttagcccttcatggtgaggcttgggtaactcaagttccaaacactgggattcgcaattcccttccagcaatggctggtttaaatgcgcccttcatggtgggtgtcagctgaatttggtctgggtcttctttctgctataagaagggcatcgctgagctcagtgtcttagaattgctggctctccctctccttagtgcacagagaagctctccataccacaccaccgctgctgggggatgaaggggtggtagtgtcagtgatgcaatactgtttttccaacttcttcaatgcctcattcagaaatatgaatttaactccatgtactgtgagtgctcacctgagttttggttcttgagaaggtgttttttgtgtagatagtttttaaattggtgttcttgcagggggatgatcagtggaaccttctattctgccatcttgctccatcctccagacttttttccttgtcattatttcctaaaaaatatagtataacagctatttacatagcattcatattgcattagttgttataagtaatctagacatgatttcaagcatacgggaagatttgtgtaggttatatagaaatactctgccatttcatattagggtctttagcatcatggattttggtattttcacgatgtcctggtactgaggacagatagtgagggatgactgtacacagggatgaatacactactcagtacttgtacgtttgtcatgctagaaagactcagcaaagtctcggaaccttgcaggcactgagaaaagtggctcccttttcccattctctttcattcccaaattatataatctaaattcgatgagactaatatttcaagggaagtctctgagcctttaaggagaggggcgatgtgggagaaggtcaccctgtcatggagaaatcttagaccacattcggtcatcagattcatagatgtcttaagagtcacagaagcatagcaagtacataacactccttttgattctgagaaagtgacactcagagcttttagtgtcttgactaagattacacaattaattggaagcaaatataataaatggtaaatgttttagaacctaaaaggttgtcagactccgatattttctcctgaatctgggaaagccccagctgtgttaatggagagtgtctacagatgcaacttttccccacgaaagatggctttgtagggccatttcaaaatatgtcaaatacatactttggggtggaatattttgattttcctcagggtctgctatctgtcatgtgatgctataccagagtcaggttggaatttggtatcttattgccactcagtctgttttgtcagtcttaggaactctatttcaatgttattgctggtcagttgtgcctaaattccaaaagatgggtgtaatgaagtgtgtctcccttcttatgtcctgcaattaagcttttcagctttcctgagattctcgtggcctagagggggtctgttcagttgattaggggtcttaggattttaaatttagtttacagacttctgacactggttttgcatgatcctccctttgtgaaattcagatttgcttttacaaagagagcttattttaaatgtctgatatgaaaatataattttaaactagaaaaatgaagttgtttaaaaaatgtgcaacgtcatgagaaagatggatttgcttttggatagatgcatcgcataaatgaaaaacatgtttaattcccacgtggaccgtgagtggaaagttagaatataaccatcaaaaacaaatagcaaaagaaaacaaaaataccaaaatagtggattctgagagggtcttaaagaaaatagaagctccaggaaagagacaatgccaagtacaggaaagatgaataagaaggaaaaaaaaaaaaaaaaaggaaaacaaggcaaagaattaagcaataaacactcatctcaattccctaatgtgaagaaactgacgatgtaattttctcattttcattctgaatttaaacccctttgctttggccttagaatggtgaaagcagcttcactgagctggcgtggcttagatttattgtctgatggaacagaaaagatggagcaaaaggtttgtgctctatgtgccgtgttcgtctctttgttgaaaggtgtcttgatgacctgtctcttcagtgctttataaaggggataagtaaggaacaaagatacctgactcttgttgctagctcttcataattctgactttaggtttcctgaagtcccagggtttttttttgttttgtctcttgttttgtgtgtgtgctttgtttttgttttgtttttttgtttttttgccctaggaacagtgcgttgtatttcactttgcatttccacatgcctcagtcactattagttttttcctcagcattatttctctaacctgcagtacagcaaccctgaggatgaccaaacctcagtcatggagctcctgactcttcattagtctagaagttagtgggctttttaactttgagacaattgtatcaagcatgattaaaacaatgcaactggaaaattaaaactgaaatattcagacaaagcagtcactgagcaaagctatgaatttatgggaggggatggtgattagtttgttatgcaaaggagatgcaggacaagaggatccctaggcttggttgcagggctgcggttttatgaaagattcaacacaactgcctcatgtgctttaacttcatttttcaatcactatgaacggaattttggacattttaggcatgatttttgggggataaatggtatcagcaaaatgaaaataaatattttgtttatatttcaactaaatacttgatatttagggcatctgcagcatttattgctgtgatttcttgtaaaaatatttctctgcctgacagttaataaattaaatgccttagatttcactggggactgggagagggctcactgtgcctactgctgctctcctgctcggcactagttctgcaccccaagctactctcctcaggcaggcgggactctccctctgctcctctgccccagtcagcactacttatggaatgcaaccttgtgaggaatagcagaataaattgaaaagttttcgtgaggaaagtggacttaaatggagatatataatggtagaagaaatttaaggagatttccagttttcagattatttcatggtattagttatgatatttgtaccattaacaatattaatattaaccttatcagccgtgatttccatcactgagtcctggatgagctactgtatccaaaaagtagtgaaaatttcaacccaacactaacactgtgttacagacctaacgtgcattccctacttcagtctctaaccatcccacaaggccagtatacttgtgttcttaattctggggggaaataagacatagagtgtacctgtcttcactcttgacttagctcatgaatagtcacctccccagatctgtttcgtagttcactttagcttgtggccaagatacaacttgacctaagatttgaacttatgattttatgtcagtttaaatcaatatttagaaaaataattcaaagcacatgtcttaccagaaaaaggtcaggaaagccatgtacataggaaagatttaaaattaatgacttttttttcctcagggggaaactgagccagtcatgtgctcagggaatcagacttctcagaatcaaacagcaagcactgatttcaccctcacgggactctttgctgagagcaagcatgctgccctcctctacaccgtgaccttccttcttttcttgatggccctcactgggaatgccctcctcatcctcctcatccactcagagccccgcctccacacccccatgtacttcttcatcagccagctcgcgctcatggatctcatgtacctatgcgtgactgtgcccaagatgcttgtgggccaggtcactggagatgataccatttccccgtcaggctgtgggatccagatgttcttctacctgaccctggctggagctgaggttttcctcctggctgccatggcctatgaccgatatgctgctgtttgcagacctctccattacccactgctgatgaaccagagggtgtgccagctcctggtgtcagcctgctgggttttgggaatggttgatggtttgttgctcacccccattaccatgagcttccccttttgccagtctaggaaaatcctgagttttttctgtgagactcctgccctgctgaagctctcctgctctgacgtctccctctataagacgctcatgtacctgtgctgcatcctcatgcttctcgcccccatcatggtcatctccagctcatacaccctcatcctgcatctcatccacaggatgaattctgccgccggccacaggaaggccttggccacctgctcctcccacatgatcatagtgctgctgctcttcggtgcttccttctacacctacatgctcccgagttcctaccacacagctgagcaggacatgatggtgtctgccttttacaccatcttcactcctgtgctgaaccccctcatttacagtctccgcaacaaagatgtcaccagggctctgaggagcatgatgcagtcaagaatgaaccaagaaaagtagtaaagggcaagcattgtcccctcctctttctataattccgttactccctatctctcctctcttttgccctcaggtctccgggtccccagcacaaagcccactcatattttccttctttcttatacgtggcgttttccctccatactgcttattgctcccatttatctcattagatttaatatctttagagtgtttttaactgcactgcagtagctgacctatgaaagaccttatagagtgccttttatcttatctcccatcccaggttcattgagcattttagtatgagacttggtcttaaacactttacccctcgaagagactcattgtaaagacttagaatcctagcagagccctagaggaggagtattggctgctccctccctttgcaatacattgtaaacctcggttcacattggcagccactggggtcagtgtttctgctattgtatctcagtaagtacaaagaaacgcattttctccaaaggctgaagtgaactttgtagtgtaaacaccagtagttttagcattggccattggaaccacctaaaccaaaaatgaatccatttcaaaattcaaagaataggttcatctatttcatagtatgtaaataaaagtagttccagatttagtttctttaggatttagtctattccagacaatggtctactatgtttacaataaatatcataacagtcgcgtgcgataatggagacttaggaaagcttaaccccctcagcatgtttcttctgaaactgggaaaaccagcaaaatggttataaacttgtcactaacctttagtttgccagatgtatatcatgctacaaaggtaacttctgtaaatctatgagcatcagatcactatcattttcattaacaaaataattcatgggtctagtatttctggaacgtgagaaattaggaaagaaatacatttgttctaatatgcaagaagctgaatctcgagctgtatcgtgaagctgttaatttacttccccttggcacagccctgaccttgcctgatttaccgacaatgaatggaagccaggtgttcccatgcctatcgcatcttcgagagaaatgacaagtacttgctttacatgacacatcgaccgaacacttttgcttctcactgaaaattattcctgcagtgcatgaaaggagtttgtctgagtttgtgtacagagatctgaatttggaagtaaattccaccaagtggtgcagaaatatcacttgtaagagggggttgttagaggtaggtaaaatttggtttcagaaattgctgtaattaaataaatgggcaaaactgctcaaatggacaccacagatgactaatttaacaatgttcttatgttgtcattatattatttatataattatttacctcaggaaggtgtacagagtgggattgctgaattatagagtagctctatttttaatctttatagaactgtcatacagctttcaacacaggctgttgcaacttacgtttctaccagcaatgcacatgtacaagtgttccatttcctacacacacttgacagcacttgctatgtattgcctggtaatagccatcctagcaggtgtgagctgatatctcattgtggttttgatttgtgtggccctgatgattagtgatgttgaacatcttttcattcacctgttggctatttgtattgcctctttggaaaaatgcctattcacactgtctttaccatttttaagttgggtaatttgatatttgctaatgattttgtcagtttcttttatattttggatgctaactccttatccaaaatatggtttgcagatatgttctcccattgcagagattaccttttcattttattgtttccttttctgtgcaaaagtttttgcatgttgatgcagtcctacttgcttattttgcttttgttgccttaatttttgtgtcatatcaaaaatatcacggccaagatcaatgtcaaagagctgtttccctatgtcatcatctaggacttttacaagtccaggtcttccatttaagtcttcgatccatttagatttggttttgggggaatagtgtaggataagagtccaatttcgttcctctgcatgtatgtatctggttttcccaatgccatttattgaacagactatcctttcttcatgctgcatttttggcaccctcatcaaagactaattgaccatataagcatggctttatttctataatttgtaatatagtttgaaatcggagtctgaagcctccagctttgttctttttatcaatattgctttggctatttgatatttttgtgcattcacaaaatttctagaatggttttattctatttatgtaaaaaatgcctgtggattttagttggggttatactgaatcagacattttctggagtaatatggacatttaaagaatattagttattctaacccattaacatgagatatcttcccacttatttatctcctctttagtgaacagatctttcactccctcagctgtatttattcctatgtattttattctattggatggtattgggaatggtattcttttcttaattacatatttggatggttcctttttggtgtatagaaatacaactcatttatatatgtttattttgtatcctgcaagtttcttgaattctttaactctgatgggattttgctggagtcttgagttttttatatgtaaaatcatgtcatctgcaaacagatggcaagataatttaacgtcctctgatttgaaagccttttctttctttttattgcctaattgctctggctagtttctggtattatgttgaatagaagcagtgagagtgagcactcttgtcttgttcctgatcttagcggaaaatctttctctccatcgagtatgatttagctgtgagatttattatgtaaaggcacattccttctataacaaatctgctgagttctcatcatgaaaagatgtcgaattttatccaatgctctttctatgtctattgagatgcacaattgtttttgtcatttattctgttaatgtggcatatcatatttattgattggtgtatgttgaaccatctttgcatctgtgggaaaaaaacttgggaccccaatttactatgccaaaaggaaaaaagatactaagctgaaagctgagttatgcaagaaactgcatttcctttggtttttgttttctttttgttcctaatcagttaactacagatgaaaggttagagtaacaggcagtaactccacattctccttacctgacgtaaagcgatgatccttctactgagtgtgaaaggaatacataaatgactattcacctacctgcttctttgcttcttttcttcttgcaacctgtggattatcatactctccctctttcccctctagcctgctttcccctttaaatattaaagtcctcaaaattatctttaaagaaaagcacagaccacagactgtttctgtaattgtgttcttttttccaagcatgtcctttaccttggtgaaataaactttcaatctgattgagacctgtctcacatacttttggtttatacatcctaggaataatcccacttgattatggtgaagtatccttttaatgcactgcttaatttggcttgttagtattttgttagtttttaccaaaaattatgaaagctgtttttcaggaatattgacctataatattttgggagttagtgttcttatctggctttggtttaaaggtaatgttggcttcagtaaatgaatttggaagtgtttttgcccttcaatgttttgaaaaaatcagaggaggatatgtgttagttctttaagtgcttggatgaattcaccatgaagtcttctagtcctaggcttttcttgggagattttttttttttttttttttttttttttagacgaagtcttactctgttgcccaggctggagtgcagtggcatgacctcggctcactgcaacctccgcctcctgggttcaagtaatcatttcatgtgctgagtactcttatacctactttcttagcaattttcaagtatataattgttgaaactgtagtcagcatgatgtaccataaacctcctgaacttatttctcctgcttaaataaaattttgtatcctttgacccacatcttctcttttccttcctcactccaaactctggtaaccaccattttactctttgtttctatgtgtttgactattggacacttcacatataaatgaaattgtgcaatatttgtcctataccaggcttattttatttaaaatattgtcctctgggctcatccatatttttccaaattatagaattgtctttgacttttgacaaactgatcataatatgtctcaggtataatgttttggtttgttcttgcttgggttcctttgaactttatgaatctgcatgtctctatcactcacaaatttaggaaatgttgtcattttagctttgtttttttctccttctgtgaatgtcataatacacatatatatttgcttgatgttgtcttatagttcccagatgcttctacattttattttttttgttcctctaactgtatgatctaaattcaagttcattgcctcctttcactgtatgatgaaatatgttgtcaaagtactctgttgaccttttcacttccataattgtattcagaatattttacaagctttacactaaagttaacgagatttacacacctccattacagtactagagtgttccaaatttgactacaaatcttctcagcacaagaattctttccttttttgatgtcaatgtctttattatatttctcattttgtttatgcatttttttattagttttagatctctgttattttgaagctctttgatcctatttaatatgattttaaaattcttaggcaattcatagatttccatttccttggggttgcttaatgaagctttattactttggtggtatttattactttggtgtcacatttgcctgatttttttgtgactcaagtagctatgcattgatgtgtgcacatttgaagttgcaaacagctcttctggtctgcatagactggtttcagtaggtaaagacattctcctgtcatttctctaggctaataagaattacctccaggactgcagttgagcagggttagagccatgtcatgtggctactcctgagtctacagcagaatttttagttggcaagcttgttaccagaagtcgagttgagtataaatcctgtctggtctcttggtagagaagactgcctctagtaccttggtcaatagggctatcgctaggacactctgcttcagggttcacatttggttctgtagatggcatgcctgttaccacgtacagaaatgggtgtggattctattgagtcccttgaaggactcccattatattggtgggaaagtctctgggcaagaaggattgtccccagaccacagttgagaggacctggaactgagtctcagggctgtgtcatggaccacagctgagtctgaggtcttctgtcctgcatggatgggtgtacctcctgcatagtccctgtaaatataagatataagatatccccaagctgtggttgaatggaagctggagctggataagagggctgattcaggatctccagctgactgatgtcagcagtcttgtttacaggggcatcgatcaatgtgtcacccaggaggtcactgagtgggcaggactgcttttgaacaatggaaaagggtgccaagtaacagagctgcttcaagattggcagtcggacgtagttttgagagcctgcctctaggcacatgaacagggttgcctcctggcaggtctctgtgcaggaaggtctattcccagaccatggctgagggggactggagctgggtcatggactgcttcagggttcagagctagaactaaggttagcaggcctgtgacttgagggtactggtcaatgtgagtgcccctgggccccttggcagatggttcaggtggcaggaccaatgccaaacagggcactagctgagtccagagggatgttaattctgtgtctgtagccaggaccacagtcagtgagcctgccacctgggtgtggccctgccttctcaaaatagctctcttcagtgttgggattcaccagttttgacacttcctgtcaagatccagaagttcccaccaagggacttttgtgccagacaggctgctatattattgctgctttgaggggatacgattataggagctcctcttcaaccatcttgctaatgtttttaatctctttgtattaagaatatttctctagcacattattcaacttagattttactcaataagttaatttaaaacctgtgacaccagacagcaagttatctgctgtcaaaatgcaacagtgacactcacatataggatagacattcctattctgaaaaagagaaattggaagttaaatagaagtcttagagccaaagcaaacttgagcctggcagggcaagtttcgttagatttcaggacttgaggtcctctttggcttgatatcctgacctccagtccataaaggtggtggcccctcttcctttgttctgtgcatgtatcttgcatttctttatatctctgatggtgccttcaggatcatttacaaaatgtttgacatgttttatatatttatagtttaattcttaaaatgttatttttgtttttataaatattttctcagtttacatttaaaatgtaaaaaaagtagaactttaagcagggtttccaccataaatattaatgttgaaaaaatatatatcaatagcttttctgtcactgttaatgctttttaagtatttttaaatgaaaaatattctccaaaaaattaaattataaaaatctcagaatctcaattattgtggaagaattttattaaaattactttaaaatccagacccgacctctaagtatttggatatctctgtgagacctattgtgcttgtttataaaaatctgcaacattttaacaatatcaattcttcccaaatgtatttcattgtattctaatcaatacaattagttagaacttttgaacctagccaaatagatcaactgaaaggaaaaacaaacttaaaaacttgcttattttgaacatgaacatacatgaagacaagaattgtttcactagttgtttaaaattatcatgaggggacacccaataaaacaagatattttaaaggaattcagtgaaagaccaatggaaaagaagagataatgtggaaacctagcctcccctgcactggcttctggtataagatgttgaccctccttccttgtgtgatcccgttgtttcctccacacaccctggttctcaaaaccatgatttcaggactgccttctcttatgacctctggattcgtgtatacactagccttgcatcatcttcatgtagatgtgtactgggcaactggagtcccaaatttcagtttcagcgttccatgccaacctgcccagccccaatattcctgtgtgtataaacggcaatccaacttcacctcctccaccacaccccttgcccagacaccatatgtctcatcaggactagctcaaaccctttcctgcattctcgctcaagccttctcagtgataatcatatacctgttccaaatgtctttcctctctgtccgtcctccagtgatatctcagagtgggattcaccgagaagcaaggagagtcaaagctttggggcccttcactctctggagattctctgagtgctgtctgttgctgggagttgtatggtggggtggggtggggaggggaagccaggctacagtcagaacagactgtgagcatgcctggtaaacttcctgaagagttcttagaagacaggggccaaacattggctgagacttcctttctttttctaagtgcacatgcactctcttgagtgccgtgtatacttttgtcttccctttcttaaacacacctctgcctgtccctggtccttctcaggaccatcatgattttataggaccggttccttggttccacttctaaccccattttctgttttgccaactttctcacctcagtctggggccacagatcttcttgctgctgttcaaacgttgcaagttactttcagtctcacagcttttaactttctctgtttcctctgcttaaagcatctctgccccgttgtttacgagtgactccattgtttcatttacggatctgatgaaatttcaccttctaaataaagggctcctaactagcctgtgttaaatagattcgctaatcattcctatctcatctctctgcctttattttttatttactgtgattattaatacttgacatttcattacatatttattagtttattgcctgtatttaccactagtatataaatgctgtgtgggaagaatctttgtttcaaacatcataaacctagatagtgcctggaacaaacagttactaattatttttgaaattaatgaataaaagaaaataccattcaacattggaatttaattttaacttaaaagcaataatgttagcaattcactgcatatcacacccaaataaattatttttgtattataactcaaaggtaccaaaaaaacctctgaaactcattaaaagtgtaaaggtagatgctttacataatccccaaatgcataaagactttgtaagcacaaaacagttaacgaaattattaaagttaatatattaaacaaaatactttaaaaaattctgatgacacaaaatatcagaatgaaactgaaataaaaatattttagttgatactattcacaaagagttactattttttttcttttctttttgagacagagtttcactctttttgcccaggctggagtgcaatagcgtgatcttggctcactgcaacttctgcctcctaggtttgactgagtctcctgtctcagcctcccaagtagcttggattacaggcacgtgctaccacaccagctaattttgtagttttagtagagatggggtttcaccatgctggccaggctggtcccgaactcctgaccccaggtgatccacccacctcggcctctcaaagtgctgggattacaggtgtgagccaccgcatctggccagttattattttcataccaaaaacacatttatatttatgaagaaaacatttcaatagaagcagtagttacatggataaacatgaaaagttatataaacatattaattaaaaaagacaaataatgatacacctatgaaattgaccaagaaggaaaagcacacataattcagagctggtgcaagtgaagtttaattctgcagcaaaatttgaagaggcttttggaaaagtaattcaatgttgtatattaagaagtgtgaatcaccgtatatcaaatggtagattgtctcagggaaaaactgacattcagagtgtattttttgtataattagttttatttctgcataatttataatgttgaaatttttaatgtcactattcactcttaggagaagattgcaattgtgatataattactctgatagatattaactccagtagatactgtccagtcatatacgaacactacatattgcaaaccgaagagatgtaacacagaagattggttagaggtggcaaagggttacagggaaggctggagaagtgggcaggggagtgttgtcatccaaggaccaagagtcctcaccactggagccccatgtgcccctcactgctgagctgatgggaactctgcactccagggctgctgagagaaccctgccctggtgatgtgcagcaacccagatgcctgcatctccccaatacgactgaaactgcctctcaggtgctgaagtctgaggccccccatggtccctgttgcttatagctgctgacccacacccccatcagaaacggaaaaaagtagtttacttcttcctctcaccctgcagtgtccacccacaagggcctgcactctcagagccttacgaaaagtgaagtagcaaagaagtcaggacaaaccacgtgcaggctgcagcactgtgggtcagagactccagccctcaaacgtgcacctaaaaacaggacattgtctagacaaaggtggtcatgaaaagacctccatgatgtaggaaaatgatcaacatttttccagagcacgtctttagagaaaagttcagaggaatttggctgcaagatctaagatggcggtgcagtttcttctgtcttcttccctgttttattccaacagcctaatacagggtatacactcaatgaatatttgtagtttaaagggaagatataacatgtaaagtatcatttttgtctggtttattacattagagtcgattttaaaatttttattcaaccagttttactttagatttttctatgactttaatgacagtatttaaaacaaaaacaaagataaaaatcaaatgcaacactaaagcaataaagattgcaagtgagtgagagggaaacagactacaatcggtcctaatgaagagggagaaagatgaagatatgaagatgactccaattttagttttaatcaaggtactgatttgtggaggtatctttgacacatcagttgacctctgagtttcagattctatacctgtgaaatgttagaataaaaataacaatatcttacaacatttacttgaatattaaatgaagatcacacatatatatggaatatattttataatgtggaaaaggctaaggctgtatatgaactaactcctacatttcataaataagattttgatgatgatgagatttgagattactattactaatattggttaaaagtttgcatttcataacagaggtaaaaattgtaaaagctattagaagaaaaccagaattgttcaggagagatacctactgacttctttagctctcttaattgcattcttcttcaactcccagaggtgatgtatcaaccgaaagctttcaacccctcccctagtgcacacggtaaaaccaggcaggtcactttcttactcctgttggtgctcttaacctggccacacaccaccagcccatctaggtgaggttcaagacatcatctgatggtgagttcagccagacagacaggaggtactagcaggaagaaaagggtcatcactgctctcgacttgttctgcttctgaaacgttctattagttcttcacagcatttcctcattttttctttatcatctgtttttaatggagaaaagcaaatgttattctttcttataacttctatacaacacttatttactgtgacataatggtaaatagatttttaatttccaattatttatggacataataatatatattctatagttttagattttcatacaatgatgtatttattttcctgtcactgaagttttatagaggaaaagtgactgattttcttttgagaggggatgatttctgagggttacaaaacactagaaacaatgtctcaatcattttatgtttctttgatgaaacccacagacagtggcctaaatccaaagtgtagactgcagagggaggatggtgtccctgagaggaatcaggcagagttacgtgcgctggctctctctctcgggctgagacgtgcgttctatctcaggttaggtgtgtgatattaggcaggtaccctgagaacctgcattttttaatatgtaaagagagaaaataataggaagtaactcataggctcttgggaaagaagaaatgtaaagtattaattttagtattagtattagaacaattcctgggatgctgtatgcttcaaataaagatttgactccatttatacttacaataaatccccaagttaaacatgcattaagcaatttacatgaaagtcaaacaagcgggtacagaagaagaatgaacagggggccagttcactgtgtgtggatagtgttcccttatctgtcccgtgtcctggttgagctgttgatagtggcttaatgatagtggcttaatgatagtgatggccatttcctaaagagcagcagagatttcttaggaaaccccgcatctccctgccctcctgctccccctcaatttactgagcaaacaccttttaggtcttcacatgtgctggtcgctcctctggtccttgcttcactttggccacaaataatggacgaggtcagcaggtgtgttttgcagtttattggaatgtttttaaattgtacacagatctcagccaccatttgccagtaggggtagtgtttgatacacattatctatctatctatctatcatcatcatctattcatatatatacatatgtacataaaatgtgtctcagatttgttggatatttatattaaagcaccgaagcatcccagaatgttggaagttttggtgagttgaatgtcttaaatactttttgtaattactacaagaatacaaaatatatttgaaacttgtaaattcattccaaaatgtccctgcatcataatcacagctaaagtcttcccagaaagaggagttattatgtccttattcttggcaagggctctcaaaatttaacatttaatatgtcagaagttgaaaagttggaaagttttaatttctttcagagaaaatgtggaaacagctattatggattatttcagaacggccagatatattttgtgtctattgcccttatttattttgtaactatttaaaaattcaacttcaaatcacatttacataatagttgttccctgaatagactgactgtgacctccttaagtgcactcaagttcaatttttctttgattcatcttctgcatataacacagaggctgtgagtatcatgatagagaaggaaacagtgagttgaagtcagaggcgattcatcgtcagtataacacaggctgtgagtgtcacggtagagggagaaacagtgagttgaagtcagatgcctcagtgttgtttgattttcctccctgcttctcagtttgtatgaaagattgattgtggcaagtaataaagcacatgaggtttgcaaaaacaactaaagccttgtctgataaacagcagtgaccctccaaattctagttcttcctcgctgagatttaatgagctttaaaatgagaggagctttaaggagatgaggttggaggaccacatactaggcaggaaggacataggagtctccaaaaagctctgcataaccagggttaaaataagaaatgttatagttatatattcacctgtgtatgtttacataaatatattatatatatttatataaaaccagagtatttacacataaacacacaaatataaaatccaaattgtttttttttaaagtgggtcatatgctttattttgcagaacttctgccatttttattttgaaagtcagcttcttaaatgtatgaataggtactgaatctggagaatggaagtaatatatcttatataataatagtagcaacaatctcttaggttgtgcagaatagttagcttaaagagttaacatctacactaagagtatatgtgtttattcatcggaaactgtactattctaagcactttcattacatttcctcattttaccctcaccacacctgagctcaaacatgatttttatcctttttgatgtagattggagaaaggaatggcagacagagaaaaaggtggacccatagctggagtctactgtgtgtgggctcctcacttcacgtctctcgatgtctaaagggtcagctgtgtgtgaggacccttccctgctcatgagaatgtgaggctcgctccacgcaatcacagagcctcacagcatggcctgatcctatgggaggaggaggttcaaacatctggcataattttttttccaagttacgctttagttacttgctaaatctttcttatatcatatatacctctgagtattttgaagatgcctattgtttcttaaaccagcgatgttgattcaattcagctgtctatgacaaaaactctacaataaggagtttgctttatctttctttcaatgagtcactgtttgtgttagcagaggagggaggttctgcaaattttcagtacttgttgataaatggcattatcatcaggaaagtttatgaatttgaaccgtgacaaccttactatcagttaccaattcttctggcctatagttgtgaattcttagtttgttttgtgaatttgttatatgtcatttatatactcaaatccccagacccacgggactcaggttagcacaatgagcatacacaaatgtgagtactcacgaaacactcattacaaagggacgcgttacactgactccaaaactctccttggtggcctaggtgaaacctcatggccaacatcaccaggatggccaaccacactggaaagttggatttcatcctcatgggactcttcagacgatccaaacatccagctctacttagtgtggtcatctttgtggttttcctgaaggcgttgtctggaaatgctgtcctgatccttctgatacactgtgacgcccacctccacagccccatgtactttttcatcagtcaattgtctctcatggacatggcgtacatttctgtcactgtgcccaagatgctcctggaccaggtcatgggtgtgaataaggtctcagcccctgagtgtgggatgcagatgttcctctatctgacactagcaggttcggaatttttccttctagccaccatggcctatgaccgctacgtggccatctgccatcctctccgttaccctgtcctcatgaaccatagggtctgtcttttcctggcatcgggctgctggttcctgggctcagtggatggcttcatgctcactcccatcaccatgagcttccccttctgcagatcctgggagattcatcatttcttctgtgaagtccctgctgtaacgatcctgtcctgctcagacacctcactctatgagaccctcatgtacctatgctgtgtcctcatgctcctcatccctgtgacgatcatttcaagctcctatttactcatcctcctcaccgtccacaggatgaactcagcagagggccggaaaaaggcctttgccacctgctcctcccacctgactgtggtcatcctcttctatggggctgccgtctacacctacatgctccccagctcctaccacacccctgagaaggacatgatggtatctgtcttctataccatcctcactccggtgctgaaccctttaatctatagtcttaggaataaggatgtcatgggggctctgaagaaaatgttaactgtgagattcgtcctttaggaaattataaagtaggaaatttggatataaagatttattttccttttctctacccatcagatacttaggattttatccctgttattccttagactctcatacaatgatgcctcatctcatattcatctcattttgaggaattctttcactgtgtggaaactctattttatagtctttgtccatccaaaattcttttacaattgtgttatactaatgtaacatttttggaagttgataactgttctctaattttgtgaaaaaatattcttaacctcaggaaatacttaatatttagagacaaaaaggtcatgaggtgttcaaatgatgagagggaaagagggagggagatagagaggggcaatgaaacaaactgagttcaatgttgctgccacacatgagtatgggtaaagggtatataggtattaattgtactattgttttttaatgatttttgtgaagttgaaatcatttacaaataattaaataccaggcttttctccctttttgaaaatattctcctttctgcttggtggcagtgtgacatcttagaaatcatgctcatttcattatatctaatcattaccaagaaaatccagtcatcgccccttctttattgagggctacatttttctgcatggtccaattctgatggcgtctagtggatttatctctccgaaataattactgccatgtggtgtattgaggatgtaggaccacataagtgactgcagaaaaaatatgacacctgagtggaaggagttttaaggaaggttacctgcccagggtgattcctgagctgagatttcaaacatgtaacttgttatacaaacaagcagagggatggcatcaacattcaatccttcatttatttaacaagcattttgtactattttataattaaaaatagttaaataagattaaattttgaatagcacatggcttttaccaaggagtttgaaaaatacatgtagttgtttatgcaaacaaatgtaagaaaataaataagctgttttgatactcgtgtgaagggtgcagctcataaggacacactaattctatctgtgacatctgagttcaaacaaggagctgagaggagactccggggctcagtgctgaatagtgacgaaaagttaccctcagatgagtgtgtgatgttggagccaggggaacttgctgagacacgctgcaagggaaaaggcacagcatgagcaaagacagggctgagcaagcgagagagatcaatgcccagtagatctttcttatttcatgttaggcttatttcttgcccttgtgtggcccagggttttacaaacaatagtgaaatgatcagatttgtattttagaaatgttatttgtgtggtgatcaattggagatgtgcaagaccaaaaacatagagaccaggtacatgagaatggtaatctaaatgatgttgatctaagtggagtcgaccatgcctttacccgagaataggctgataggagggcatttgaggtggggcctgctgaacctgttacctaaaagcatacatgtggtagctgcatgctataacttcctaattggctatgtacaacttgcgaataatcaggtgttttcaacagtacacattcttcttttctctcaccacactcaattattttatgactataatataaagattctgtagtgctttggaaaaatatgagagaactagtttttaatatttttcctgaactcagacaatataaaatgcatactctaactttgtatgaattaaagagcatttgtcaactctcaatttgctggattataattatagacacatttgatggttatctttaaaacatccttgtgaaaggaaatgtagcaaaatttcatgaaaaatgatttttgtagagctttattgtgctaaaaattgttagctgcctaaaataacctgttataatatgttggtaagtctcgtggtaactacaaagcaaaaacctgtagtagacatacaaaaatttttaaaaaacaaggaatcaatgcataccactagaaaaaacatcatttaaccgtaaaagaagatagtaagaatggaagaaaagaacaaagtctctagaaaacaactggaaaactaacaaaattgtagcattaagtccctatgtatcaaaaattatcttaaatgtaaatgtattaaattatccaatcaaaagatatctggtggcagaatgtataaaaaatgccaactacaacaggttactttaacctgcaaggacatatgcagacgaagtgaagtggttgaaaaggatatcccatgcaagtcgtaaccagaaaagagcaggagtagctatgcttatatcagataaaatagactgaagtccagaactgtagaaagagacaaagaagatcatatataatgattaaaaagtcaattcaacaaaaagtatataataattgtgactatgtatgaaacattaacctaaatacataaagtattaatagatctaaggggatagatagcaataaaataatactaagaaacttcaacacccctctttcagccatggaaagactatccagacaggaggtaaacaatgaaataacagcttcaagttgcactctagggcaatggacctaaaaagcatatgcaaaacattttattcagtagctgcagaatacacattatactcgattgcacatgaaacattttctaggttagatcacatgtttgaccacaaaaaagtcttaaagataagaagttcaaaataatatcaatcatcttttctgatcacagcagtttataaacgaatgcaagaattctcagaaagtttacaaataaatggtgattaaataatatgctcctaaacaatagatgggtcaatgaaaaaattaaaagggaaaataaaaggttgtttgagacaaataaaaatggaaaactcaacataccaaaacctacaggacacagcaaaagcagttcaaagaggaagtttatagtttatagcaatgaatggctacatcaataaagaagaaagacttcaaataaggaaaggtaatattgtaccttaattaactagaaaaacaagaataagctaaactcaaaattagtagatacattaatattgattagaggagaaataaaaaaatgataaaaacaatgcaaaacatcagatgagttgttttgtgaaaaaacaaaataaactagactaagaaggttcaaatcagaaatttacaaaggatatattacaactgaggccacagaaatacaaaagattatgaaagtataatgaataattgcatgtcaaaaattagataagctggaagacatgaattgactgatacataaatcctacgatagtaaatcttagcaaaccaataatgaataatgcagtgaagtagtaataaaagtctcccaccagaaaaaaaaaaaaaaaagcccaggacaatatggactcattgcaaaattctatcaaaaatttaaagaactaataccaattattctcaaacacttccaaaaaattgaagaagtgggaatactttcaaattcattatacaaggccagaattatcctaataccaaagccagagaaggacatgggaatgaaaaaggaactacaggtcaatatcatttgggaacatggatgtaaaattcctcaaaaaatgctagaaaactgaatttaaaagcacatttcaaaaagcattcatcatgataaaatgggattcatcccagggatgcaaggatgcttcaacagatgccaattaataaacatcacatagcacagtaacagaatgaatgatacaattttatgattatttaggtggagagaagcatttgacaaaattccaaaactctcaacaaattaggtatacaaggaatgtatctcaccataacaaaggccatatatgataagcctacagctgacataatacttaatgatgaaatgttgaaagctttttctctaagatccagcaaaagaccagaacggtcactcttgccacttttatgtaacatagcactgaaagtcccagctaaagcaattagggaagaaaaataaatagaaatgtaaataggaaaggaagaagtgacatgtttctgtttgttaataaagtaatattacatataaaaaaacataaagccttcaacaaaaactattccctaacaaattcaggaaagtttcaggaaatcaacagacagaaattggagtttctatactctaacagcaaactgtatctttaaaaagttaagaaagactcatagagaggagttatagcaacaagatagatgaatagaagatcctccagcatcattcatccacacccacaaaaatagaactggaaactattcaaaaacaataacatcctgaattcccatgaattcaggagagaaaaaagagaagctgtgtctggtcttagagcaattaggtaaaagaaggaaacaaaggcctccaaattggaaagaaggaactgaaattttccctgtttacagatgacatggtcatatattaaaaaaatcctaatgacaccagcaaaaactgtgagaactgataaatgaattcagtaaatttgcaagatacaaaatcaacatacaaaattagcatttatatatgccaacagtgagcaatctgaaagagaaataaggcaatcccatttacaaaaactaaagtaaatacaaaataactaggaataaatttagccaaagtaaaagatctcttcaagaaaaactatacaactctaatgaaagaaattgaagagatcacaaataaatggaaagattccccatgttcgtggattagaagaattgatatcattaaaatgtccatctaccaaaagagagctacagaattaaggcaatcactatccgaatacaaaagatattcttcagagatagaaaaaaacaatcctaaagttcatatggaagcaaaaaagactccaaatagccaatgcaattctgagcaaaatgaatgaatatgtaggcatcatactacccgatatactacaagctattaaacatcaaaagagaatggtactggcataaaagcagacacacaaacagaagagaacccctgagagtccagatataaattcactcatttatagtcaactgatgtttgaccaagttgaaaagaacatacaccaagaaaagcactacttcctcaataaatggtgatgcaaaaaatgcatatccaaatacagaatgaaactagacacttatttcactattttaaactcaaattggattaaagactttaatatcagatcttaaactgtaaaacttctggtagaaaacacaggcagaatgcatcatcactacattgatctgggcaagaatttttaaagtagaacctcaaaatcacagggaaaaattaaaaaattaaaaaatgagattacatcatactgaaaggttcttcacaataacgaaaacaattcacagagtgaatagataacatacgagtgggagaaaagatttgccaacaatgcatttgacaaggggttcatatccagaatatataaagaactcaagtaactgagtaccaaaattatcccacaaataatttgatttaaaaaatgggcaaaagacatcaaaaaacatatttcaaaagaagacatacaaatggctagcacgtatatgacaaagtgctcaacatcactaatcatcagggaaaggcaaactgcaatgtcttggatggacatggtatctttcactttgaaactggagtcctgcaggccattttgaatattgttcatgtttcctaacacacccaagttggcagaagaccccctatttaggtctaatacctgctgtttatgctcaaataggcccaggcaatacaagttttggctatgactccagttatgtatatttctggaagaaacaatagatgggtataaaataaagtatggtagagtgaaatcatcatacctgtacaggaatgtaaatttggaggtcatttttcttatcaggacacatcacacggggaatgtgtttctttagtaaatgttgtgtactcctttagatatacttataacaaaccaacgatgcatggcatcaggataagtttagaaataattactaaacgagattccatagggtagagacaagaaattagattttgcctatgttcaagtgggagaatacccatttcaaatacccaagattatagaagaaggaatgaaaaagtttcaactttaagctgctgagggaagcttgaaaagaatttagtctgacatttgatattctttataaccatgtgactaattactcagatggtacttaggaattaagaaaagtcattaacctacaaaaagcccgaagtataagaaaacacagttaaaggtgtgttttttaattgtctttgctggattcggttagttcaatagccttgtcttcaagctctgaacttgtttcttctacttgtttgattctatttctgagattttccagtgtattttgcatttttctagtgtgttcttgatttccagcagttgtgattgttttttatttatgctatctgtttctccggagatttttccattcatgtcctgtaacacatttttaaatttaagttggtattcacctttctctggtactttgttgagtagcttaataattgaccttcttaattctttttctggcaattcagaaatttctcctttgtttgaatccattgctggtgagctagtgtgatctttgggggtgtcagaaaaccttgttttgtcatattttcagaatggttttcctggatttttctcatttgggtagactatgtgagagggaagttctggggctaaagggctgctgttgagattcttttgtcccatggggtgctcccttgatgtggtgctctaccccttcttctagggatgggggttcctgagaaacaaagtgcagagattgttatttctcttccacatctaaccacccagcgaagctactgtgctctggtactggctggtaccggagagtgtctgcaaagagtcttgtggtatgatctgtcttcaggtctctcagccatggataccagcacatgctgtggtggagggagcaggggagtgaagtggactctgtgagggtccttggctgtatttttgataagtttgctggttggtctccagccagcagttgattctttcaagagttgcatcagctgcagtagtgtagggaagatacgagcttgccttagggttacctggataagtatccagatttctcaggcaatgggccgggcctcagagctcccatgagattatgtcctttgtctttggctcccagggtgggtagagaaaggccaagaggtgggggcagtgttaggcgtgtctgagctgagactctccttgggcggggcttgctgtgtggctgctgtgtgggattggggtgtggtcctcagactgatggagttatgtttccacggggattatgagtgcctctgctgggtcatgcaggtcaccagagaagggggggaacgggcagttacatgcttcactcagctcccaggcagcccaaaaggccagtctcactcccaccttgtgcccccagtagcactgagttttttccaggcagctggtgagcagggctgagaacttgccccaggctacaagcccctcatgaagaaagcaagcagggcttttaggtttcatgcctctctgcctgcctcagcttctgagcttgtatctgcactcccagtttgccccctcccccaggttctgtccaggaagcttcacgttagtcaagattattacaaaattcatctgaaagcttgcttctccttgtagtctttccccaattccactggcagccctcccaaaggacccctgcaagacaaagtccgaaatggtttcccacagggctcttcttgttgtttcctctactcgaatattttgcttggctctctaaattcctcttagctccgcgtaagattaaatccttttcccaccatgtggaccgtcaggttccccagtgaggatctgtgcttgggggtggagcatcccccttttacactttcacacattttggcactcagtctttggcacggagcctacagtggccgccacctccttcaaagggtctttggattctcttggctttcctggtatgtcctatggtagttcttggagcaaaagttcacagcgtgaatctccacatgctgctctgtccatccaagtgggagctgcaagttagtcctgcctcctatctgccatcttcctcttctggagtccacgaaaaggattataaacaaactattttgttgggagtaataatgtggtcctggcctagtgtgaagtgaagctcactccaggccatttctctcaagctgtgttaatttgtacccttcagcagtttatgagaggttcatttccataggcccccacatctacaactaggggatttcatatatctaatctgagcagggacattggttctacatggagacagtgcagagatgagctgtgcttgaggcctcacctgtaggtggtagggtctagaccgggagacaggcattggccaacagaaataaaggacacaaagtgatgtccttctccactcacttcagcttttcttcaacactatttcagatgcttccttcctggcttagctcttcattcaaggtgagatattatgggaacaggattgtgggggcaggtggccccaggtatggagactaaggggaggtgtacatggcaagagagaagccagaatatggggatgagaaaggaacaagctgtctgtggtagtcatccatgattgagatgatgtgtggaccctgagtcagactacctggttcaaatgcaggctctctactttttacccatttgatcttggcctgtggctctctacttcttatccatttcatcttggacttgtggcctctcatacctcatcttccttacagtcctccatatgaaatccccctaaagtaggaacaaagctttggccaactgctcctcccatctttccgtggtctttacttaggaactgtgtgtttaatatacgtgacacagggtttctcccacatccctgagcagaaacaagctgtgtctgtattttgcactgtactcacccccatgctaaaccccctcatctacatcctgagaaacaaggatgtggtggggctcttcagaaagttctgggaacacatcaagtctctaaacagaacacataaatatcaatgtggaaaacaacggtagagggccaagatgcaaagacttcaggagcatctcattttccagcatgaggaatgttgctccatcgtatgagaaaaccatttggttcaatttaatttgaaatattaatttgctcataaaaagcttaagggctgggtgcgggggctcatgcctgtaatcccagcactttgagaggcctaggctggcagatcatttaaggtcaggagtttgaaaccagcctggccaacatcgtgaagccctttctctactaaaaatagaaaacttagccaggcacggtggtaggtacctgcaaccccagctacttgggaggctgatgtgggagaatcacttgagcccgggaggcggaggttgcagtgagcagagatctcaccactgcactgcagcctgggacacagagcaagactctgtctcaaaaataaataaataaataaataatgaaaagcttaagaactttttatctagtttctaaccattgtttcaaaatggctgaactcaactgtgtttctccttgaagctagatgataagcatagacaaagttccagtcttctctctttttacctgctttagccatttctcagtatcctttgaagctcaactctgtccaggtattgctaatctccattgttgtaagcatcagcttcctaggaaagacaaaagtgtgatttctcaggggcaataataacacaatagattttcttttctcttgattgctctggaaatcccaacatgttggctctattctcttatcctgtctcgggtggaaacttctggtgattctcagataagcaataactcagctgatatataatacaagaagattttctcttctataataaatacagcaagccttgagtaatagtacgtaatctgtgggtgagcaaggaacaataggcttctctcttgactttgtaagttcctcccattctcactagctctagatgcttactcttcctcgagtcagtgcaggtggaactcaggggatagagtggaagtaggggctagaaaagccctacctaccttccaccaatacagagaagcttcccttcaatttttggtggtttgattataatatgtcttaggggtagttttgtttggattgaatctgattggttactttttacctcactgtacctggttatttatatctttttccaggtttgaaaagttttctattatttcttcatataagctttctactcctttatcatttcaactcccttatctccaatgactcaaaaatttgctgttttgttgctgtccagtaaatctcatgtttcctttattatttttcattcttttctcttctctattttcatataacctgtatttgagttcacagattcattggcttgatccattctgctgttgatggtctcaactgcagtttacattttgttcattatattttgcagctttagaatttgtttgatttttaagttattccaatatttgctaagtttatcattgtggtcatattatttttatcgtttgtttgaatagtttctgtgtattttcttgaagtttgctgagcttccctaagactgttatttcaaatgctttgtcaggtagtttatgcatctccatttgtttgcttggtgatgtatgcttccttgatttctcttgcgtctgcagtcatgcatctaatataataggtacttattccagtctttgcagacttgttttatcctgaaacattcttcaatagtaagcctgtctagagattctgagcaggttgtctggtgtggtccctaagctctagtttgctgtggtgggggcagccctaggtggtgccctaagcctgggactgccacgactggtgcagtgcagtgctgtaatcccatggccactggaactggtgtgggtcccagatgatatcctgtggccactggggctggtgcagcactgatgcaagtctgaagcccatgttcactgaggcctgcctgccagtggatactttccagagcttaaggccactctgggtgggtggcagtgatgatgactgcaaattaattctgctttgcatggtttctgcctagtgttggtgtagatctggaggctcggtctttgtgtactggcctggagtcagtggttgtgggggctgcctggttttcagtttttctgtagtgggcctagtgttgggcaccaagaccaagtcccacacttacttccctttttattccccaagtgtttggtatctctccctgcactgtgctgtctgaggttggggataagaaatgcaggtaatcagaactctccttcctgccctcttcaatgtttattattttatcacaagaagaaaatagtataactaggtacaatgatctctcacatggctttactagcttttgtgaaggtatgtagtgtaagaatagttattaaaattgatgtttctatggggatacaattgttaaagaattccgttctgccagctttcccactctcctctcttttcacttttttgattgagacctttgaagcacaaaaattttgaagttagatgaggtccaattatttattttcttattgctcgttctttcggtatcatgctaaaaaaaatgctaaacttaaggtcttgaatatttaacttcatcttttctcatatttttataattttacttcttatgtttaggtccctgatcaatttgagtttaagtatgatttgtaatgccacttcattcttttgtttgtggatatcttcttgtctgagcacaatttgttaaagtgagtattcttttcccattgaatggacgtggcacacttgtcagatgattattgaccatagacacatgcgtgtatttctcattagattctcaattgtcttctatttatttatgcatatatccttattctgttatcaggcttttaaaattagtgtatctttttggcaaattttgtactcaggaagtgtaaatcttccaactttgtttttctattcaaggttgttttggattttgcagtcgctcgtaatttcatatgatttttagtgttttctactcttgcaaaaaaaaaaaaaaggcatggaatttttataggcattgtattgaacctgtggatatattttggttgtattatcttaaccacaagtctcccaatccattaacatgcgatgttgtttcatcagtttatgttttatttgctattagcagtgctttgtaattttcagtgtgttgtttaacactactttaagtttcttcttgagtaagtgttggtagtttctgtgtttccaggatttggttttcatctcactgaaggtatctagttagtattcaattatttgtaatattctcttataattgcttgtgtttctgaaaggctagttgttatgtacccatgttatattcatatttatgtattcatgatgtaagacttctctctttctctctttggtaagtttacctaaagttttctatattttgttgatcttttgaaagctcgaaatagtcaaattgttttttctattctgcattttattaatctctattccaatacttttttttccttctgtttgctttgtattgagtctgctcttctttttctagttccttaaggtgtaaaaatatattattgtttttagatgtttcttctttttttgagtataggcaatctagctaaaattttccttctaagagttgctttagctgcatcctatatgttttgttatgttttaagtcatctgaatatattttctaacttcatttccaatttcttttttgacccaccggtgcttcacagtgtggtgtttaatccccacatatgtgtaacttttgtagttctccctctatttcagatttccagttttatttcattgattggaaaagatactttgaattaaatcttttaaaatttagtcttatttgtttttggcaatttatcctggagaatgtgttattagtacttgagaagcatctatactctgctatttcagtattctccacatatatattaggtcatttggtttatagtgctgttctagtcacttactactatattaacattctgtctaagtgcactatgcattattgaaaatggacatttaagtattgaactataagtacagaactgtttatttcttcctttaattctgtccaccttggcttcatatattttgggtctctgttacattcattcatgtttacaatttttatatctaaagatctatattacattctccaaggaagatacacaaatgatcccaaacagtatacgattttttttttacttataaaaatttttgtcataaactcactttgtctcacattaacatagccactctggctatctttcggttaccaactgcacgaagtatctgtttatcttcatgtatagtatatgataaaatgttatattcacagataaaacaatttaaagtataaaattatgattcaatatgctttttaatttccttgaacactttcttttcttctaaatctattttctttattcctttatagtttattattttcatatgcttaataaattcaggaatgacaaagttgaaatacaaccaactacatagaagtacaaaaaaccctaagggactattatgaacacctctctgcagacaaactagaaaacctagaagaaatatataaatccctcgaaacaaggaatttatctatttctccacccaagattatttaacctcctgacattaagccaggaagaaattgaaatcctgaacagaccaataatgggttctgaaattaagtcagtgattaaaaaaaacctaccaaccaaaacaagccctggaccagacggattaacaaccaactcctaccagacatataaataagagttggtacaaaatcttctgaaattattttaaaaattgagaagggaatactctctaagtcattctgtgaagccagcatcattctgataccaaaattaggcacaaatacgacaaaaaaaagtaaagttcgggccaacattcctgaggaatatagacacacaatcctccacgaaataccagcaaaccaaatccagcagcacatcaaaaagtgaattcaccacgatcaagtaggctttatttctgggatgcaaggttggttcaacaagtgcaaatcagtaaatgtgattcaccacataaacataattaaatacaaaaatcacatgatcatctcaatagaagcaaaatgatttttcataacattcagcatcctttcttcttaaaaaccctcaatatactgggcaccaaatgaacttatctcaaaaaaataagagccatctatgacacacccacagccaccatcatactaaacaagtaaaatctggaagcattcctcttgagaactggaacaatttgaacaattcagttttcaatttctcatcaaaaattgtgttgacatgattgattgaagtattttatccccctttctcccaaataccaggccacagacagcatgaaatattttaaataaacattaaaataaataagtccagattggtcattaaatcgagtattttttttttattgtataaactcaagatgtacaacatgttttgatgtagatatctatagtgaaataattaccacatgctagcaaattaacacatccatcactgtctgcagtttacttttttgtgataaaaacacatataatctagttattctcttagcaaatttgtaatgtataataaaatagaactatagtccttctgttgtacattagatctctaaatatctttatgttacataactgtaattttgtcttcttttacctacattatcccaatttgtctacttccctgactctggcaactgcccttcaactccctatttatcttactcaatttccatttattttacacataaatgagctcatgctgcatttttctttctgtgcctgacttgtttcacttggcatattgtactccatactttaaaatttattaagcttaaagaattaaacaagtaagctctagttgcctaagaagttaatgtacccagaaatataaatttctcaacaatcatggaaaatgtgttacaactatatcttctttcaagtaggtcttgtaaatattttctgtattaatactgactatgctctcgtttggttgtcattctattctgagtttttaaccctcttgtttaacccaatctctcctcctcaaaaatgaataaatgcattgactcaagaaacatttatttttgagcgtctgttttggaataggtgctatattttaggcattggaaagacactagtgataaaaatggtaaaatgctttatctcctggatcttacattctatggtagagaagagataataatcgcaaaaaaactatcaggaatgataaacattataaagaagagtaaaatagggtgtgtaggagataattactgttttatattcactgctcagagatgtcttctctgataatcaagagagcagagaagagagacctaaatcagttgaagaaatgggtcacaacgtatcggaaaagagaccaccaggcagagagaatagtaatctttttttctttattcagtgtattaaatgcattgtgtttattgatataccccattagtttaatcatattccctcacactttgttattacctttattttaattgccatttttaaatttttgtgatgaacaaataaaattgtatatatttatcatgtacaatgtgatattttaaaatatgtatattgtgtggaatgggtaaattgaggtaattaacatatgcatcacctcacatacttataattctttgcagtaagaagacaaaatcaactctttgcctttatttcaaaattatttcattgtgtggtatttaatattttctatttaacaaaatgtgtatattatgtacaaatacctatgcataaaacatattttataagactaaaatatccttaatttccctctctttacacagtatctactagtttcctagcataaggaagaacagaaaatatttcagaagatatgtctattctcctttccttcatcattcaattgtagccaatatgtttacactagtgcttatcactatttctttacacttgcttttatattttctccatcatctttattattttacaatcactcacaagccacggagcagccattcagcttcgtccccatcactccctttaaattctctcctgactcagggtgattcccatttcacatctttctgttggccgattgtcgtctctttttagtgggtcatcagttctctgaaccgtcatatttctgttttaaaatgttttctcatttataaaactgctttattaaggatttggggttgtagagtatttgaagtttatatcagtatttagctccgatttaaggcaataattttggggtagatttattttttttctatagtatttttggaaagacgttgcattttctaatttcatttttaagaatttgatttgcctttccagttgttaccaggtggattgcatagggcttgcaggcattggggaatattcttgtttctcaagccctacagcttcattgtatgcattcctgctgtcttctccatgttcatttctaccaccttcctattcgtggttatgcctgggatggtgacccccttagtttaggcaagattgtcctgttatctccaccacttctttcccaggtatactccctgcatctatctcttcaataatcctcagattgctacctggctccgtgttcatcaggcttgggtatagcagtttacacttgtgagaggaccctctccttcttggggaataatatttcctggtattttttatcattaccaccaccagtgaccttgactgggtctcttctctgccggacttcctgcttccaatatggagtttctgtaccaattctgatgagtgtccgtgactttcttccccttccttacatgtaatttatagttgatggattgcctttgtctcctgatttcagtgaaggaatcatttgtgcttttttcattttttttgtcttggatgtttattatatcattggagaattaaagtaggataaaaagattggaagactatctaaaagtttgtatcagcaactaggactcccttatgtatgtttgaacagttttgttctgtttgcttttgtgagaaatgagatgaattgatgtgcaaagtgttattagttagggtgcctcaatataggcccaggaaacattggaacaccaaaatggatggagcagacatgagcagaacacaaaaaagaaataaacagcaatatgataatagtaggggattataataccccactctcaacactcataaacaacaaatggacccaaaaataaagacaatttaaaaatatcctgagacaaacaaaaatggacaaataacataccaaatcatggggtacagcaaaagtagttctgatagctactgagacagagagagaaatgatcccaaataagcaacctaacttggcactctgggaattagaaaagaagaaaaaagccaaaagttagaagaaagaagaaagttataaaggttagagcagaattaaacagataagaaagacaaaagaaaagatcagtaacacgaggagttggttctgtaaaaacgtgaggaaaattggcaaacctttaggtagacaaaccaagaaaactaagagagatgactcaaataaaactataagtaaagcaggagaaattagtcaatactaccaaaatacaaagggtcataagagattatcatgaccaattatgtcaataaattgagtaacgtagaagaaatggataaattcttagacatgtatgtcctgaagaaagaataaacctgaacaaattaataactagtacagagattaaatcaccaataataataataataaacttaaaagttcaggacttgatgcttttactggtgattgctaccaaatatctaaagacagattaatgctattctcaaacttttccaaacaattaaaaagggtgcactttccaacacattttttcatgcattaccctaacaccaatgtcagacaaggacggtataagaaaattacaggccaatttattttatgatcatggatgtaaagattctcaacactagcaaactgaattcaatatgttcaaaagatcatttagttgaatgttttctttcttctgaaattcttcattttgcttccaaatgtcatttttccttatattttattttttcattaatcaaatttaattttaaaatttccaactaaaaaaatctgtgggtttaataaacatatttttaattaacatttaaaaaaagcacaagtttgtaaattgtatattttctgtccattagattttggtttgagtattgggccaattgcacggtaagctttttaatttttttccagaagtaatcccaggaccttaaatctccactgaaactctcgaagtttaattggtcagctgggattgtagtccctggggtgttgaaagcataaataagccataccttaagtctggaccatttatccctgtagggagtccctcttctcctctgttctctttcagaactacttattactttaggttcagtgtatgtagcatatggtgactctatgggtttcagttttctgaaccccaaatatgcaaaaatatagaaaaagcagaccaggcatcccaccttctgtgtgccactaagggagcatctcttcctctttctcccctaataagttgtatattattttctcagtattttaattttttgctatttatattatctgagatttatcattggaatcatacaaatattaaaccaggaaagatcacccaggaagaaattgagatcacccacaatatcaggtattctaaaacatgttatatgaaaattgtaataattaaaacatgaatcacaaatcttgcaggtagaaatgtcaacatattaatttttttgaggaagagcaacttggatgaatatatggatgtaaacttgctgatcaactacagccaaaaattacattgtaattgtaacgtgtccctaaacttgacccattaccaatcctgataagtctgtgcttaggattatgtagattttcaaaggattgaaatgtagttgccttttccaaatcttgactagcttgtctgacaaggtaggatcatgtcaagtagattggactgaggtgatccctttattttaaagagcagtctttggcaaacactgatactagaaactgatatgattttgctcttgttgaagaattttacttattataaatgttttttaaaaacaagggaaggaaacataatcttaaaaccactcatttgtgtccatccacattatactgtagagaagactgacttttttttccaggtgattattgtagcaaaacattttaagttttattgagatcgtttgtcatgtctaaatttgttcatcataatatatcctgagcttagttcagtgcctggctcatgataaattttatttatttagtgtggtgagagcacttaacaggaaatttaccctcttacactttttcagtgcacgattcagtactgtgaactccaggcacggtgctgcacagccaatctctaggacttcatcttgtgtcactgaaaccttatacccattgcacagtagatcaagagaagaaatacttgatacacggcacaagacctatagaacacgcagggaaaacttcttctggcatcagaaaacctgttcattgctgagttcattcattatattcacctccttacaccacaatgctaacccatgaatctaactggctgtgacaaaactgtctttcataaacctacagactttaagatttatggaaagagaaagacctgtggcatcctagaattctaacatccactcttggatcatcatgaccacttagcagagctttgcattgaattccagataaagaatatcaaactcaaggatatagcagctcttgaataatgggaaagataaatgaagtgtttggcaagtagaaagataatcatgaagttcagtcattaaagtctcgccctgaacaaatgccatggacttgacatcataaaaaacataaaataggtataagtcaaaaatgtttattttgggaaattatatttaaatcaaaatcaaaaatatactcatctgaaagacaacagaaagttctgtcaccaagggaaataaaactctaattaccaaaacaaaatgtaaacaaaataaaacttacataaatatatacattcatgcattcaaaagaagttgcatagaattttatttagccatatctcagtattttggaattttgcaaacaccaagagtcgcaataataatacataatcttcgtctctcactctgttattttttcctcaagcttgggaaagataatgtgtgagtggatagagtgattctggggatcgggatgagacaattctgcttaaggcaacttctcttaggatggcaggaggtagcaagagaagaaagggcagaataaccattacagtttacaccatatttatagctataatgccttaatataatatgaagtaattactttcaattactttttaataacagagatatatacaatatatattctttaaaatggttatctaaaagtttaagaaattaaaaaaccttaatcttagaaattatctagaaatttaaatttctgaattataggtaaatgtgttatgattttcttttttcaaataagccttacaaatattttcaatattgatactgtttcattttaaatgtgccactaacatgatgctgtcatttcattgtcattctagcagtaaggattctgagtccttagcactctgtttgacccagcctctccttccaggaaatgactaaatatactcattcagagcatatttatttttgagcatctactttggggctaccactgtgttaggctttcagcacacagcagtgataaaaatgagcaaaatgtctcatcttattaatatgacactatattgtggaaaagagaaacaattgtaaaaaatatgttcaagattgttaattttatgaagaaaaataagacagcataagggacagatcagtcatttttattcattggtcattgaaatcttttctgataatcgaatagcacagaagagacctaaaagaactgaaataatgggttctagtgtatctggggaaaacgactcaaggtaaagggaaccatcatctttttcagatggcactcagagccataagaggttcagatagatccacccagcagtgagtgcagtgggtttttctaggcagaaaacacagaagaaacatcaagaaatcacatgattggcttgccatgtccaagtccttttctaattttgtttttctttttaaagcatattttttgcctgctaccatgacttgtaatttttgatgatgttgttgaaagctgatgtattcatttgctatgcgtaccatagcattctggtagtttgatgacaacctttggcattccttggcttgaagtagcattacttcaatctattcctttatcttcaaaagataatattcctgggtgcatgtccaactttttttaaataaggacaccagtttcaaaggtaaagcccagacactggttaaggtagtgaggacagattttaattagtaacatattttggggtatttgtgggtttttcacctaaaatgtaatcttacacaggctgtagattatatctctgtttccaggaagccccgtgtgttgctttgtgtgtgcatcagtctctcgagaaccccctgtgaatcaggaggcatacgttccagtgactatagggagtcgaggggctaaagaggtaagtgaaacatctggtaggggtaaaaggatgggtatatatcaaaagtcaggggtgtttaatggaaaagaggtgcatatcaaagtgtcaggggagttcaatggaaaaagttaagatggtaaaagaaagaaggaaaaaagaaggaaatgggaagggagcagtcctataagagccactttaggcagatcttaagattttcaaataaaccattgcagttccgaattatccacagtaaagtcattttgcctaaaatagaagcagacatggttagtgtcatagtatatatagagagtaggaacccaaaaggggtttaactgtggagttcctgtgggaagagtaagttcaaatagaatgaagaggtctcacaagaagccagagtgaacattccagcacaggagttaggaagtgaattcccactgaaaacagggagccaggaagataaacagccagcccaggagatgtctttcaaaagcagcctggaattataacccagccttagagactacagccagaaacataggaagaaaatatgtcctcgccatgcctcagtgcaaatttctacacagtgttaggccagaagttgaactcgccaccaaatacccaaaaaagtaagtcaactgaagatcagacaaaggtttctacgcatgcagaaaggattgactgttttgtccaagggccagataagggttccaatctggatttgagttccagtgccagataactgtcaagacaaacaaaatggaaaactggttaaagaggtaagaacgtgctttaactagtcatatactattgaaacaggcaagagttcagcatgaacttaactttgatgtatccaggttgaggaaaatgttaaagggagtttgaggaaagagaaatgggagttagtgggggctcaggagggtcagggatgtgagaaattacaaatcgtgagaaggggggagttggttcctgtgaaacccatttgctttgttaactgatacttgctgatgttgggcttctaccctcccacagaggtcaggagacaccaggcctatcttcaagtcttggctgggacaagcatgctatagattgtctgtgtacttacataagttatatgttgaaatcttaaaccccaatgtgatgatattgggagaggaagtctttgggggttgattagatcatgagtgatgaactcatgaatggccttagtgacctcataaaagagactccagagagctttcttgcctcttctgccatgtgagggcacagcaagaagaccatgctctataaatcagaaaatgggtccttacagaccaaactggctggcacctttattgtggactttccaatctgtggaaatgtgagaaataagtgttgtgtaaggccatggtatttttgttataggaaccatgaagacaggcaggtttcagttttctcagacagttcactttaagggagactgggtcgttcgttctagagatgtagacttgaactgttaccaactatgttcctgtctttttcaagtttttatagaccaaagttaaggctgaattgagaaggctcagaagaccctggctagagtttcgtcaagtttaaaatgatcgtcaactctgtatacatcaaaattgagttcagtgcgtgctggactgttttctctgtttcaatagtatatgactcattaaaatatgttgttactactttttcttcaatcatattggattagggacactttctactagagtatgttctcatcttcaattaactaattacatctgcaatggtcctatttccaaataagggtacattctgagatagttgggggtatgacttcaatatatgagtctgtggggatacaattcttaccataatttacatgatgtgttaggtaaagataaacaggcgtttagtgtgaagtttatgtttatgtgttaggctatgtttatcgctagttttacctctgatgtcagaggccataatttgctctagtgttcttatttttgtgtcctctgttatctttggcttttctacagattcattgttaaacaggatttgaggcttgtcatccttccatgtgcatcctctgttatcatacatgagatattttaatgtgtttgtcagtgtggaagggagagaaatcattctatagtcctacaaattggtctgaatctatttgccagcatgtgttcttggactgcaaccttcaaagagcttcttaacatcccctgcccacccccacataggtgtgacacaggttagaaggacctggagttgggtattttccttctagcatattggttagcctgtggtaaaaccccagtaatacggcagcctctgttaaatagtttattttttttaattatactttaagttctagggtacatgtacacaacgtgcaggtttgttacatatgtatacatgtgccatgttggtgtgctacacccattaactcgtcatttacattaggtatatgtcctaatgctatccctccctcctccccccaccccacaacaggccctggtgtgtgatgtcccccttcctgtgtccaggtgttcttattgttcaattcccacctataagtgagaacatgcgatgtttggttttttgttttgcaatagtttgctgagaatgatggtttccagcttcatccatctccctacaaaggacaagaactcatcattttttaaggctgcagagtattccatggtgtatatgtgccacattttcttttgtgtgtgtgtttttttttttgttttgtttaagtttttcttttattattatactttaagttttagggtacatgtgcacattgtgcagattagttacatacgtatacatgtgccatgctggtgcgctgcacccactaactcgtcatctagcattaggtatatctcccaatgctatccctccccccaccccacaacagtccccagagtgtgatgttccccttcctgtgtccatgtgatctcattgttcaattcccacctatgagtgagattatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaataatgccgcaataaacatacgtgtgcatgggtcttatagcagcatgatttatagtcctttgggtatatacccagtaatgggatggctgagtcaaatggtatttctagttctagatccctgaggaatcgccacactgacttccacaatggttgaactagtttacagtcccaccaacagtgtaaaaatgtttctatttctccacatcctctccagcacctgttgtttcctgactttttaatgtttgccattctaactggtgtgagatggtatctcattgtggttttgatttgcatttctctgatggccggtgatgatgagcatttttcatgtgttttttggctgcataaatatcttcttttgagaagtgtctgttcatatccttcacccactttttgatggggttgtttttttcttgtaaatttgtttgagttcattgtagattctggatattagccctttgtcagatgagtaggttgcgaaaatttcctcccattttgtaggttgcctgttcagtctgatggtagtttcttttgctgtgcagaagctctttagtttaattagatcccatttgtcaattttggcttttgctgccattgcttttggtgttttagacatgaagtccttgcccatgcctatgtcctgaatggtactgcctaggttttcttctagggcttttatggttttaggtctaacgtttaagtctttaatccatcttgaattgatttttgtataaggtgtaaggaagggatccagtttcagctttctacatattgctagccaattttcccagcaccatttattaaatagggaatcctttccccattgcttttctcaggtttgtcaaagatcagatagttgtagatatgcggcgttatttctgagggctctgttctgttccattgatctatatttctgttttggtaccagtaccatgctgttttggttactgtagccttgtagtatagtttgaattcaggtagtgtgatgcctcgaggtttgttcttttggcttaggattgacttggtgatgtgggctcttttttggttccatatgaactttaaagtagttttttccaattctgtgaagaaaggcattggtagcttgatggggatggcattgaatctgtaaattaccttgggcagtatggccattttcatgatattgattcttcctacccatgagcatagaatgttcttccatttgtttgtatcctcttttatttccttgagcagtggtttgtagttctccttgaagatgtccttcacatcccttgtaagttggattcctaggtattttattctctttgaagcaattgtgaatgggagttcactcatgatttggctctctgtctattgttggtgtataagaatgcttatgatttttgtacactgattttgtatcctgagattttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatcctgtcttgtgccagttttcaaagggaatgcttccagtttatgcccattcagtatgatattggctgtggctttgtcatagatagctcttatgattttgaaatacatcccatcaatacctaatttattgagagtttttagcatgaagggttgttgaattttgtcaaaggccttttctgcatctattgagataatcatgtggtttttgtctttggctctgtttatatgctggattacattgattgatttgcttatattgaaccagccttgcatcccagggatgaagcccactcgatcatggtggataagctttttgatgtgctgctggattcggtttgccagtattttattgaggatttttgcatcaatgttcatcaaggatattggtctaaaattctcttttttggttgtgtctctgcccagctttggtatcaggatgatgctggcctcataaaatgagttagggaggattccttctttttctattgattggaatagtttcagaaggaatggtaccagttcctccttgtacctctggcagaattcggctgtgaatccgtctggtcctggactctttttggttggtaagctattgattattgccacaatttcaaatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggataggtggtgatatcccctttatcattttttattgcttctatttgattcttctctctttttttattagtcttgctagcggtctattttgttgatcctttcaaaaaaccagctcctggattcattaattttttgatgggttttttgtgtgtctatttccttcagttctgctctgattttagttatttcttgccttctgctagcttttgaatgtgtttgctcttgcttttctacttcttttaattgtgatgttagggtgtcaattttggatctttcctgctttctcttgtgggcatttagtgctataaatttccctctacacactgctttgaatgtgtcccagagattctggtatgttgtgtctttgttctcattggtttcaaagaacatctttatttctgccttcattttgttatatacccagtagtcattcaggagcaggttgttcagtttccatgtagttgagtggttttgagtgagattcttaatccttagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttgggatggagagttctgtagatgtctattaggtctgcttggtgcagagctgagttcaattcctgggtatccttgttgactttctgtcttgttgatctgtctaatgttgacagtggggtgttaaagtctcccattattaatgtgtgggagtctaagtctctttgtaggtcactcaggacttgctttatgaatctgagtgctcctctgttgggtgcatatatatttaggatagttggctcttcttgttgaattgatccctttaccattatgtaatggccttctttgtctcttttgatctttgttggtttaaagtctgttttatcagactaggattgcaacccctgcctttttttgttttccatttgcttggtatattttcctccatccttttattttgagcctatgtgtgtctctgcacgtgagatgggtttcctgaatacagcacactgatgggtcttgactgtttatccaatttgccagtctgtgtcttttaattggaacatttagtccatttacatttaaagttaatattgttatgtgtgaatctgatcctgtcattatgatgtcagctggttattttgctcgttagttgatgcagtttcttcctagtctcaatggtctttacattttggcatgattttgcagcggctggtaccggttgttcctttccatgtttagtgcttccttcaggagctcttttagggcaggcctggtggtgacaaaatctctcagcatttgcttgtctgtaaagtattttatttctccttcatttaggaagcttagtttggctggatatgaaattctgggttgaaaattcttttctttagaatgttgaatattggcccccactctcttctggcttgtagggtttctgccaagagatccgctgttagtctgatgggcttccctttgagggtaacctgacctttctctctggctgcccttaacattttttccttcatttcaactttggtgaatctgacaattatgtttcttggagttgctcttctcgaggagtatctttgtggcattctctgtatttcctgaacctgaattttggcctgccttgctagattggggaagttctcctggataatatcctgcagagtgttttccaacttggttccattctcaccatcactttcaggtacaccaatcagatgtagatttggtcttttcacatagtcccatatttcttggaggctttgctctttttattcttttttctctaaacttcccttctcacttcatttgattcatttcatcttccatcactgatagcctttctccagttgattgcattgcctcctgaggcttctgcattcttcatgtagttctcaagccttggttttcagctccatcagctcctttaagcatttctctgtattggttattctagttatacattcttctaaatttttttcaaagttttcaacttctttgcctttagtttgaatgtcctcccgtagctcagagtaatttgatcgtctgaagccttcttctctcagctcgtcaaagtcattctccatccagctttgttccgttgctggtgaggaactgcgttcctttggaagaggagaggcgctctgctttttagagtttccagtttttctgttctgttttttcccatctttgtggttttatctacttttggtcttcgatgatggtgatgtacagaagggtttttggttttctcccattctatagcttgcctgttcactatgatgatagtttcctttgctgcacagaagctctttaattagatcccatttgtcaactttggcttttgttgccattgcttttggtgttttagtcatgaagtctttacccacgtctatgtcctgaatggtattgcctaggttttcttctagggtttttattgttttaggtctaacatttaagtctttaatctatcttgagttaattttttataagatgtaaggaagaagtccagtttcagttttctgcatatggctagccagttttcccagcaccatttattaaacagggaattttttttcccattgcttgtttttgtcagttttgtcaaagatcagatggttgtagatgtgcggtgttatttccgaggcctctgttctgttccattggtctatatatctgttttggtaccactaccatgctgttttggttactgtagccttgtagtatagttcgaagtcaggtagtgtgatgcctccagctttgtcctttttgcttaggattgtcttggctatatggcctttttttggttccatatgaaatttaaagtagttttttctaattctgtgaagaaggtcaagctagcttgatggggatagcattgaatctataacttactttgggcagtgtggcatatatatccaaaggattataaatcattctataaagtcacatggacacatgtttattgtggcactattcacaacagcaaagacttggaatcaacctaaatgcccatcaatgatagactggataaagaaagtgtggcacatatacaccatggaatactatgcagccatagaaaaggatgcattcatgtcctttgcagggacatggatgaaggtggaaaccatcattttcagcaaactaacacaagaacagaaaagcaaacatcgcatgttctcattcataaatgggagttgaacaataagaacacatggacacagggaggggaacatcacacaccagggcctgttggtgggttggggggctaggaaggagggatagcattaggagaaatacctaacatagatgacaatttgatggctgcaggaaaccaccatggcatgtgtatacttatgtaacgtgcacgttctgcacatgtaccctagaacttatagtttaaaaaaaagtttgctttggctttcgatgtaattctacttagacaactcttatacatatagagtaacatgtacacacatttcattttacaaattctcccttttattttgacttggcatttgacaatatcactttgatagtagcttgtgaatattagtcaagatttgtatagaggtcgggcacagtgactcatgcctgtaaccccagcactttgggaggctgagtcaggtggatcacttgaggtcagttgttcaagagcaccctagccaacatggtgaaacaccatttgtactaaaattacaaaaattaggccaggcacagtggctcacgcctataatcccagcactttgggaggctgaggtagttaggtcacctgaggtcaggagttccagaccagcctggccaacatggtgaaacccccatctctactaaaaaaaaatatatatatatataaaaatatatatatatacacacaaaaattagcgggcatggggcctgtgcctgtaatcccagctacttgggaggctaaggcaggagaattgcttgaacgtgggaggtggtttgcagtgagcagagattgtgccactgcactccaccctgggagacagagtgagattccatctaaaaaaaaaaaaaaaaaaaaaaaaatacaacaattagctgggagtggtggcacacgcctgtagtctcagctactcttgaggctgaggcaagagaattacttgaacccaggaagcagaggttgaagggaacagagatcacggcactgtactctagtccaggcgacagaacgactccatctcaaaaaatatatatatttgtatacatataacaaaatatttgcatcaaaaggacattgggtcagttgctttacctgcataaatacatcatttgaacatataaatatatcggtgtaaaaatgggcaaagtacaagaataagcaaagagtgaataaatacaaatatcaaataaaacaaatgttaatacaatacttttgttgtttgagtaaaactttattcaataaaaatagaaggaagtggcatttcccgcccatggatttatgttgaggaaagttctataggtcttcacaacatgttttaggtgatatataaggaagataattatactgtaaacgactgtggattaccattcttgacctcattactttctatccccaaatattaatcacttagtatttgaagctgaagagtcctgaagctgcaggaaaaatggaggaaaccaacaacagctctgaaaagggatttcttctcctgggattttcagatcagcctcagctagagaggtttctttttgccatcattttgtacttctacgtcttgagccttctggggaacactgccctcatactagtatgttgtctggactccagactccacactccaatgtacttcttcctcagcaacctctcgtgtgtggacatctgctttaccaccagtgttgccccacagttgctggttaccatgaataagaaagacaaaaccatgagctacggtggctgtgtggcccagctctatgtggccatggggttgggctcgtctgagtgtattctcttggccgtcatggcttatgaccgctatgctgctgtctgccggccactgcgctacatagccattatgcaccccaggttctgtgcgtctctggccggtggagcatggctcagcggcctcatcacctccctaattcagtgctccctcactgtgcagctgcccctctgtggtcatcgcacactggatcatattttctgtgaggtgccagtgctcatcaaactggcctgtgtggatacgactttcaacgaggcagaactctttgtggccagtgtagtctttctaattgtcccggtgttactcatcttagtctcctatggctttatcactcaagctgtgttaaggataaaatcagctgcgggccgccaaaaggcctttgggacctgttcgtctcacctggttgtggtcatcattttctatgggaccatcatattcatgtaccttcaaccggccaataggagatccaaaaaccagggaaagtttgtttctcttttctataccatagtcaccccacttttaaaccccattatctacactctgagaaacaaagatgtgaaaggggccttgaggaccctgatactgggtagtgctgctggacaaagccacaaggactaggaaacacctggaattctaaacaagggaaacacctcaaggcagagtgagggttcatcctccccagacattcctcttgtcaatcccaaagccacagggactaggaagcattggaattctaaagaagggaaacacctcaaggcagcgtgaggattcatcctccccagacattcctcttgtcaatcccaaagccacagggactaggaagcattggaattctaaagaagagaaacacaccaaagcagcatgagggttcatcctcccagacattcctcttgtcaatccaagaccctgtgttctatctggaaaaaaatgtttgtccttcatccacctgccatcaaggttcatgtatccattatttccttctaatgtgccagcccatctgatagacttctactaatgcttcaaaactcagctgaaatgtcacctgcactcactagctgtcctgaaacaccatccttctcatccttgtgcagaattaactgtttcataatatgtttccatagcacttgatccacactaccatttctacatttcacatttgagatatatgtatacatatatctctaactaggcaaagcaatgtatataacagactgaaaaaatacatgaccattttcccagaatatgtcacttttaactggagaatggaaccatcccactctattggcttatttacaacacgagaaacacaaatattaagagttgtgatgctttggttccacagaattgtgggatgcaaataatgactaatattttattaaaggaatcaaataagcaaacttgaattaaggagattgattaaaagttgagtaaaattgccatatactaaaatgtgttttaacatttatacaaaattcataaaataagttattgtttttggccttaaactctggaaaacagttacttatgtaattttatacttcaaaaatttgaaatatgaatcccacacactgtctcacgttaacgatcatagttatatgtttggtttccaaaacagcaaaaaaaatgaaatatttagaagcattttaataaatgtattcttatatttgaccaaacttttactttctgatttaattctgtctctatctctctgtgtatctttgtgtgtctcagcctctttcttgctttcttttcccaaaacgattgaacttcatcaattcgtcaacctcaagtattttaagagaactgtgcaattatagaaaaaagtgatttaatctgtggttgtaattttacttcatattctcattatgatacacatgaaaaaagcatgaaaacatcaatgcaaatgaagagtaaaatgcaggcagaatctggggtggaagtggaattttcaagtgatttagacttttcttttttggacagggtcttgctctgttgcccaggctggagtgcagtggctcaatcatggctcactgcagccttgacctcctgggtttaagtgatccctctgcctcagccttccaacattcagatttataataattcatcctggtgtgagaatattgtagcctgtctacgaatgttaaggataacgtttggacctgcctctcctaccaaagcctggactgaaggcaaaatggctgcgcacacaagaacaaaaaggcatcaggagaattcactaatgactcaggctgcctcttcacaaataccctgtccagctggcacctcttcaatatacttttagcaaacaaaatgatgaatatccaatttaacaaaaacgagggaaaagaagcctggttaaatttgtcttctaggatattcttatgtgattttcctcctccagtaatggagaggagagttgggaactgagcagaacatgctgaggagcacatgtttttatttacaatatgcaagtagagaagtagttctacaggaagcgtcacatgtacaaatgcattattcctgataacccgagcaacacagcataggaaagaatgtacctgtgtcagagtctcaatcaatttacatggaatatggccccagggcaaaagatgtggcatttaaaggaaagaaatagctccaggtgaaaagacaaccatgtgtaaagcaatgatatgaacacaatatgtagaaaaacctacatatgaattgtgaagcaaccattttcaaagacaaactcacatccatttaaggtaatatggaatacaaatcccactgaaaataaaatcaaattattactgtatacaataaattcaaacataattcagaaaaaaatagaatatctgcttattgctgaaattagcatctttagctgtaagttatttgcacccaaaaggaaaccagaaaataatagatataacataggcaaagcaacctaaaaaaactacttaactgcagatgaaaatgggaacacatttgaaaataaaatcctgttactactttcttgaatttagagctttcctatgatatggatatgtttatactgcttttataatcatcatacatgtataatttcatactatttttatttataatgtgagcatttttctgattaatctaaaaaatatccaccatttattaaaaatcttccctataattgaataacatgagtagtttctcttttttaaatacctacattgagcatacttttgtttgtgaatgcttataattatgtacttataatgtattttataaatacaattagtaaatctaaaacaggtacacatcagtcaatttgcacacattactagcttgatctgcagaacacgttttcaaaggatgcgccaagaaaaaaactatcacttagttaaatgaccattcagtattgcaattatttaaaaactatacaatgagaatgctgtaataagtatatggttccaccactccaaacaccatgaattttttttaaaagatatttttaagaaaaaataaaatgattttacataacaaatattaatgaattcatgaaaaacaaaaaccatataggaccacagctcagagaagaaaaatgggaggcacttactatttaaaccctaacccaaatggtcagtaaaaagacaagtaccagctactacaaaaaaacaccaaaatataaagaccaatgatactgtgaagaaactgcattacctaatgtgcaaaataaccagctagcatcacgatgacaagatcaaattcacacataaaaatattaatcttaggcagggcacagtggctcacacttgtaatcatagcactttgggaggctgagtcaggtggatcatgaggtcaggagttcaagctcagcctggccagcatggtgaaaccccatgtctcctaaaaaaaatacaaaaaattagccaggcacagtggtgcatgcctataatcccagttactcaggaggctgaggcaggagaattgcttgaacctaggaggcagaggttgcagtgagccaagatcgtgccactgtactccagcctgggcaacagagcaagactccatctcaaaaaaaaaagaaaaaaatgtatatgttatcactttggtctcatttgagtatgaatgatcagacagggaaaataaaagtaccaagaaaaataaacaagggtcttataataaaagcaacacagaatggccaaagctatcctgagcaaaaagaggaaaaaagctggagccatcacattactagacttcaaaatatactaccaagttatagttaccaaaacagcctggtattggcataaaaacagacacatgggccaatagaacagaatggagaacctagaaatagattcatgtatttacagccaactgatttttgacaaaggtgccaagaacatacactggggaaaggagagtttcttcaataaatgtcctggaacagtaatcagcagctggggctggtaccatagggatacttaaagttgaatttatcaattgctggaagctcatgtgaactaacttgacaaataaaaaaaatgttgagccccagtcttaggaaatcctccctatactcatgatttttaccttcaggagtctcaacagcttctcactgtgcaaagtagagagaaattcccttttgctttggcagagagaggagaaaataaacatttgaaatatgcccagagctctctgttcaccataacctgatctcagtagtaactatttaatgattgccattctaactggtgtgagatgatatctcattgtggttttgatttgcatttctctgatggccagtgataatgagcattttttcatgtggctgtgggctgcataaatatcttttgagaagtgtctgttcatatctttcgcccactttttgatgggttttttttttcttgtaaatttgtttgagttctttgtagattctggatattatccctttgtcagatgagtagactgcaaaaattttctcccattctctaggttgcctgtacactctgatggtagtttcttttgctgtgcagaagctctttagtttaattagatcccatttgtcaattttggcttttgttgccattgcttttggtgttttagacatgaagtccttatccatgcctatgtcctgaatggaattgcctaggttttcttctagggtttttatggttttaggtctaacatttacgtctttaatccatcttgaattaatttttgtataaggtgtaaggaagggatccagtttcagctttctacatatggctagtcagttttcccagcaccatttgttaaatagggaatcctttccctatttcttgttttgtcaggtttgtcaaagatcagatagttgaagatgtgtggtattatttcggagggttctgttctgttccattggtctatctctctgttttggtaccagtgccatgctattttggttactgtagccttgtagtatagtttaaagttaggtagcatgatgcctccagctttgttcttttggcttaggattgacttggcgatgcaggctcttttttggttccatatgaactttagttttttccaattctgtgaagaaagtcattggtagcttgatggggatggcattgaatctataaattaccttgggcagtatggccattttcatggtatttcttcttcctatccatgagcatggaatgttcttccatttgtttgtatcctcttttatttcattgagcaaacaggtgctggagaggatgtggagaaataggaacacttttacactgttggtgggactgtaaactggttcaaccattgtggaaaacagtgtggtgattcctcaggtatctagaactagaaataccatttgacccagccatcccattactgggtatatacccaaaggattataaatcatgctgctataaagacacatgcacatgtatgtttattgcagcagtattcacaatagcaaagacctggaaccaacccaaatgtccaacaatgataaagtggattaagaaaatgtggcgaagatggccgaataggaacagctccggtctacagctcccagcgtgagcgacgcagaagacaggtgatttctgcttttccatctgaggtaccgggttcgtctcactagggagtgccagacagtgggtgcaggtcagtgggtgcgcgcaccatgtgcaagccaaagcagggcgaggcactgcctcactcgggaagcgcaaggggtcagggagttccctttcctagtcaaagaaaggggtgacggagggcacgtggaaaattgggtcactcccacccaaatactgcacttttccgacgtgcttaaaaaacagcgcaccacgagattatatcccgcacctggctcggagggtcgtactcccacggagtcggagtctcgctgattgctagcacagcagtctgagatcaaactgcaaggcggcagcaaggctgggggaggggcacccgccattgcccaggcttgcttaggtaaacaaagcagccaggaagctcgaactgggtggagcccaccacagctcaaggaggcctgcctgcctctgtaggctccacctctgagggcagggcacagacaaagacagcagtaacctctgcagacttaaatgtccctgtctgacagctttgaagagagcactggttctcccagcacgcagctggagatctgagaacgggcagactgcctcctcaagtgggtccctgacccctgacccctgagcagcctaactgggaggcaccccccagcaggggcagactgacacctcacacggcagggtactccaacagacctgcagctgagggtcctgtctgttagaaggaaaactgacaaacagaaaggacatccacaccaaaaacccttctgtacatcaccatcatcgaagaccaaaagtagataaaaccacaaagatgggaaaaaacagaacagaaaaactggaaactctaaaaagcagagcgcctctcctcttccaaaggaacgcagttcctcaccagcaacggaacaaagctggatggagaatgactttgacgagctgagagaagaaggcttcagacgatcaaattactctgagctacgggaggacattcaaactaaaggcaaagaagttgaaaactttgaaaaaaatttagaagaatgtataactagaataaccaatacagagaaatgcttaaaggagctgatggagctgaaaaccaaggcttgagaactacatgaagaatgcagaagcctcaggaggcaatgcaatcaactggagaaaggctatcagtgatggaagatgaaatgaatcaaatgaagtgagaagggaagtttagagaaaaaagaataaaaagagcaaagcctccaagaaatatgggactatgtgaaaagaccaaatctacatctgattggtgtacctgaaagtgatggtgagaatggaaccaagttggaaaacactctgcaggatattatccaggagaacttccccaatctagcaaggcaggccaaaattcaggttcaggaaatacagagaatgccacaaagatactcctcgagaagagcaactccaagaaacataattgtcagattcaccaaagttgaaatgaaggaaaaaatgttaagggcagccagagagaaaggtcaggttaccctcaaagggaagcccatcagactaacagcggatctcttggcagaaaccctacaagccagaagagagtgggggccaatattcaacattctaaagaaaagaattttcaacccagaatttcatatccagccaaactaagcttcctaaatgaaggagaaataaaatactttacagacaagcaaatgctgagagattttgtcaccaccaggcctgccctaaaagagctcctgaaggaagcactaaacatggaaaggaacaaccggtaccagccgctgcaaaatcatgccaaaatgtaaagaccattgagactaggaagaaactgcatcaactaacgagcaaaataaccagctgacatcataatgacaggatcagattcacacataacaatattaactttaaatgtaaatggactaaatgttccaattaaaagacacagactggcaaattggataaacagtcaagacccatcagtgtgctgtattcaggaaacccatctcacgtgcagagacacacataggctcaaaataaaaggatggaggaaaatataccaagcaaatggaaaacaaaaaaaggcaggggttgcaatcctagtctgataaaacagactttaaaccaacaaagatcaaaagagacaaagaaggccattacataatggtaaagggatcaattcaacaagaagagccaactatcctaaatatatatgcacccaacagaggagcactcagattcataaagcaagtcctgagtgacctacaaagagacttagactcccacacattaataatgggagactttaacaccccactgtcaacattagacagatcaacaagacagaaagtcaacaaggatacccaggaattgaactcagctctgcaccaagcagacctaatagacatctacagaactctccatcccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactaaggattaagaatctcactcaaaaccactcaactacatggaaactgaacaacctgctcctgaatgactactgggtatataacaaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatccaaaattgacaccctaacatcacaattaaaagaagtagaaaagcaagagcaaacacattcaaaagctagcagaaggcaagaaataactaaaatcagagcagaactgaaggaaatagacacacaaaaaacccatcaaaaaattaatgaatccaggagctggttttttgaaaggatcaacaaaatagaccgctagcaagactaataaaaaaagagagaagaatcaaatagaagcaataaaaaatgataaaggggatatcaccacctatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggatttgaaattgtggcaataatcaatagcttaccaaccaaaaagagtccaggaccagacggattcacagccgaattctgccagaggtacaaggaggaactggtaccattccttctgaaactattccaatcaatagaaaaagaaggaatcctccctaactcattttatgaggccagcatcatcctgataccaaagctgggcagagacacaaccaaaaaagagaattttagaccaatatccttgatgaacattgatgcaaaaatcctcaataaaatactggcaaaccgaatccagcagcacatcaaaaagcttatccaccatgatcgagtgggcttcatccctgggatgcaaggctggttcaatataagcaaatcaatcaatgtaatccagcatataaacagagccaaagacaaaaaccacatgattatctcaatagatgcagaaaaggcctttgacaaaattcaacaacccttcatgctaaaaactctcaataaattaggtattgatgggatgtatttcaaaatcataagagctatctatgacaaagccacagccaatatcatactgaatgggcataaactggaagcattccctttgaaaactggcacaagacaggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaaatctcaggatacaaaatcagtgtacaaaaatcataagcattcttatacaccaacaatagacagagagccaaatcatgagtgaactcccattcacaattgcttcaaagagaataaaatacctaggaatccaacttacaagggatgtgaaggacatcttcaaggagaactacaaaccactgctcaaggaaataaaagaggatacaaacaaatggaagaacattctatgctcatgggtaggaagaatcaatatcatgaaaatggccatactgcccaaggtaatttacagattcaatgccatccccatcaagctaccaatgcctttcttcacagaattggaaaaaactactttaaagttcatatggaaccaaaaaagagcccacatcaccaagtcaatcctaagccaaaagaacaaacctcgaggcatcacactacctgaattcaaactatactacaaggctacagtaaccaaaacagcatggtactggtaccaaaacagaaatatagatcaatggaacagaacagagccctcagaaataacgccgcatatctacaactatctgatctttgacaaacctgagaaaagcaatggggaaaggattccctatttaataaatggtgctgggaaaattggctagcaatatgtagaaagctgaaactggatcccttccttacaccttatacaaaaatcaattcaagatggattaaagacttaaacgttagacctaaaaccataaaagccctagaagaaaacctaggcagtaccattcaggacataggcatgggcaaggacttcatgtctaaaacaccaaaagcaatggcagcaaaagccaaaattgacaaatgggatctaattaaactaaagagcttctgcacagcaaaagaaactaccatcagactgaacaggcaacctacaaaatgggaggaaattttcgcaacctactcatctgacaaagggctaatatccagaatctacaatgaactcaaacaaatttacaagaaaaaaacaaccccatcaaaaagtgggtgaaggatatgaacagacacttctcaaaagaagatatttatgcagccaaaaaacacatgaaaaatgctcatcatcaccggccatcagagaaatgcaaatcaaaaccacaatgagataccatctcacaccagttagaatggcaaacattaaaaagtcaggaaacaacaggtgctggagaggatgtggagaaatagaaacatttttacactgttggtgggactgtaaactagttcaaccattgtggaagtcagtgtggcgattcctcagggatctagaactagaaataccatttgactcagccatcccattactgggtatatacccaaaggactataaatcatgctgctataagacccatgcacacgtatgtttattgcggcattattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccgcataatctcactcataggtgggaattgaacaatgagatcacatggacacaggaaggggaacatcacactctggggactgttgtggggtggggggagggatagcattgggagatatacctaatgctagatgacgagttagtgggtgcagcgcaccagcatggcacatgtatacgtatgtaactaatctgcacaatgtgcacatgtaccctaaaacttaaagtataataataaaagaaaaacttaaacaaaacaaaaaaaaaaacacacacacaaaagaaaatgtggcacatatacaccatggaatactctgcagccttaaaaaatgatgagttcttgtcctttgtagggagatggatgaagctggaaaccatcattctcagcaaactattgcaaaacaaaaaaccaaacatcgcatgttctcacttataggtgggaattgaacaataagaacacctggacacaggaagggggacatcacacaccagggcctgttgtggggtggggggaggagggagggatagcattaggacatatacctaatgtaaatgacgagttaatgggtgtagcacaccaacatggcacatgtatacatatgtaacaaacctgcacgttgtgtacatgtaccctagaacttaaagtataattaaaaaaaataaactatttaacagaggctgccgtattactggggttttaccacaggctaaccaatatgctagaaggaaaatacccaactccaggtccttctaacctgtgtcacacctatgtgggggtgggcaggggatgttaagaagctctttgaaggttgcagtccaagaacacatgctggcaaatagattcagaccaatttgtaggactatagaatgatttctctcccttccacactgacaaacacattaaaatatctcatgtatgataacagaggatgcacatggaaggatgacaagcctcaaatcctgtttaacaatgaatctgtagaaaagccaaagataacagaggacacaaaaataagaacactagagcaaattatggcctctgacatcagaggtaaaactagcgataaacatagcctaacacataaacataaacttcacactaaacgcctgtttatctttacctaacacatcatgtaaattatggtaagaattgtatccccacagactcatatattgaagtcatacccccaactatctcagaatgtacccttatttggaaataggaccattgcagatgtaattagttaattgaagatgagaacatactctagtagaaagtgtccctaatccaatatgattgaagaaaaagtagtaacaacatattttaatgagtcatatactattgaaacagagaaaacagtccagcacgcactgaactcaattttgatgtatacagagttgacgatcattttaaacttgacgaaactctagccagggtcttctgagccttctcaattcagccttaactttggtctataaaaacttgaaaaagacaggaacatagttggtaacagttcaagtctacatctctagaacgaacgacccagtctcccttaaagtgaactgtctgagaaaactgaaacctgcctgtcttcatggttcctataacaaaaataccatggccttacacaacacttatttctcacatttccacagattggaaagtccacaataaaggtgccagccagtttggtctgtaaggacccattttctgatttatagagcatggtcttcttgctgtgccctcacatggcagaagaggcaagaaagctctctggagtctcttttatgaggtcactaaggccattcatgagttcatcactcatgatctaatcaacccccaaagacttcctctcccaatatcatcacattggggtttaagatttcaacatataacttatgtaagtacacagacaatctatagcatgcttgtcccagccaagacttgaagataggcctggtgtctcctgacctctgtgggagggtagaagcccaacatcagcaagtatcagttaacaaagcaaatgggtttcacaggaaccaactccccccttctcacgatttgtaatttctcacatccctgaccctcctgagcccccactaactcccatttctctttcctcaaactccctttaacattttcctcaacctggatacatcaaagttaagttcatgctgaactcttgcctgtttcaatagtatatgactagttaaagcacgttcttacctctttaaccagttttccattttgtttgtcttgacagttatctggcactggaactcaaatccagattggaacccttatctggcccttggacaaaacagtcaatcctttctgcatgcgtagaaacctttgtctgatcttcagttgacttacttttttgggtatttggtggcgagttcaacttctggcctaacactgtgtagaaatttgcactgaggcatggcgaggacatattttcttcctatgtttctggctgtagtctctaaggctgggttataattccaggctgcttttgaaagacatctcctgggctggctgtttatcttcctggctccctgttttcagtgggaattcacttcctaactcctgtgctggaatgttcactctggcttcttgtgagacctcttcattctatttgaacttactcttcccacaggaactccacagttaaaccccttttgggttcctactctctatatatactatgacactaaccatgtctgcttctattttaggcaaaatgactttactgtggataattcggaactgcaatggtttatttgaaaatcttaagatctgcctaaagtggctcttataggactgctcccttcccatttccttcttttttccttctttcttttaccatcttaactttttccattgaactcccctgacactttgatatgcacctcttttccattaaacacccctgacttttgatatatacccatccttttacccctaccagatgtttcacttacctctttagcccctcgactccctatagtcactggaacgtatgcctcctgattcacagggggttctcgagagactgatgcacacacaaagcaacacacggggcttcctggaaacagagatataatctacagcctgtgtaagattacattttaggtgaaaaacccacaaataccccaaaatatgttactaattaaaatctgtcctcactaccttaaccagtgtctgggctttacctttgaaactggtgtccttatttaaaaaaagttggacatgcacccaggaatattatcttttgaagataaaggaatagattgaagtaatgctacttcaagccaaggaatgccaaaggttgtcatcaaactaccagaatgctatggtacgcatagcaaatgaatacatcagctttcaacaacatcatcaaaaattacaagtcatggtagcaggcaaaaaatatgctttaaaaagaaaaacaaaattagaaaaggacttggacatggcaagccaatcatgtgatttcttgatgtttcttctgtgttttctgcctagaaaaacccactgcactcactgctgggtggatctatctgaacctcttatggctctgagtgccatctgaaaaagatgatggttccctttaccttgagtcgttttccccagatacactagaacccattatttcagttcttttaggtctcttctgtgctattcgattatcagaaaagatttcaatgaccaatgaataaaaatgactgatctgtcccttatgctgtcttatttttcttcataaaattaacaatcttgaacatattttttacaattgtttctcttttccacaatatagtgtcatattaataagatgagacattttgctcatttttatcactgctgtgtgctgaaagcctaacacagtggtagccccaaagtagatgctcaaaaataaatatgctctgaatgagtatatttagtcatttcctggaaggagaggctgggtcaaacagagtgctaaggactcagaatccttactgctagaatgacaatgaaatgacagcatcatgttagtggcacatttaaaatgaaacaatatcaatattgaaaatatttgtaaggcttatttgaaaaaagaaaatcataacacatttacctataattcagaaatttaaatttctagataatttctaagattaaggttttttaatttcttaaacttttagataaccattttaaagaatatatattgtatatatctctgttattaaaaagtaattgaaagtaattacttcatattatattaaggcattatagctataaatatggtgtaaactgtaatggttattctgccctttcttctcttgctacctcctgccatcctaagagaagttgccttaagcagaattgtctcatcccgatccccagaatcactctatccactcacacattatctttcccaagcttgaggaaaaaataacagagtgagagacgaagattatgtattattattgcgactcttggtgtttgcaaaattccaaaatactgagatatggctaaataaaattctatgcaacttcttttgaatgcatgaatgtatatatttatgtaagttttattttgtttacattttgttttggtaattagagttttatttcccttggtgacagaactttctgttgtctttcagatgagtatatttttgattttgatttaaatataatttcccaaaataaacatttttgacttatacctattttatgttttttatgatgtcaagtccatggcatttgttcagggcgagactttaatgactgaacttcatgattatctttctacttgccaaacacttcatttatctttcccattattcaagagctgctatatccttgagtttgatattctttatctggaattcaatgcaaagctctgctaagtggtcatgatgatccaagagtggatgttagaattctaggatgccacaggtctttctctttccataaatcttaaagtctgtaggtttatgaaagacagttttgtcacagccagttagattcatgggttagcattgtggtgtaaggaggtgaatataatgaatgaactcagcaatgaacaggttttctgatgccagaagaagttttccctgcgtgttctataggtcttgtgccgtgtatcaagtatttcttctcttgatctactgtgcaatgggtataaggtttcagtgacacaagatgaagtcctagagattggctgtgcagcaccgtgcctggagttcacagtactgaatcgtgcactgaaaaagtgtaagagggtaaatttcctgttaagtgctctcaccacactaaataaataaaatttatcatgagccaggcactgaactaagctcaggatatattatgatgaacaaatttagacatgacaaacgatctcaataaaacttaaaatgttttgctacaataatcacctgaaaaaaaagtcagtcttctctacagtataatgtggatggacacaaatgagtggttttaagattatgtttccttcccttgtttttaaaaaacatttataataagtaaaattcttcaacaagagcaaaatcatatcagtttctagtatcagtgtttgccaaagactgctctttaaaataaagggatcacctcagtccaatctacttgacatgatcctaccttgtcagacaagctagtcaagatttggaaaaggcaactacatttcaatcctttgaaaatctacataatcctaagcacagacttatcaggattggtaatgggtcaagtttagggacacgttacaattacaatgtaatttttggctgtagttgatcagcaagtttacatccatatattcatccaagttgctcttcctcaaaaaaattaatatgttgacatttctacctgcaagatttgtgattcatgttttaattattacaattttcatataacatgttttagaatacctgatattgtgggtgatctcaatttcttcctgggtgatctttcctggtttaatatttgtatgattccaatgataaatctcagataatataaatagcaaaaaattaaaatactgagaaaataatatacaacttattaggggagaaagaggaagagatgctcccttagtggcacacagaaggtgggatgcctggtctgctttttctatatttttgcatatttggggttcagaaaactgaaacccatagagtcaccatatgctacatacactgaacctaaagtaataagtagttctgaaagagaacagaggagaagagggactccctacagggataaatggtccagacttaaggtatggcttatttatgctttcaacaccccagggactacaatcccagctgaccaattaaacttcgagagtttcagtggagatttaaggtcctgggattacttctggaaaaaaattaaaaagcttaccgtgcaattggcccaatactcaaaccaaaatctaatggacagaaaatatacaatttacaaacttgtgctttttttaaatgttaattaaaaatatgtttattaaacccacagatttttttagttggaaattttaaaattaaatttgattaatgaaaaaataaaatataaggaaaaatgacatttggaagcaaaatgaagaatttcagaagaaagaaaacattcaactaaatgatcttttgaacatattgaattcagtttgctagtgttgagaatctttacatccatgatcataaaataaattggcctgtaattttcttataccgtccttgtctgacattggtgttagggtaatgcatgaaaaaatgtgttggaaagtgcaccctttttaattgtttggaaaagtttgagaatagcattaatctgtctttagatatttggtagcaatcaccagtaaaagcatcaagtcctgaacttttaagtttattattattattattggtgatttaatctctgtactagttattaatttgttcaggtttattctttcttcaggacatacatgtctaagaatttatccatttcttctacgttactcaatttattgacataattggtcatgataatctcttatgaccctttgtattttggtagtattgactaatttctcctgctttacttatagttttatttgagtcatctctcttagttttcttggtttgtctacctaaaggtttgccaattttcctcacgtttttacagaaccaactcctcgtgttactgatcttttcttttgtctttcttatctgtttaattctgctctaacctttataactttcttctttcttctaacttttggcttttttcttcttttctaattcccagagtgccaagttaggttgcttatttgggatcatttctctctctgtctcagtagctatcagaactacttttgctgtaccccatgatttggtatgttatttgtccatttttgtttgtctcaggatatttttaaattgtctttatttttgggtccatttgttgtttatgagtgttgagagtggggtattataatcccctactattatcatattgctgtttatttcttttttgtgttctgctcatgtctgctccatccattttggtgttccaatgtttcctgggcctatattgaggcaccctaactaataacactttgcacatcaattcatctcatttctcacaaaagcaaacagaacaaaactgttcaaacatacataagggagtcctagttgctgatacaaacttttagatagtcttccaatctttttatcctactttaattctccaatgatataataaacatccaagacaaaaaaaatgaaaaaagcacaaatgattccttcactgaaatcaggagacaaaggcaatccatcaactataaattacacgtaaggaaggggaagaaagtcacggacactcatcagaattggtacagaaactccatattggaagcaggaagtccggcagagaagagacccagtcaaggtcactggtggtggtaatgataaaaaataccaggaaatattattccccaagaaggagagggtcctctcacaagtgtaaactgctatacccaagcctgatgaacacggagccaggtagcaatctgaggattattgaagagatagatgcagggagtatacctgggaaagaagtggtggagataacaggacaatcttgcctaaactaagggggtcaccatcccaggcataaccacgaataggaaggtggtagaaatgaacatggagaagacagcaggaatgcatacaatgaagctgtagggcttgagaaacaagaatattccccaatgcctgcaagccctatgcaatccacctggtaacaactggaaaggcaaatcaaattctgaaaaatgaaattagaaaatgcaacgtctttccaaaaatactatagaaaaaaaataaatctaccccaaaattattgccttaaatcggagctaaatactgatataaacttcaaatactctacaaccccaaatccttaataaagcagttttataaatgagaaaacattttaaaacagaaatatgacggttcagagaactgatgacccactaaaaagagacgacaatcggccaacagaaagatgtgaaatgggaatcaccctgagtcaggagagaatttaaagggagtgatggggacgaagctgaatggctgctccgtggcttgtgagtgattgtaaaataataaagatgatggagaaaatataaaagcaagtgtaaagaaatagtgataagcactagtgtaaacatattggctacaattgaatgatgaaggaaaggagaatagacatatcttctgaaatattttctgttcttccttatgctaggaaactagtagatactgtgtaaagagagggaaattaaggatattttagtcttataaaatatgttttatgcataggtatttgtacataatatacacattttgttaaatagaaaatattaaataccacacaatgaaataattttgaaataaaggcaaagagttgattttgtcttcttactgcaaagaattataagtatgtgaggtgatgcatatgttaattacctcaatttacccattccacacaatatacatattttaaaatatcacattgtacatgataaatatatacaattttatttgttcatcacaaaaatttaaaaatggcaattaaaataaaggtaataacaaagtgtgagggaatatgattaaactaatggggtatatcaataaacacaatgcatttaatacactgaataaagaaaaaaagattactattctctctgcctggtggtctcttttccgatacgttgtgacccatttcttcaactgatttaggtctctcttctctgctctcttgattatcagagaagacatctctgagcagtgaatataaaacagtaattatctcctacacaccctattttactcttctttataatgtttatcattcctgatagtttttttgcgattattatctcttctctaccatagaatgtaagatccaggagataaagcattttaccatttttatcactagtgtctttccaatgcctaaaatatagcacctattccaaaacagacgctcaaaaataagtgtttcttgagtcaatgcatttattcatttttgaggaggagagattgggttaaacaagagggttaaaaactcagaatagaatgacaaccaaacgagagcatagtcagtattaatacagaaaatatttacaagacctacttgaaagaagatatagttgtaacacattttccatgattgttcagaaatttatatttctgggtacattaacttcttaggcaactagagcttacttgtttaattctttaagcttaataaattttaaagtatggagtacaatatgccaagtgaaacaagtcaggcacagaaagaaaaatgcagcatgagctcatttatgtgtaaaataaatggaaattgagtaagataaatagggagttgaagggcagttgccagagtcagggaagtagacaaattgggataatgtaggtaaaagaagacaaaattacagttatgtaacataaagatatttagagatctaatgtacaacagaaggactatagttctattttattatacattacaaatttgctaagagaataactagattatatgtgtttttatcacaaaaaagtaaactgcagacagtgatggatgtgttaatttgctagcatgtggtaattatttcactatagatatctacatcaaaacatgttgtacatcttgagtttatacaataaaaaaaaatactcgatttaatgaccaatctggacttatttattttaatgtttatttaaaatatttcatgctgtctgtggcctggtatttgggagaaagggggataaaatacttcaatcaatcatgtcaacacaatttttgatgagaaattgaaaactgaattgttcaaattgttccagttctcaagaggaatgcttccagattttacttgtttagtatgatggtggctgtgggtgtgtcatagatggctcttatttttttgagataagttcatttggtgcccagtatattgagggtttttaacaagaaaggatgctgaatgttatgaaaaatcattttgcttctattgagatgatcatgtggtttttgtatttaattatgtttatgtggtgaatcacatttactgatttgcacttgttgaaccaaccttgcatcccagaaataaagcctacttgatcgtggtgaattcactttttgatgtgctgctggatttggtttgctggtatttcgtggaggattgtgtgtctatattcctcaggaatgttggcccgaactttacttttttttgtcgtatttgtgcctaattttggtatcagaatgatgctggcttcacagaatgacttagagagtattcccttctcaatttttaaaataatttcagaagattttgtaccaactcttatttatatgtctggtaggagttggttgttaatccatctggtccagggcttgttttggttggtaggttttttttaatcactgacttaatttcagaacccattattggtctgttcaggatttcaatttcttcctggcttaatgtcaggaggttaaataatcttgggtggagaaatagataaattccttgtttcgagggatttatatatttcttctaggttttctagtttgtctgcagagaggtgttcataatagtcccttagggttttttgtacttctatgtagttggttgtatttcaactttgtcattcctgaatttattaagcatatgaaaataataaactataaaggaataaagaaaatagatttagaagaaaagaaagtgttcaaggaaattaaaaagcatattgaatcataattttatactttaaattgttttatctgtgaatataacattttatcatatactatacatgaagataaacagatacttcgtgcagttggtaaccgaaagatagccagagtggctatgttaatgtgagacaaagtgagtttatgacaaaaatttttataagtaaaaaaaaaatcgtatactgtttgggatcatttgtgtatcttccttggagaatgtaatatagatctttagatataaaaattgtaaacatgaatgaatgtaacagagacccaaaatatatgaagccaaggtggacagaattaaaggaagaaataaacagttctgtacttatagttcaatacttaaatgtccattttcaataatgcatagtgcacttagacagaatgttaatatagtagtaagtgactagaacagcactataaaccaaatgacctaatatatatgtggagaatactgaaatagcagagtatagatgcttctcaagtactaataacacattctccaggataaattgccaaaaacaaataagactaaattttaaaagatttaattcaaagtatcttttccaatcaatgaaataaaactggaaatctgaaatagagggagaactacaaaagttacacatatgtggggattaaacaccacactgtgaagcaccggtgggtcaaaaaagaaattggaaatgaagttagaaaatatattcagatgacttaaaacataacaaaacatataggatgcagctaaagcaactcttagaaggaaaattttagctagattgcctatactcaaaaaaagaagaaacatctaaaaacaataatatatttttacaccttaaggaactagaaaaagaagagcagactcaatacaaagcaaacagaaggaaaaaaaagtattggaatagagattaataaaatgcagaatagaaaaaacaatttgactatttcgagctttcaaaagatcaacaaaatatagaaaactttaggtaaacttaccaaagagagaaagagagaagtcttacatcatgaatacataaatatgaatataacatgggtacataacaactagcctttcagaaacacaagcaattataagagaatattacaaataattgaatactaactagataccttcagtgagatgaaaaccaaatcctggaaacacagaaactaccaacacttactcaagaagaaacttaaagtagtgttaaacaactaacacactgaaaattacaaagtactgctaatagcaaataaaacataaaccgatgaaacaacatcgcatgttaatggattgggagacttgtggttaagataatacaaccaaaatatatccacaggttcaatacaatgcctataaaaattccatggctttttttttttgcaagagtagaaaacactaaaaatcatatgaaattacgagcgactgcaaaatccaaaacaaccttgaatagaaaaacaaagttggaagatttacacttcctgagtacaaaatttgccaaaaagatacactaattttaaaagcctgataacagaataaggatatatgcataaataaatagaagacaattgagaatctaatgagaaatacacgcatgtgtctatggtcaataatcatctgacaagcatgccacgtccattcaatgggaaaagaatactcactttaacaaattgtgctcagacaagaagatatccacaaacaaaagaatgaagtggcattacaaatcatacttaaactcaaattgatcagggacctaaacataagaagtaaaattataaaaatatgagaaaagataaggttaaatattcaagaccttaagtttagcattttttttagcatgataccgaaagaacgagcaataagaaaataaataattggacctcatctaacttcaaaatttttgtgcttcaaaggtctcaatcaaaaaagtgaaaagagaggagagtgggaaagctggcagaacggaattctttaacaattgtatccccatagaaacatcaattttaataactattcttacacaacataccttcacaaaagctagtaaaggcatgtgagagatcatagaacctggtgatacaattttcatcttgttataaaataataagattagaagcattgaagagggcaggaaggagagttttgattacctgcattttttatccccaacctcagacagcacagtgcagggagaaataccaaacacttggagaataaaaacggaagtaagtgtgggacttggtcttggtgcccaacactaggcccaccacagaagaactgaaaaccaggcagcccccacaaccactgactccaggccagtacacaaagaccgagcctccagatctacaccaacactaggcagaaacctgcagcccatgcaaagcagaattaatttgcagtcatcatcactgccacccacccagagtggccttaagctctggaaagtatccactggcaggcaggcctcagtgaacatgggcttcagacttgcatcagtgctgcaccagccccagtggccacaggatatcatctgggacccacaccagttccagtggccatgggattacagcactgcactgcaccagtcgtggcagtcccaggcttagggcaccacctagggctgcccccaccacagcaaactagagcttagggaccacaccagacaacctgctcagaatctctagacaggcttactattgaagaatgtttcaggataaaacaagtctgcaaagactggaataagtacctattatattagatgcatgactgcagacgcaagagaaatcaaggaagcatacatcaccaagcaaacaaatggagatgcataaactacctgacaaagcatttgaaataacagtcttagggaagctcagcaaacttcaagaaaatacacagaaactattcaaacaaacgataaaaataatatgaccacaatgataaacttagcaaatattggaataacttaaaaatcaaacaaattctaaagctgcaaaatataatgaacaaaatgtaaactgcagttgagaccatcaacagcagaatggatcaagccaatgaatctgtgaactcaaatacaggttatatgaaaatagagaagagaaaagaatgaaaaataataaaggaaacatgagatttactggacagcaacaaaacagcaaatttttgagtcattggagataagggagttgaaatgataaaggagtagaaagcttatatgaagaaataatagaaaacttttcaaacctggaaaaagatataaataaccaggtacagtgaggtaaaaagtaaccaatcagattcaatccaaacaaaactacccctaagacatattataatcaaaccaccaaaaattgaagggaagcttctctgtattggtggaaggtaggtagggcttttctagcccctacttccactctatcccctgagttccacctgcactgactcaaggaagagtaagcatctagagctagtgagaatgggaggaacttacaaagtcaagagagaagcctattgttccttgctcacccacagattacgtactattactcaaggcttgctgtatttattatagaagagaaaatcttcttgtattatatatcagctgagttattgcttatctgagaatcaccagaagtttccacccgagacaggataagagaatagaaccaacatgttgggatttccagagcaatcaagagaaaagaaaatctattgtgttattattgcccctgagaaatcacacttttgtctttcctaggaagctgatgcttacaacaatggagattagcaatacctggacagagttgagcttcaaaggatactgagaaatagctaaagcaggtaaaaagagagaagactggaactttgtctatgcttatcatctagcttcaaggagaaacacagttgagttcagccattttgaaacaatggttagaaactagataaaaagttcttaagcttttcattatttatttatttatttatttatttttgagacagagtcttgctctgtgtcccaggctgcagtgcagtggtgagatctctgctcactgcaacctccgcctcccgggctcaagtgattctcccacatcagcctcccaagtagctggggttgcaggtacctaccaccgtgcctggctaagttttctatttttagtagagaaagggcttcatgatgttggccaggctggtttcaaactcctgaccttaaatgatctgccagcctagacctctcaaagtgctgggattacaggcatgagcccccgcacccagcccttaagctttttatgagcaaattaatatttcaaattaaattgaaccaaatggttttctcatacgatggagcaacattcctcatgctggaaaatgagatgctcctgaagtctttgcatcttggtcctctaccgttgttttccacattgatatttatgtgttctgtttagagacttgatgtgttcccagaactttctgaagagccccaccacatccttgtttctcaggatgtagatgagggggtttagcatgggggtgagtacagtgcaaaatacagacacagcttgtttctgctcagggatgtgggagaaaccctgtgtcacgtatattaaacacacagttcctaagtaaagaccacggaaagatgggaggagcagttggccaaagctttgttcctactttagggggatttcatatggaggactgtaaggaagatgaggtatgagaggccacaagtccaagatgaaatggataagaagtagagagccacaggccaagatcaaatgggtaaaaagtagagagcctgcatttgaaccaggtagtctgactcagggtccacacatcatctcaatcatggatgactaccacagacagcttgttcctttctcatccccatattctggcttctctcttgccatgtacacctccccttagtctccatacctggggccacctgcccccacaatcctgttcccataatatctcaccttgaatgaagagctaagccaggaaggaagcatctgaaatagtgttgaagaaaagctgaagtgagtggagaaggacatcactttgtgtcctttactttctgttggccaatgcctgtctcccggtctagaccctaccacctacaggtgaggcctcaagcacagctcatctctggactgtctccatgtagaaccaatgtccctgctcagattagatatatgaaatcccctagttgtagatgtgggggcctatggaaatgaacctctcataaactgctgaagggtacaaattaacacagcttgagagaagtggcctggagtgagcttcacttcacactaggccaggaccacattattactcccaacaaaatagtttgtttataatccttttcgtggactccagaagaggaagatggcagataggaggcaggactaacgtgcagctcccacttggatggacagagcagcatgtggagattcacgctgtgaacttttgctccaagaactaccataggacataccaggaaagccaagagaatccaaagaccctttgaaggaggtggcggccactgtaggctccgtgccaaaaactgagtgccaaaatgtgtgaaagtgtaaaagggggatgctccacccccaaacacagatcctcactggggaacctgacggtccacatggtgggaaaaggatttaatcttacgcggagctaagaggaatttagagagccaagcaaaatattcgagtagaggaaacaacaagaagagccctgtgggaaaccatttcggactttgtcttgcaggggtcctttgggagggctgccagtggaattggggaaagactacaaggagaagcaagctttcagatgaattttgtaataatcttgactaacgtgaagcttcctggacagaacctgggggagggggcaaactgggagtgcagatacaagctcagaagctgaggcaggcagagaggcatgaaacctaaaagccctgcttgctttcttcatgaggggcttgtagcctggggcaagttctcagccctgctcaccagctgcctggaaaaaactcagtgctactgggggcacaaggtgggagtgagactggccttttgggctgcctgggagctgagtgaagcatgtaactgcccgttcccccccttctctggtgacctgcatgacccagcagaggcactcataatccccgtggaaacataactccatcagtctgaggaccacaccccaatcccacacagcagccacacagcaagccccgcccaaggagagtctcagctcagacacgcctaacactgcccccacctcttggcctttctctacccaccctgggagccaaagacaaaggacataatctcatgggagctctgaggcccggcccattgcctgagaaatctggatacttatccaggtaaccctaaggcaagctcgtatcttccctacactactgcagctgatgcaactcttgaaagaatcaactgctggctggagaccaaccagcaaacttatcaaaaatacagccaaggaccctcacagagtccacttcactcccctgctccctccaccacagcatgtgctggtatccatggctgagagacctgaagacagatcataccacaagactctttgcagacactctccggtaccagccagtaccagagcacagtagcttcgctgggtggttagatgtggaagagaaataacaatctctgcactttgtttctcaggaacccccatccctagaagaaggggtagagcaccacatcaagggagcaccccatgggacaaaagaatctcaacagcagccctttagccccagaacttccctctcacatagtctacccaaatgagaaaaatccaggaaaaccattctgaaaatatgacaaaacaagattttctgacacccccaaaagatcacactagctcaccagcaatggattcaaacaaaggagaaatttctgaattgccagaaaaagaattaagaaggtcaattattaagctactcaacaaagtaccagagaaaggtgaataccaacttaaatttaaaaatgtgttacaggacatgaatggaaaaatctccggagaaacagatagcataaataaaaaacaatcacaactgctggaaatcaagaacacactagaaaaatgcaaaatacactggaaaatctcagaaatagaatcaaacaagtagaagaaacaagttcagagcttgaagacaaggctattgaactaaccgaatccagcaaagacaattaaaaaacacacctttaactgtgttttcttatacttcgggctttttgtaggttaatgacttttcttaattcctaagtaccatctgagtaattagtcacatggttataaagaatatcaaatgtcagactaaattcttttcaagcttccctcagcagcttaaagttgaaaccttttcattccttcttctataatcttgggtatttgaaatgggtattctcccacttgaacataggcaaaatctaatttcttgtctctaccctatggaatctcatttagtaattatttctaaacttatcctgatgccatgcatcattggtttgttataaatatatctaaaggagtacacaacatttactaaagaaacacattccccgtgtgatgtgtcctgataagaaaaatgacctccaaatttacattcctgtacaggtatgatgatttcactctaccatactttattttatacccatctattgtttcttccacaaatatacataactggagtcatagccaaaacttgtattgcctgggcctatttgagcataaacagcaggtattagccctaaatagggggtcttctgccaacttgggtgtgttaggaaacatggacaatattcaaaatggcctgcaggactccagtttcaaagtgaaagataccatgcccatccaagacattgcagtttgcctttccctgatgattagtgatgttgagcactttgtcatatacgtgctagccatttgtatgtcttcttttgaaatatgtttttcgatgtcttttgcccatttttaaaatcaaattatttgtgagataattttggtactcagttacttgagttctttatatattctggatatgaaccccttgtcaaatgcattgttggcaaatcttttctcccactcgtatgttatctattcactctgtgaattgttttcgttattgtgcagaacctttcagtatgatgtaatctcattttttaattttttattttttccctgtgattttgaggttctactttaaaaattcttgcccagatcaatgtagtgatgatgcattctgcctgtgttttctaccagaagttttacagtttaagatctgatattaaagtctttaatccaatttgagtttaaaatagtgaaataagtgtctagtttcattctgtatttggatatgcattttttgcatcaccatttattgaggaagtagtgcttttcttggtgtatgttcttttcaacttggtcaaacatcagttgactataaatgagtgaatttatatctgggctctcaggggttctcttctgtttgtgtgtctgcttttatgccagtaccattctcttttgatgtttaatagcttgtagtatatcgggtagtatgatgcctacatattcattcattttgctcagaattgcattggctatttggagtcttttttgcttccatatgaactttaggattgtttttttctatctctgaagaatatcttttgtattcggatagtgattgctttaattctgtagctctcttttggtagatggacattttaatgatatcaattcttctaatccacgaacatggggaatctttccatttatttgtgatctcttcaatttctttcattagagttgtatagtttttcttgaagagatcttttactttggctaaatttattcctagttattttgtatttactttagtttttgtaaatgggattgccttatttctctttcagattgctcactgttggcctatataaatgctaattttgtatgttgattttgtatcttgcaaatttactgaattcatttatcagttctcacagtttttgctggtgtcgttaggatttttttaatatatgaccatgtcatctgtaaacagggaaaatttcagttccttctttccaatttggaggcctttgtttccttcttttacctaattgctctaagaccagacacagcttctcttttttctctcctgaattcatgggaattcaggatgttattgtttttgaatagtttccagttctatttttgtgggtgtggatgaatgatgctggaggatcttctattcatctatcttgttgctataactcctctctatgagtctttcttaactttttaaagatacagtttgctgttagagtatagaaactccaatttctgtctgttgatttcctgaaactttcctgaatttgttagggaatagtttttgttgaaggctttatgtttttttatatgtaatattactttattaacaaacagaaacatgtcacttcttcctttcctatttacatttctatttatttttcttccctaattgctttagctgggactttcagtgctatgttacataaaagtggcaagagtgaccgttctggtcttttgctggatcttagagaaaaagctttcaacatttcatcattaagtattatgtcagctgtaggcttatcatatatggcctttgttatggtgagatacattccttgtatacctaatttgttgagagttttggaattttgtcaaatgcttctctccacctaaataatcataaaattgtatcattcattctgttaatgtgctatgtgatgtttattaattggcatctgttgaagcatccttgcatccctgggatgaatcccattttatcatgatgaatgctttttgaaatgtgcttttaaattcagtttgctagcattttttgaggaattttacatccatgttcccaaatgatattgacctgtagttcctttttcattcccatgtccttctctggctttggtattaggataattctggccttgtataatgaatttggaagtattcccacttcttcaattttttggaagtgtttgagaataattggtattagttctttaaatttttgatagaattttgcaatgagtccatattgtcctgggcttttttttttttctggtgggagacttttattactacttcactgcattattcattattggtttgctaagatttactatcgtaggatttatgtatcagtcaattcatgtcttccagcttatctaatttttgacatgcaattattcattatactttcataatcttttgtatttctgtggcctcagttgtaatatttcctttgtaaatttctgatttgaaccttcttagtctagtttattttgttttttcacaaaacaactcatctgatgttttgcattgtttttatcatttttttatttctcctctaatcaatattaatgtatctactaattttgagtttagcttattcttgtttttctagttaattaaggtacaatattacctttccttatttgaagtctttcttctttattgatgtagccattcattgctataaactataaacttcctctttgaactgcttttgctgtgtcctgtaggttttggtatgttgagttttccatttttatttgtctcaaacaaccttttattttcccttttaattttttcattgacccatctattgtttaggagcatattatttaatcaccatttatttgtaaactttctgagaattcttgcattcgtttataaactgctgtgatcagaaaagatgattgatattattttgaacttcttatctttaagacttttttgtggtcaaacatgtgatctaacctagaaaatgtttcatgtgcaatcgagtataatgtgtattctgcagctactgaataaaatgttttgcatatgctttttaggtccattgccctagagtgcaacttgaagctgttatttcattgtttacctcctgtctggatagtctttccatggctgaaagaggggtgttgaagtttcttagtattattttattgctatctatccccttagatctattaatactttattgtatttaggttaatgtttcatacatagtcacaattattatatactttttgttgaattgactttttaatcattatatatgatcttctttgtctctttctacagttctggacttcagtctattttatctgatataagcatagctactcctgctcttttctggttacgacttgcatgggatatccttttcaaccacttcacttcgtctgcatatgtccttgcaggttaaagtaacctgttgtagttggcattttttatacattctgccaccagatatcttttgattggataatttaatacatttacatttaagataatttttgatacatagggacttaatgctacaattttgttagttttccagttgttttctagagactttgttcttttcttccattcttactatcttcttttaaggttaaatgatgttttttctagtggtatgcattgattccttgttttttaaaaatttttgtatgtctactacaggtttttgctttgtagttaccacgagacttaccaacatattataacaggttattttaggcagctaacaatttttagcacaataaagctctacaaaaatcatttttcatgaaattttgctacatttcctttcacaaggatgttttaaagataaccatcaaatgtgtctataattataatccagcaaattgagagttgacaaatgctctttaattcatacaaagttagagtatgcattttatattgtctgagttcaggaaaaatattaaaaactagttctctcatatttttccaaagcactacagaatctttatattatagtcataaaataattgagtgtggtgagagaaaagaagaatgtgtactgttgaaaacacctgattattcgcaagttgtacatagccaattaggaagttatagcatgcagctaccacatgtatgcttttaggtaacaggttcagcaggccccacctcaaatgccctcctatcagcctattctcgggtaaaggcatggtcgactccacttagatcaacatcatttagatcaccattctcatgtacctggtctctatgtttttggtcttgcacatctccaattgatcaccacacaaataacatttctaaaatacaaatctgatcatttcactattgtttgtaaaaccctgggccacacaagggcaagaaataagcctaacatgaaataagaaagatctactgggcattgatctctctcgcttgctcagccctgtctttgctcatgctgtgccttttcccttgcagcgtgtctcagcaagttcccctggctccaacatcacacactcatctgagggtaacttttcgtcactattcagcactgagccccggagtctcctctcagctccttgtttgaactcagatgtcacagatagaattagtgtgtccttatgagctgcacccttcacacgagtatcaaaacagcttatttattttcttacatttgtttgcataaacaactacatgtatttttcaaactccttggtaaaagccatgtgctattcaaaatttaatcttatttaactatttttaattataaaatagtacaaaatgcttgttaaataaatgaaggattgaatgttgatgccatccctctgcttgtttgtataacaagttacatgtttgaaatctcagctcaggaatcaccctgggcaggtaaccttccttaaaactccttccactcaggtgtcatattttttctgcagtcacttatgtggtcctacatcctcaatacaccacatggcagtaattatttcggagagataaatccactagacgccatcagaattggaccatgcagaaaaatgtagccctcaataaagaaggggcgatgactggattttctcggtaatgattagatataatgaaatgagcatgatttctaagatgtcacactgccaccaagcagaaaggagaatattttcaaaaagggagaaaagcctggtatttaattatttgtaaatgatttcaacttcacaaaaatcattaaaaaacaatagtacaattaatacctatataccctttacccatactcatgtgtggcagcaacattgaactcagtttgtttcattgcccctctctatctccctccctctttccctctcatcatttgaacacctcatgacctttttgtctctaaatattaagtatttcctgaggttaagaatattttttcacaaaattagagaacagttatcaacttccaaaaatgttacattagtataacacaattgtaaaagaattttggatggacaaagactataaaatagagtttccacacagtgaaagaattcctcaaaatgagatgaatatgagatgaggcatcattgtatgagagtctaaggaataacagggataaaatcctaagtatctgatgggtagagaaaaggaaaataaatctttatatccaaatttcctactttataatttcctaaaggacgaatctcacagttaacattttcttcagagcccccatgacatccttattcctaagactatagattaaagggttcagcaccggagtgaggatggtatagaagacagataccatcatgtccttctcaggggtgtggtaggagctggggagcatgtaggtgtagacggcagccccatagaagaggatgaccacagtcaggtgggaggagcaggtggcaaaggcctttttccggccctctgctgagttcatcctgtggacggtgaggaggatgagtaaataggagcttgaaatgatcgtcacagggatgaggagcatgaggacacagcataggtacatgagggtctcatagagtgaggtgtctgagcaggacaggatcgttacagcagggacttcacagaagaaatgatgaatctcccaggatctgcagaaggggaagctcatggtgatgggagtgagcatgaagccatccactgagcccaggaaccagcagcccgatgccaggaaaagacagaccctatggttcatgaggacagggtaacggagaggatggcagatggccacgtagcggtcataggccatggtggctagaaggaaaaattccgaacctgctagtgtcagatagaggaacatctgcatcccacactcaggggctgagaccttattcacacccatgacctggtccaggagcatcttgggcacagtgacagaaatgtacgccatgtccatgagagacaattgactgatgaaaaagtacatggggctgtggaggtgggcgtcacagtgtatcagaaggatcaggacagcatttccagacaacgccttcaggaaaaccacaaagatgaccacactaagtagagctggatgtttggattgtctgaagagtcccatgaggatgaaatccaaccttccagtgtggttggccatcctggtgatgttggccatgaggtttcacctaggccaccaaggagagttttggagtcagtgtaacgcgtccctttgtaatgagtgtttagtgagtactcacatttgtgtatgctcattgtgctaacctgagtcccgtgggtctggggatttgagtatataaatgacatataacaaattcacaaaacaaactaagaattcacaactataggccagaagaattggtaactgatagtaaggttgtcacggttcaaattcataaactttcctgatgataatgccatttatcaacaagtactgaaaatttgcagaacctccctcctctgctaacacaaacagtgactcattgaaagaaagataaagcaaactccttattgtagagtttttgtcatagacagctgaattgaatcaacatcgctggtttaagaaacaataggcatcttcaaaatactcagaggtatatatgatataagaaagatttagcaagtaactaaagcgtaacttggaaaaaaaattatgccagatgtttgaacctcctcctcccataggatcaggccatgctgtgaggctctgtgattgcgtggagcgagcctcacattctcatgagcagggaagggtcctcacacacagctgaccctttagacatcgagagacgtgaagtgaggagcccacacacagtagactccagctatgggtccacctttttctctgtctgccattcctttctccaatctacatcaaaaaggataaaaatcatgtttgagctcaggtgtggtgagggtaaaatgaggaaatgtaatgaaagtgcttagaatagtacagtttccgatgaataaacacatatactcttagtgtagatgttaactctttaagctaactattctgcacaacctacctaagagattgttgctactattattatataagatatattacttccattctccagattcagtacctattcatacatttaagaagctgactttcaaaataaaaatggcagaagttctgcaaaataaagcatatgacccactttaaaaaaaaacaatttggattttatatttgtgtgtttatgtgtaaatactctggttttatataaatatatataatatatttatgtaaacatacacaggtgaatatataactataacatttcttattttaaccctggttatgcagagctttttggagactcctatgtccttcctgcctagtatgtggtcctccaacctcatctccttaaagctcctctcattttaaagctcattaaatctcagcgaggaagaactagaatttggagggtcactgctgtttatcagacaaggctttagttgtttttgcaaacctcatgtgctttattacttgccacaatcaatctttcatacaaactgagaagcagggaggaaaatcaaacaacactgaggcatctgacttcaactcactgtttctccctctaccgtgacactcacagcctgtgttatactgacgatgaatcgcctctgacttcaactcactgtttccttctctatcatgatactcacagcctctgtgttatatgcagaagatgaatcaaagaaaaattgaacttgagtgcacttaaggaggtcacagtcagtctattcagggaacaactattatgtaaatgtgatttgaagttgaatttttaaatagttacaaaataaataagggcaatagacacaaaatatatctggccgttctgaaataatccataatagctgtttccacattttctctgaaagaaattaaaactttccaacttttcaacttctgacatattaaatgttaaattttgagagcccttgccaagaataaggacataataactcctctttctgggaagactttagctgtgattatgatgcagggacattttggaatgaatttacaagtttcaaatatattttgtattcttgtagtaattacaaaaagtatttaagacattcaactcaccaaaacttccaacattctgggatgcttcggtgctttaatataaatatccaacaaatctgagacacattttatgtacatatgtatatatatgaatagatgatgatgatagatagatagatagataatgtgtatcaaacactacccctactggcaaatggtggctgagatctgtgtacaatttaaaaacattccaataaactgcaaaacacacctgctgacctcgtccattatttgtggccaaagtgaagcaaggaccagaggagcgaccagcacatgtgaagacctaaaaggtgtttgctcagtaaattgagggggagcaggagggcagggagatgcggggtttcctaagaaatctctgctgctctttaggaaatggccatcactatcattaagccactatcattaagccactatcaacagctcaaccaggacacgggacagataagggaacactatccacacacagtgaactggccccctgttcattcttcttctgtacccgcttgtttgactttcatgtaaattgcttaatgcatgtttaacttggggatttattataagtataaatggagtcaaacctttatttgaagcatacagcatcccaggaattgttctaatactaatactaaaattaatactttacatttcttctttcccaagagcctatgagttacttcctattattttctctctttacatattaaaaaatgcaggttctcagggtacctgcctaatatcacacacctaacctgagatagaacgcacgtctcagcccgagagtgagagccagcgcacgtaactctgcctgattcctctcagggacaccatcctccctctgcagtctacactttggatttaggccactgtctgtgggtttcatcaaggaaacataaaatgattgagacattgtttctagtgttttgtaaccctcagaaataatcccctctcaaaagaaaatcagtcacttttcctctataaaacttcagtgacaggaaaataaatacatcattgtatgaaaatctaaaactatagaatatatattattatgtccataaataattggaaattaaaaatccatttaccattatgtcacagtaaataagtgttgtatagaagttataagaaagaataacatttgcttttctccattaaaaacagatgataaagaaaaaatgaggaaatgctgtgaagaactaatagaacgtttcagaagcagaacaagtcgagagcagtgatgacccttttgttcctgctagtacctcctgtctgtctggccgaactcaccatcagatgatgtcttgaacctcacctagatgggctggtggtgtgtggccaggttaagagcaccaacaggagtaagaaagtgacctgcctggttttaccgtgtgtactaggggaggggttgaaagctttcggttgatacatcacctctgggagttgaagaagaatgcaattaagagagctaaagaagtcagtaggtatctctcctgaacaattctggttttcttctaatagcttttacaatttttacctctgttatgaaatgcaaacttttaaccaatattagtaatagtaatctcaaatctcatcatcatcaaaatcttatttatgaaatataggagttagttcatatacagccttagccttttccacattataaaatatattccatatatatgtgtgatcttcatttaatattcaagtaaatgttgtaagatattgttatttttattctaacatttcacaggtatagaatctgaaactcagaggtcaactgatgtgtcaaagatacctccacaaatcagtaccttgattaaaactaaaattggagtcatcttcatatctccatctttctccctcttcattaggaccgattgtagtctgtttccctctcactcacttgcaatctttattgctttagtgttgcatttgatttttatctttgtttttgttttaaatactgtcattaaagtcatagaaaaatctaaaataaaactggttgaataaaaattttaaaatcgactctaatgtaataaaccagacaaaaatgatactttaaatgttatatcttccctttaaactacaaatattcattgagtgtataccctgtattaggctgttggaataaaacagggaagaagacagaagaaactgcaccgccatcttagatcttgcagccaaattcctctgaacttttctctaaagacgtgctctggaaaaatgttgatcattttcctacatcatggaggtcttttcatgaccacctttgtctagacaatgtcctgtttttaggtgcacgtttgagggctggagtctctgacccacagtgctgcagcctgcacgtggtttgtcctgacttctttgctacttcacttttcgtaaggctctgagagtgcaggcccttgtgggtggacactgcagggtgagaggaagaagtaaactacttttttccgtttctgatgggggtgtgggtcagcagctataagcaacagggaccatggggggcctcagacttcagcacctgagaggcagtttcagtcgtattggggagatgcaggcatctgggttgctgcacatcaccagggcagggttctctcagcagccctggagtgcagagttcccatcagctcagcagtgaggggcacatggggctccagtggtgaggactcttggtccttggatgacaacactcccctgcccacttctccagccttccctgtaaccctttgccacctctaaccaatcttctgtgttacatctcttcggtttgcaatatgtagtgttcgtatatgactggacagtatctactggagttaatatctatcagagtaattatatcacaattgcaatcttctcctaagagtgaatagtgacattaaaaatttcaacattataaattatgcagaaataaaactaattatacaaaaaatacactctgaatgtcagtttttccctgagacaatctaccatttgatatacggtgattcacacttcttaatatacaacattgaattacttttccaaaagcctcttcaaattttgctgcagaattaaacttcacttgcaccagctctgaattatgtgtgcttttccttcttggtcaatttcataggtgtatcattatttgtcttttttaattaatatgtttatataacttttcatgtttatccatgtaactactgcttttgtgaaacgtgtgtttttatccttttcacatttttttctattgaaatgttttctttataaatataaatgtgtttttggtatgaaaataataactggccagatgcggtggctcacacctgtaatcccagcactttgagaggccgaggtgggtggatcacctggcctcaggagttcgggaccagcctggccagcatagtgaaaccccatctctactaaaactacaaaattagctggcgtggtagcacgtgccctgtaatccaagctacttgggaggctgagacaggagactcagtcgaacctaggaggcagaagttgcagcaagccaagatcacgctattgcactccagcctgggcaaaaagagcgaaactctgtctcaaaaagaagaaaaaaaatagtaactctttgtgaatagtatcaactaaaatatttatatttcagttttcattctgatattttgtttcatcagaattttttaaagtattttgtttaatatattaactttaataatttcattaactgtctcgtgcttacaaagtctttatgcatttggggattatgtaaagcatctacctttacacttttaatgagtttcagaggttttttggtacctttgagttataatacaaaaataatttatttgggtgtgatatgcagtgaattgctaacattattgcttttaattaaagattaaattccaatgttgaatgatattttctttaatttcaaaaataattagtaactgttccaggcactatctaggtttatgatgtttgaaacaaagattcttcccacacagcatttatatactagtggtaaatacaggcaataaactaataaatatgtaatgaaatatcaagtattaataatcacagtgaataaaaaataaaggcagagagatgagataggaatgattagcgaatctatttaacacaggctagttaggagccctttatttagaaggtgaaatttcatcagatccgtaaatgaagcaatggagtcactcgtaaacaacggggcagagatgtttaagcagaggaaacagagaaagttaaaagctgtgagactgaaagtaacttgcaacgtttgaacagcagcaagaagatctgtggccccagattgaggtgagaaagttggcaaaacagaaaatggggttagaaatggagccaagaacaggtcgtataatatcatgatggtcctgggaaggaccagggacaggcagaggtgtgtttaagaaagggaagacaaaagtatacacggcactcaagagagtgcatgtgcacttagaaaaagaaaggaagtctcagccaatgtttggcccctgtcttctaagaactcttcaggaagtttaccaggcatgctcacagtctgttctgactgtagcctggcttcccctccccaccccaccccaccatacaactcccagcaacagacagcactcagagaatctccagagagtgaagggccccaaagctttgactctccttgcttcttggttaatcccactctgagatatcactggaggacggacagagaggaaagacatttggaacaggtatatgattatcactgagaaggcttgagcgagaatgcaggaaagggtttgagctagtcctgatgagacatatggtgtctgggcaaggggtgtggtggaggaggagaagttggattgccgtttatacacacaggaatattggggctgggcaggttggcatggaacgctgaaactgaaatttgggactccagttgcccagtacacatctacatgaagatgatgcaaggctagtgtatacacgaatccagagttcataagagaaggcagtcctaaaatcatggttttgagaaccagtgtgtgtggaggaaacaacgggatcgcacaaggaaggagggtcaacatcttataccagaagccagtgcaggggaggctaagtttccacattatctcttcttttccattggtctttcactgaattcctttaaaatatcttgttttattgggtgtcccctcatgataattttaaacaactagtgaaacaattcttgtcttcatgtatgttcatgttcaaaataagcaagtttttgtttttcctttcagttgatctatttggctaggttcaaaagatctaactaattgtattgattagaatacaatgaaatacatttgggaagaattgatattgttaaaatgttgcagatttttataaacaagcacaataggtctcacagagatatccaaatacttagaggtcgggtctggattttgaagtaattttaataaaattcttccacaataattgagattctgagatatttttataatttaattttttggagaatatttttcatttaaaaatacttaaaaagcattaacagtgacagaaaagctattgatatatattttttcaacattaatatttatggtggaaaccctgcttaaagttctactttttttttacattttaaatgtaaactgagaaaatatttataaaaacaaaaataacattttaagaattaaactataaatatataaaacatgtcaaacattttgtaaatgatcctgaaggcaccatcagagatataaagaaatgcaagatacatgcacagaacaaaggaagaggggccaccacctttatggactggaggtcaggatatcaagccaaagaggacctcaagtcctgaaatctaacgaaacttgccctgccaggcttcaagtttgctttggctctaagacttctatttaacttccaatttctctttttcagaataggaatgtctatcctatatgtgagtgtcactgttgcattttgacagcagataacttgctgtctggtttcacaggttttaaattaacttattgagtaaaatctaagttgaataatgtgctagagaaatattcttaatacaaagagattaaaaacattagcaagatgtttgaagaggagctcctataatcgtatcccctcaaagcagcaataatatagcagcctgtctggcacaaaagtcccttggtgggaacttctggatcttgacaggaagtgtcaaaactggtgaatcccaacactgaagagagctattttgagaaggcagggccacacccaggtggcaggctcactgactgtggtcctggctacagacacagaattaacatccctctggactcagctagtgccctgtttggcattggtcctgccacctgaaccatctgccaaggggcccaggggcactcacattgaccagtaccctcaagtaacaggcctgctaaccttagttctagctctgaaccctgaagcagtccatgacccagctccagtccccctcagccatggtctgggaatagaccttcctgcacagagacctgccaggaggcaaccctgttcatgtgcctagaggcaggctctcaaaactacgtccgactgccaatcttgaagcagctctgttacttggcacccttttccattgttcaaaagcagtcctgcccactcagtgacctcctgggtgacacattgatcgatgcccctgtaaacaagactgctgacatcagtcagctggagatcctgaatcagccctcttatccagctccagcttccattcaaccacagcttggggatatcttatatcttatatttacagggactatgcaggaggtacacccatccatgcaggacagaagacctcagactcagctgtggtccatgacacagccctgagactcagttccaggtcctctcaactgtggtctggggacaatccttcttgcccagagactttcccaccaatataatgggagtccttcaagggactcaatagaatccacacccatttctgtacctcgtaagaggcatgccatctacagaaccaaatgtgaaccctgaagcagagtgtcctagcgatagccctattgaccaaggtactagaggcagtcttctctaccaagagaccagacaggatttatactcaactcgacttctggtaacaagcttgccaactaaaaattctgctgtagactcaggagtagccacatgacatggctctaaccctgctcaactgcagtcctggaggtaattcttattagcctagagaaatgacaggagaatgtctttacctaccgaaaccagtctatgcagaccagaagagctgtttgcaacttcaaatgtgcacacatcaatgcatagctacttgagtcacaaaaaatcaggcaaatgtgacaccaaagtaataaataaataccaccaaagtaataaagcttcattaagcaaccccaaggaaatggaaatctatgaattgcctaagaattttaaaatcatattaaataggatcaaagagcttcaaaatagcagagatctaaaactaataaaaaaatgcataaacaaaatgagaaatataataaagacattgacatcataaaaggaaagaattcttgtgctgagaagatttgtagtcaaatttggaacactctagtactgtaatggaggtgtgtaaatctcgttaactttagtgtaaagcttgtaaaatattctgaatacaattatggaagtgagaaggtcaacagagtactttaataacatatttcatcatacagcgaaaggaagcaatgaacttgagtttagatcatacagttagaggaacaaaaaaaataaaatgcagaagcatctgggaactataagacaacatcaagcaaatatatatgtgtattatgacattcacagaaggagaagagagaaaaacagaaagctaaaatgacaacatttcctaaatttgtgagggatagggacatgcagattcataaagttcaaaggaacccaagcaagaacaaaccaaaacattatacctgagacatattatgatcagtttgtcaaaagtcaaagacaattctataatttggaaaaatatggatgagcccagaggacaatattttaaataaaataagcctggtataggacaaatattgcacaatttcatttatatgtgaagtgtccaatagtcaaacacatagaaacaaagaataaaatggtggttaccagagtttggagtgaggaaggaaaagagaagatgtgggtcaaaggatacaaaattttatttaagcaggagaaataagttcaggaggtttatggtacatcatgctgactacagtttcaacaattatgtacttgaaaattgctaagaaagtaggtataagagtactcagcacatgaaatgattacttgaacccaggaggcggaggttgcagtgagccgaggtcatgccactgcactccagcctgggcaacagagtaagactttgtcttaaaaaaaaaaaaaaaaaaaaactcccaagaaaagcctaggactagaagacttcatgatgaattcatccaagcacttaaagaactaacacatatcctcctctgattttttcaaaacattgaagggcaaaaacacttccaaattcatttactgaagccaacattacctttaaaccaaagccagataagaacactaactcccaaaatattataggtcaatattcctgacaaacagctttcataatttttggtaaaaattaacaaaatactaacaaaccaaagcagtgcattaaaaggatacttcaccttaatcaagtgggattattcctaggatgtataaaccaaaagtatgtcagacaggtctcaatcagattgaaagtttatttcaccaaggtaaaggacatgcttggaaaaaagaacacaattacagaaacagtctgtggtctgtgcttttctttaaagataattttgaggactttaatatttaaaggggaaagcaggctagaggggaaagagggagagtatgataatccacaggttgcaagaagaaaagaagcaaagaagcaggtaggtgaatagtcatttatgtattcctttcacactcagtagaaggatcatcgctttacgtcaggtaaggagaatgtggagttactgcctgttactctaacattttatcagtagttaactgattaggaacaaaaaacaaaaaccaaaggaaatgcagtttcttgcataactcagctttcagcttagtatcttttttccttttggcatagtaaattggggtcccaagtttttttcccacagatgcaaagatggttcaacatacaccaatcaataaatatgatatgccacattaacagaataaatgacaaaaacaattgtgcatctcaatagacatagaaaaagcattggataaaattcaacatcttttcatgataaaaactcagcagatttgttatagaaggaatgtgcctttacataataaatctcacagctaaatcatactcgatggagagaaacagattttccgctaagatcaggaagaagacaagagtgctcactctcactgcttctattcaacataataccggaaactagccagagcaattaggcaataaaaagaaagaaaaggctttcaaatcagaggaagttaaattatcttgccatctgtttgcagatgacatgattttacatataaaaaactctaaagactccaccaaaatcccatcagagttaaagaattcaagaaacttgcaggatacaaaataaacatatataaatgagttgtatttctatacaccaaaaaggaaccatccaaatatgtaattaagaaaagaataccattcccaataccatccaatagaataaaatacataggaataaatacagctgagggagtgaaagatctgttcactaaagaggagataaataagtgggaggatatctcatgttaatgggttagaataactaatattctttaaatgtccatattactccagaaaatgtctgattcagtataaccccaactaaaattccacaggcattttttacataaatagaataaaacaactctagaaattttgtgaatgcacaaaaatatcaaatagccaaagcaatattgataaaaagaacaaagctggaggcttgactccgatttcaaactatattacaaattatagaaataaagccatgcttatatggtcaattagtctttgatgagggtgccaaaaatgcagcatgaagaaaggatagtctgttcaataaatggcattgggaaaaccagatacatacatgcagaggaacgaaattggactcttatcctacactattcccccaaaaccaaatctaaatggatcgaagacttaaatggaagacctggacttgtaaaagtcctagatgatgacatagggaaacagctctttgacattgatcttggccgtgatatttttgatatgacacaaaaattaaggcaacaaaagcaaaataagcaagtaggactgcatcaacatgcaaaaacttttgcacagaaaaggaaacaataaaatgaaaaggtaatctctgcaatgggagaacatatctgcaaaccatattttggataaggagttagcatccaaaatataaaagaaactgacaaaatcattagcaaatatcaaattacccaacttaaaaatggtaaagacagtgtgaataggcatttttccaaagaggcaatacaaatagccaacaggtgaatgaaaagatgttcaacatcactaatcatcagggccacacaaatcaaaaccacaatgagatatcagctcacacctgctaggatggctattaccaggcaatacatagcaagtgctgtcaagtgtgtgtaggaaatggaacacttgtacatgtgcattgctggtagaaacgtaagttgcaacagcctgtgttgaaagctgtatgacagttctataaagattaaaaatagagctactctataattcagcaatcccactctgtacaccttcctgaggtaaataattatataaataatataatgacaacataagaacattgttaaattagtcatctgtggtgtccatttgagcagttttgcccatttatttaattacagcaatttctgaaaccaaattttacctacctctaacaaccccctcttacaagtgatatttctgcaccacttggtggaatttacttccaaattcagatctctgtacacaaactcagacaaactcctttcatgcactgcaggaataattttcagtgagaagcaaaagtgttcggtcgatgtgtcatgtaaagcaagtacttgtcatttctctcgaagatgcgataggcatgggaacacctggcttccattcattgtcggtaaatcaggcatggtcagggctgtgccaaggggaagtaaattaacagcttcacgatacagctcgagattcagcttcttgcatattaattagaacaaatgtatttctttcctaatttctcacgttccagaaatactacacccatgaattattttgttaatgaaaatgatagtgatctgatgctcatagatttacagaagttacgtttgtagcatgatatacatctggcaaactaaaggttagtgacaagtttataaccattttgctggttttcccagtttcagaagaaacatgccgagggggttaagctttcctaagtctccattatcgcacgcgactgttatgatatttattgtaaacatagtagaccattgtctggaatagactaaatcctaaagaaactaaatctggaactacttttatttacatactatgaaatagatgaacctattctttgaattttgaaatggattcatttttggtttaggtggttccaatggccaatgctaaaactactggtgtttacactacaaagttcacttcagcctttggagaaaatgcgtttctttgtacttactgagatacaatagcagaaacactgaccccagtggctgccaatgtgaaccgaggtttacaatgtattgcaaagggagggagcagccaatactcctcctctagggctctgctaggattctaagtctttacaatgagtctcttcgaggggtaaagtgtttaagaccaagtctcatactaaaatgctcaatgaacctgggatgggagataagataaaaggcactctataaggtctttcataggtcagctactgcagtgcagttaaaaacactctaaagatattaaatctaatgagataaatgggagcaataagcagtatggagggaaaacgccacgtataagaaagaaggaaaatatgagtgggctttgtgctggggacccggagacctgagggcaaaagagaggagagatagggagtaacggaattatagaaagaggaggggacaatgcttgtcctttactacttttcttggttcattcttgactgcatcatgctcctcagagccctggtgacatctttgttgcggagactgtaaatgagggggttcagcacaggagtgaagatggtgtaaaaggcagacaccatcatgtcctgctcagctgtgtggtaggaactccggagcatgtaggtgtagaaggaagcaccgaagagcagcagcactatgatcatgtgggaggagcaggtggccaaggccttcctgcggccggcggcagaattcatcctgtggatgagatgcaggatgagggtgtatgagctggagatgaccatgatgggggtgagaagcatgaggatgcagcacaggtacgtgagcatcttatagagggagacgtcagagcaggagagcttcagcagggcaggagtctcacagaaaaaactcaggattttcctagactggcaaaaggggaagctcatggtaatgggggtgagcaacaaaccatcaaccattcccaaaacccagcaggctgacaccaggagctggcacaccctctggttcatcagcagtgggtaatggagaggtctgcaaacagcagcatatcggtcataggccatggcagccaggaggaaaacctcagctccagccagggtcaggtggaagaacatctggatcccacagcctgacggggaaatggtatcatctccagtgacctggcccacaagcatcttgggcacagtcacgcataggtacatgagatccatgagcgcgagctggctgatgaagaagtacatgggggtgtggaggcggggctctgagtggatgaggaggatgaggagggcattcccagtgagggccatcaagaaaagaaggaaggtcacggtgtagaggagggcagcatgcttgctctcagcaaagagtcccgtgagggtgaaatcagtgcttgctgtttgattctgagaagtctgattccctgagcacatgactggctcacagtttccccctgaggaaaaaaaagtcattaattttaaatctttcctatgtacatggctttcctaacctttttctggtaagacatgtgctttgaattatttttctaaatattgagttaaactgacataaaatcataagttcaaatcttaggtcaagtcgcatgttggccacaagctaaagtgaactacgaaacagatctggggaggtgactattcctgagctaagtcaagagtgaagacaggtacactctatgtcttatttccccccagaattaagaacacaagtatactggccttgtgggatggttagagactgaagtagggaatgcacgttaggtctgtaacacagtgttagtgttgggttgagattttcactactttttggatacagtagctcatccaggactcagtgatggaaatcatggctgataaggttaatattaatattgttaatggtacaaatatcataactaataccatgaaataatctgaaaactggaaatctccttaaatttcttctaccattatatatctccatttaagtccactttcctcatgaaaacttttcaatttattctgctattcctcacaaggttgcattccataagtagtgctgactggggcagaggagcagagggagagtcccgcctgcctgaggagagtagcttggagtgcagaacgagtgccgagcaggagagcagcagtaggcacagtgagccctcttcccagtccccagtgaaatctaaggcatttaatttattaactgtcaggcagagaaatatttttacaagaaatcacagcaataaatgctgcagatgccctaaatatcaagtatttatttgaaatataaacaaaatatttattttcaaaatgccatatttatcccccaaaatcatgcctaaaatgtccaaaattccgtgcatggtgattgaaaaatgaagttaaagcacatgaggcagttgtgttgaatctttcataaaaccgcagccctgcaaccaagcctagggatcctcttgtcctgcatctcctttgcataacaaactaatcaccaccccctcccataaattcatagctttgctcagtgactgctttgtctgaatatttcagttttaattttccagttgaattgtttcaatcatgcttgatacaattgtctcaaagttaaaaagcccactaacttctagactaatgaagagtcaggagctccatgactgaggtttggtcatcctcagggttgctgtactgcaggttagagaaataatgctgaggaaaaaactaacagtgactgaggcacgtggaaatgcaaagtgaaatacaacgcactgttcctagggcaaaaaaaaaaaaaaaaaaaaaaaaaaaaacaacaacaaaaacaaaaccatacacacaaaacaagagaccaaaaaaaaaaaacaaaacctgggacttcaggaaacctaaagtcagaattacaaagagctagcaacaagagtcaggtatctttgttccttacttatcccctttataaagcactgaagaaacgggttatcaagacacctttccacaaagagacgaacattgcacatagagcacaaaccatttgctccacctcttctgctccatcagagaataaatctaagccacgccagctcagtgaagctgctttcaccattctaaggccaaagcaaaggggtttaaattcagaatgaaaatgagaaaattacatcatcagtttcttcacattagggaattgagatgagtgtttattgcttaattctttgcaccgttttcccttttttttttctgcttattcatcttccctgtacttggcattgtctcttccctggagcttctactttctttaagaccatctcagaatccattattttggtatttttgttttgttttgctatttgtttttgatagttatattctaactttccagttacagtccacgtggtaattaaacatgtttttcatttatgcgatgcgtctatccaaaagcaaatccatctttttcatgacattgcacatttttaaacaacttcatttttctagtttaaaattatattttcgtatcggacatttaaagtaagctctttgtaaaagcaaatctgaatttcacaaagggaggatcatggaaaaccagtgtcagaaatctgtaaactaaatataaaatcctaagacccctaatcaactgaacagacccccttctaggacaagagaatctcaggaaagctgaaaagcttaattgcaggacataacaagaagggagacacacttcattatacccctgtctgttggaatttaggcacaactgaccagcaataacattgaaatagagttcctaagactgacaaaacagactctgagtggcaataagataccaaattccaacctgactctagtatagcatcacatgacagatagcagaccctgaggaaaatcaaaatattccaccccaaagtatgtctttgacatattttgaaatggccctacaaagccatctttcgtggggaaaagttgcatctatagagactttccattaacacagcaggggctttcccagattcaggagaaaatatcggagtctgacaacatttaaggttctaaaagaaacatttaccatttattatatttgcttccaattaattgtgtaatcttagtcaagaccctaaaagctctgagtgtcacttcctcaatcaaataaaaggaggagtgttatgtacttgctatgcttctgtgactcttaagacatctatgaatctgatgaccgaatgtggtctaagatttctccatgacagggtgaccttctcccacatcgcccctctccttaaaggctcagagacttcccttgaaatattagtctcatcgaatttagattatataatttgggaatgaaaaagaatggaaaaagggagccacttttctcagtgcctgcaaggttccgagactttgctgagtctttctagcatgacaaacgtacaaatactgagtagtgtattcatccctgtgtacagtcatccctcactatctgtcctcagtaccaggacatcgtgaaaataccaaaatccatgatgctaaagaccctaatatgaaatggcagagtatttctatataacctacaccaatcttctcgtatgcttgaaatcatgtctagattacttataacaactaatgcaatatgaatgctatgtaaatagccgttatactattttttttttacgaaataatgacaaggaaaaaaagtctggaggatggaacaagatgacagaatagaagtttccactgatcatccccctgcaagaacaccaatttaaaaactacctacacaaaaaacacctttacaagaaccaaaaatcgggtgagcactcacagtacatggagttaaattcatatttctgaatgaggcattgaagaagttagaaaaacagtattgcatcactgacactaccactccttcatcccccagcagtggaggtgtggtatggagagcttctctgtgcactggggagagggagagccagcaattctaagacactgaactcagcaatgcccttgttatagcagaaagaagacccagaccaaattcagctgacacccaccatgaagggtgcatttaaatcagccattgctggaagggaattgcgaatcccagtgtttggaacttgagttacccaagcctcaccatgaagggctaaagtggctctggagccacagacaaacctgaagggcagtctaggccacaagagctgcaaatcctaatgctaatctgggcccagagccagtggactcaggggacacatgacctgttaaaacaccagccagggcagctaaactcatcccctaacctcagcctccacggcttgtggctccaaaagaggcctctttcctctgctttaggagaggagagggaagagtgaggaggactttgtcttgcatcttggataccagctcagccacatcagggttggataccagccagagtcatgagggccttgggtgagactctgagacatgctggcttcaggtgagactcagcatattaccagctatggtggctatggggcaagactccttctgcttgaggaaagtggacagaaaattaaaggagattttgtcttgcactttagtgcaactattgttaccattgttattcaacatattactggaagttctagctagagcaatcagacaagagaaacaaacatatatatatatatatatatatatatatatatatatatatatacacacacacacacacacacacacacacacacacacacacacacatgcatacggcatcaaacgtcaaagaaaagtaaaattatctttgttcacagatgataggaccttatgcttggaaaaacctaaagtctccccaaaaacctattagaactaataaacaaattcaggaaagttgcaggatacaaaatcaacatacaaaaggcagatttctataagtcaatagcaaatagattaaaacaaatttaaaaagtaatggcatttatgatagccacaaataaaattaaagaggaattaaccaaagaagtgaaagagttctataatgataactataaaacagtaataattgaagaggacactaaaaaatgaaaagatattccaggttcatgaaccaaaagaatcaatattgttaaaatatccatagtactcaaagcaatctatagattcaatgttatccttatcaaaataccaatgacatttcttacagatatagaagacactatcctatcatttgtatgaaggcacaaaacacccagaggagccaaaattattctaagcaaaaccgccaaccaaccaacccaccaaaactggaggaatcccattgcctgacttcaaattatactacagagctaccataaccaaaacagcatggtgctggcataaatgcagatacatagaccaatgaaacagaatagagaactcagaaacaaatccacacacctacagtgaactcattttctacaaaggtgcaaggaacatacaccagggaaaagatcatctcttcaataagcagcactgggaaaagtggatatctatatgaagaaaaatgaaactagtcccgtctctcgccatatacaaagatatagtcaaaatggactaaagactttaagacctcaaactatgaaactaccagaagaaaacattggagaaaatctccaggatatttgtctgggcaaatatttcttgagtaatactccataacacagacaaccaaagcaaacatggacaaatgagagcacattttgttaaaaagcttctgcacagtgaaggaaataaatcaacaaagagacatcccacaaaatggaagaaaatgttttcaaactacccacctgacaaggaattaataaccgcaatacatagggagctcaaacaaatctataggaaaaaatataataatctgatttatatactgataaaagattgaatacacatttctcaaaagacaacatacaaatcaaaaacaggcacataaaaagtgctcaacattgatcagagaaatgcagatcaaagctacaatgagataccatctcatcccaattaaaatggctcttatacaaaagacatgcaaaaataaatgctggtgaggacatggagaaaagggaaccctcataaactctgtgggaatgtgaagttgcatttaaagttgtatttaaaggtgcaacagagaacagtttggaggttcctcaaaaaactaagaatagagctaacgtattatccagcaatcccactgctgggtatatagccaaaagaaaagaaatcaatatactgaagagacatctacacttccatgtttgttgcagctctgttcacaatagctacaatttggaagcaacctatgtgttcgtcaacagatgaatgggtaaagaaaatgtggtacttatacatgatagtgtactatatagccacaaaacaatgaaatcctgtcatttgcaacaacatagatggaattggaggtcattatgctaagtcaaataagccaggcacagaaagacaaacattgcatgttctcagttatttgtggcaccttaaaatcaaaacaattggacttatggagatataaattagaaatatgcttagcagatactgggaagggtactgggggggggtgaaggggtaggtggggatggttaatggatacaacaaagttgttagaatgaataagtactagcataatagactgacattgtcaataacaatcgtacatttaaaaataactaaaaggatatagtaatattgtaacacaaaagataaatgcttgagaggatactccatttttcatcatgcatttattatacattgcattcctgtatcaaaacatctcatgtaccccgtaaatgtatacacctatgtcacaacaaaaataaaatttagaaaagtctgtaccaatgtgaccatgataagcctaattatattttcaatccatgattggttaagtccatgattggttgaatcttcagatgcagaatccaactcataagcccaactgcagaagcagatactgacaccaggagacagaatgagcatattctgtccttggctggtacccaccctatcttccaacattgcttcttccaatatctcagagtatccttaaaccacacactttcatattccttcataacttcttgtatcctgcttccttgctgtgaatttaccaaatgcatttctgtataaactctaccagtcataaacacttagataatatgacaatttctttatgaaggcgtgctctactcaatcagtgagaactctcacacctcagacataacaatccttcttttatacccttcacacaagcctcaactcactcttgtattttaattatttctaagtttcaatgaaaattccacatgaatatgtataattagaaattactttaatgagctgtataggtatgaaagttaaaaaactaaataagtgtttaaaaatcgcaggtggagggttgataatacgtaaaattgcaaaattctagatacattttaggtactgctatgaaatccttaatgagctgtacacttattttttttatggatatacttcaatagttgtacaagcttcatgtatagccacaaatataaacatattcaagaacataaaatgacaaaatggtcaacaaatttatcatcttaggtccttgagggacttttgatgagtggaccctgagtaccatctgacagatttacaatgtgaacatcacataaacaatgtttttgtgcagcttgagatgttactatggcattaccttgtgcattctgactgatccataattatatttaaaatttgcaacagtgctccctattttatgttcataacatatatcatcatctggcatgaccacatcatatgttttacctattcactgtttgggtttttgttattgcacaaggagaccaaaatatattcattttcttctctgttgctttctaacattagcactatgcctggcatatatcactttcgcaccaacataatagtaaaaattgattatttgttaaataaatgaagaagggaaaatgatggttagagagattagtgcaactcctttagagatgaatttagtaatatctcataacattgaagatgttctttcttcactacctaagacttccaaggagattatacgaggatagacactctgttacactataaagcatgaaaaaagtggtaaacctaaatattcatataaagaaaatgcacacatgaccaatattaataccaatttattgtgaacatttcaataagtaaagttgaaggaaaatatatgtggcagaatgatcagtgtgttaccatttaacaaatacatcctgctaaaatattacatttggacacatatctgcaataaaaacattaaaaattgatagggaagatacacacctactgtttaaaaaaattggtctgaggacactaagagagggaattcaggagagcacagataagactttgatgtacctgtaaaatatatacccccatttttgagtcagggtcttgctctgtcacccaggctggagtgcagtgtcacagttgtggctcactgcagcttcaatctcccaggctcaagtgatcctctcacctcagcctcctgagtagctaggactatagacacgtgccactatgcctccctaatttttttaaatttaatttttggagagatgaggtctcactatgttacccaggctggtctcaaatacttaggctcaagcaatcttcccacctcagccttccaaagtgttgggattatagggcataagccactgcccctggatgatgtacctatgatatatatatatttttttatttcaataggtttttggggaacagttggtgtttggttacattaagttctttagtggcaatttgagaatttggtgcactcatcacccaagtagtgtacactgtacccgatgtgtagtcttttatccctcacctgctcccaccctttcccccaagtccccaaagtctattgtatcattattatccctttgtatcctcatagcttagctcccaggtgtgagtgagaacaatgtttggtttttcattcctgagttgcttcacttggaataatggtctctaattacatctagtttgctgcaaatgccattatttcattccttttcatggctaagtaatattcatatatatatatatatatgcatatataggaatatatgtatatatgtgtatatatgtatatataaatatatgtatatgaatatatgtatgtgaatatatgaatatatatgaatatatgaatatatacgaatatgagaatatatgaatatatatgattttctttatccactcattgattgatgatcatttgggctgcttccatatttttgcaattgtgaagtgtggtgctgtaaacatgtgtaagtatcttttgaatacaatgacttattttcctctgggtacacaccaagtagtgggattgctggatcaaatggtagatatacttttagatctttaaggaatctccagacttttccatagtggttgtacaagtttacatttgcaccagcagtgtaaaagagttcccttttcagcacatccacaccaatgtctatttttaaaaaattttttgattatggccattcttgcaggagtgagatggtattgcattgcggttttgaatttcatttccctgataattagtgatgttgagcatttttttcatgtttgttggccatttgtatattttctcttgagaattgtctatttgtgtccttagcccactttttaatggctttgttttgttcttgctgatttgagtttcttgtagattctagatattagtcctttgttggatgtagagactgaagattttctcccactccatgggttgtctgtttactctgatgattatgtcttttgctgtgcacaagctttttagtttaattaagtcccatttatttttgtttttattgcatttgcttttgggttcttggtcatgaagtctttgcctaagccaatgtctacaagttaacattttctgacgttattttccagatttttaataatttcaggtcttaggtttaagtctttgatctatcctgagttgttttttctataaggttagagatgaggttccagtttcattctttacatgtggcttgccaattttctcagcaccatttgttgaatagggtgtcctttccccacttttatgtttttgtttgctttgttgaagatcagttggctgtagtatttggttttatttctgggttctctatactgttccattggtctatatactgatttttatgccagtaccaagctattttggtgactatggccttatagtatagtttgaagtcgagtaatgtgatgcctctggtttcgttctcttttcctagtcttgctttggctatgtgggctttttggttccatatgaattttaggattgtttaggattgtttttctgtgaagaatgatggtggtgttttgatgggaagtgcattgaatttgtccattgctttggcaatatggtcattttcaattattgattctactcacccataagcatgggatgtgtttcaatttatttgtgtcatctatgatctctttcagcagtgatttgtagttttcctcatagaggtcttttacctccttggttaggtattcctaagtattttattttgcagctattgtaaattgggttgagctcttgatttgcatctcagcttggtggctattgctgtattaacagagctactgagtcgtgtacattaattttgtattctgaaactttgctgacttcatttaccagttccaggagctttttggatgagtctttagggttttcttggtatacgatcatattatcagcaaaccgacagcataacttcctctttactgatttagatgccctttacttctttctcttgtctgattgctctggctaggacttccagaactatattgaatataagtggccaaaatgggcatccttgccttgttccagttctcagagggaatgccttcaacttttccccattcagaataatgtttgctgtggatttgtcataggtgacttttattaccttacagtgtgtcccttgtatgctgattttgctgagggttttaatcataaagggatggattttgtcaaatgctttttctgcaactattgagatacacagaattaaaaacaaaagtcacatggttatgcgatgtatcacgagttgactcatatatgttaaatcaaccctgcatccctgttacgaaacccacttgatcatgatgatttatctttttgatatgttgttggattctgttagacagtattttgttgagaatttttgcatgtatgttcatcagggatattggtctatagttttgttatgtcctttcctgggtttggtattagggtgatactggcttcatagaatgatgtaggaagttttccctctatcttgtggaatagtgtcagtaggattgatgccaattaattcagctgtgaatccatctggtcccagactttttttgctggcattttttaattaccattccaatcttgctgcttgttactggtctcttcagagtttctatttcttctttgtttaatctaggagcattgtatatttccagaaattaattcatctcctgtaggttttctactttacacgcataaagctgttcatagtagccacgaataagcttttgtatttctgtgatattggttgtcatatcacctgtttcatttctaattgagcttatttggctattctcttgattaatcttgctaacagtatcaattttacttattttttcaaagaacctacgttgtttcatatagcttttgtattttttatttcaatttcatttagttctgctctgatgtttgttatttcttttcttctgctgggtttgggtttggtttgttcttgtttctctagttccttgaggtgtgaccttagattgcctatttgtgctctttcagactttttgatgtgggcattaatagtatgaaccccatgtgattcaggaattccattactaaggatgtatccaatttaattgggcatgtcaaagagatatctgcactcccatgttcattgcaacattattcacaatagtcaagatatggaatcaacctaagtatccatcaatggatgaatagatatagaaaacaagacatatatccacagtgaaatgtaattcagcctttaaatagaagaaaatcttgttcatgtgtcaatgttctatattgtgttgtatatatcaaaacattataattgtatatataatacatatgtgtatataatgtatattatatataatacataattacaattatatgtgtaatatatatgtgttgtatatatcaaaattgctaagtgggtacattttaaatgtctcaccatgaaaattggtgataatatgttcattaggttaatttcatcattacaaataatattcgtatattaaaatatcacattctaccccataaaaatctatattttaatatttcaattaaaaatatttttaaaaataatgcaataagaacatgaaagtagaaaaatgattatagacctttggtgtggaactgaaatcagaaacacaaatattaacctatgatttctacatacatttataaataattgatggtgtctacttcattctttactcgttttctttccacattttgtagatataatttgagatttttttattctatcttcttgaaataggagattagtcaatatttaacctttcttcttaatgatctacagggataaatttttctgtaaccactgcgttagctgcatcctacacgttttatgtcatgtttatattattgttctgtcaaaggcccacctgtgtttgattttggtgagaatcccacgtgaactagaaaagaacttgacttttcttattgttgtgagcattgttccatatgtacaaagttttgttaccattaagtatgttgtataaatcttctataactttagtaatttggaggtttctgtgctctatcacatattggcatgttaacatatatactattaaattgagcaatgactgggcaaaaggaaaaatcaaaagagaattaaaatctcaagacagacaaaaaatacactatactaaaacttatgagatgcaccaaacccagtactaagagaaaagttgattgcaatgaatagctacatgaaaaaaagaattcaaattaaccaactaactttatatatcaagaaactagaaatagagagcctaagtccaaagttataatacagaagaaaacattaaagtagaaatgagactagaaaaactaaagaaaaatcagcaaatctaaattgttttttaaaaatttaaaggtgataaaccttagctagactaagaaaaagagtatcctcaactaaaatgagaaataggaggagtcattagaacaaatgcctcaaaatgaaaaggatcataaaagactattatgaaaactatgcacttataaattagataatctataagaaatcaaacttgatttatgcaacctaccaaaactaaatcaagaggaaataggaagcctgaacagaggaagaagatcaaattagtaaacaaaaacttcccaaagaaaagaccgaaccaaatggcttcgtggatgaattctaaacattcaaagaactaatagcaatccttcttaaactctttcaaaaaccaggagaatgccccaaactcattttatgaggccatcaaacacttatatcaaagccagacaaagataatcaaaagaaaataaaactacaggtcaatatcactgataaacataggtgtaaaaatcttcaacaaaatactaacaaaccaaattcaacagcccattaaaaagagaataaaccatagccaactgaaatgtatctctgggatgcaagaatgcttcaacataggcaaatcactcagtgtgatataacacattaagagaataaaaaaaaattgcagcaaaagcatttgacagttcatgtcaaaactctgaaaaacaggtatagaaggaacttatttcaacacaacatatcatatatgaaaagcccacagttaacataataaaaaatgaaaatgtttctcctatggtctggtacaaagcaaggatgttcattgtcaccacttttatttaacatggtactgaaagtcctatccaaagcaattagacaaaaaagcatcaaaattagaaaaatattaaaataatctctgtgcaggtgacatggccatatatataaaaaccctaagactacaccaaaaaactattcgaataaacaaattcagtaaagttgcagaacataaaatagcacacaaaaatcagtgacatttctgcacacaaacgatgagctatttgaaggaaaataagaaagcaatcccatttaaaatagcaaaaaataatatatttaggaatacttatccaatagggcagaagactcctacactaaaaatcataataccttagtcaaagatattgaaggagacacaaataaatggaaagacactgtattcattcatttgaataattaacaaatcttcaaatttgtagatttgaataattaacattgtttaaaatgtccttattaagcaaaacaatctataaattgcaatttctataaaatatcaccggtatttctttacagaaataaaaaaacaataagtaactacatctagaaccataaaagatctcaaatagccaaatcaaccttgaacaaaactagaggcatcacattgatttcaaaatatattacaaaggtatgggaattatcactgtaaagaactgtcataaaaaagaaaaatggacatatagactaatgaaacacaatacggagaacagaaagcaacccgagcatatttggccaactgatcaacaaagtgagaaggcaacctacagaatgggagaaaatatctgcaaaccatatatctgtaaagagggtaatatccagaacttataaggagctcaaacaactcaatagcaaaaaccaattaccttgattaaaaataagcaaagggcctgggtaggcatttctcaaaagacgacataaaaatggccaccaggtaaataaaaagagctgaacatcactaagcatcaggcaaatgcaaactaaaaccacaacgaggtatcacctcccaccggttagaatagccatcattacagatcaaacaaaagagagggaaagtggagaaaaagaaacctttgaatattgttggtgagaatgaaaattggcacagcaattataagcaaacagtacagagtttcttcaaaaagttaaaaatagtactatcatatggtctagcagtcatgcttctaggtaatggttcacccaaagaagtgaaagcgggatttcaaagaggtatcagcacaccagtgtttattgcagcattattcacaatagcaaaaatagaaaaataactgtaaatgaatgaaaatgtaatgaaaatataaatacacatacttgcacaatgaaatattctttattttttagcccaaagtaaatcctgccatttggcacaacatgaatgaacctgaactatattatgctaagtgaaaaatacacagaaagacaaataccatatattctcacttatctaaaatagtagactagctcatagaaacagtagcatgttggtcccccgtgaggagtttagggaaacgaataaagactggtcaaatgctacaaagttcagtcatgcaaaagtgaataatttctagagggctaatatacagcatggtgactatagttagcaatattgtcttgtatacttgacatctgttaagagaataaatcttgtatacttgacatttgttaagaggatatcttaagtgttctaaccacaccaaaaaaaaaataactgtgaggtgatggaaatgttaacgagcttgatggtggtcatgatttcataatgtatgaaatatatgtacataatgtatgaaataatgtcggaagacaccgacacgccgcgccgccggagccccagtgcatgctggttgcgctgaaggcgaccccgccccagaatgcacggagcctccgcccaggccccggaaggacaatgtgcccgacaactggcgatggctgtaggaagccatggtgaggcgggggatggatggaaccaccctgggcccagcagctgtgattggcaggaggagccacatctttcattcttacagcctcagtctctctgcatccttatacttaaggtgtctgtaatcataatattgtataatctgataatctcagtattttacttggaacatttagtatattacatattttattgatacataatatttctacatacttatggggcacatgtgatattttgatacatgcatgcaatgtgtaataattactgatataattggggttctatgtgagctataacttctaaccatattctatttggcccatctgtttcacgtctctttttcattctttcgttgcttcttttagaaatataaaaatctatcattttttcattttataaacttgttttggcgtttactataaacattacagcatgtactcttgatttactaaagtttaacacaaattactacctctactacatcaatattgatatatcttcaacatgatttttcatacatttaagttttgcacaaatctaaactgtatattacattaaaattattgctaagtcaatattgattatgactcatttacatattactctttggggttgatgtttgtcatttttgcttatatttctgagtttacttttgagataatttttctatggctgaagaattttatccacttttgtttgttggaaaaatttattttactatcattttttataattggagttagactcaatctacatctagttcatccctattactgagacatggtcctactggactcttgattgacaggctggtagatgtccctatgctctgtcttgaaagcatttctcccaatatcaatgtggctcattaacttgtaaactccacatctttgctcaactataaccagtgaggattagcctaaatccctacataaaacgtgacccctacacactccaagacccctctcctgctcaagattttccaacacttttcttctgataatactccatgtcttcttctcaattaccaaatttattttctgtatacaccctttaagtgctaaaaaagatgaagatttttatttgttttgctcactgatgtatcctcagtttgtagaacggggcctggcaaactataggggctcagtagttatttgttgaatgaatgaatgacttggggcctaaaggaagattatgtagtcatggaaagttatcttcgtatccttgtacttacagataaaaaaacattccgaagagagggaaagccacgtgaaaacattgggtatggaaagaactatagtgtttccaaggttggagtatggccctcccagagggagaggcaatgcagtgtggaaaaggccacagactccacaagacgtggcacatgcagtggtcaggggcagggactccggcctgcctgcctgggcttaaatccctgttgagcactttataagctgcacacccttttgttcatgttactcaaacccatgggtttcagttaaatcaactgtagaataaggctaataataggctgtgaaaataaaagtgttccatacatgtcacgcactaaaaatggtgccagatcataataatcacacaagacgttataattattatgttatttgttaaatacaaatacaaccatgcacatacgtaaaactgtgatttgaaattatattctaagtatgtgtcaccattggcttgaacagggagaagtgtgcgaaacttccatatttctctggttaagtctatgaataaaccaattatactccaaacatgttgtagcccatgtctactggatagcccatgtctctgctctaattttgggaggtttgacttcttatatgctcacagaaaataagaatttgattgagaacacattctagaaattctgatggaagaaaaatctcaactgtacatttagcatctctgaggtcttgaatgtgtttatctccaaatgcctatggatgaatgaacccccttgtccctgaggatcccctgcttggggcaagtcaggggaagcctcaaaggctgttttgtcatttgtgaaatgtgggtgaccttagcctcagccacagagggtgaaggtcgaatgaggtggtgaacgaaaagcgtttagcacagagtggatgctgaggaacactctgaatatggtgttatttcatactcatcaatgggcccatgatagcaaaacaaattttctctgtggtggaaggtgctcaagggtcataaacacatttattttcatatttctccactgtaatctaaaaaaaggaccattggccccgaaggactggactagagatcaatgctacgagggaagggggggataagtgaacatcatctcaagtgtgattataggagggaagaacactgggctgaatccccctgaaggacaactcagggagtcagacactaccacaatatgctgattgtttggtggaaggacacctaaagtgaagagagactctaagaagagaggaccaacttaagttctttcacactttaatatggaggtttctgcacgctcagcatttttttcaaagcccttgtgacatccttattcctgaaactgtaaatgataggattcaagacaggtgtaaggatagtgtagaaaaaggatgacatcatatctttctcaggagtttggtaggagctggggagcatgtagttgtaaatagcagctccatagaagaggctgaccactgtaatgtgggaggagcaggtggtgaaggcctttttccgaccctcaactgagttcatcttatggatggtgaggatgatatagtagtaagacactgaaatgaccgtcacaggtatcaggagcatgatgacacagcacaagtacatgaaaatcttgtaaagtgaggtgtctgagcaagagagcttcaaaacagcagggacctcacagaagaagtgctgaatctcatgggatctgcagaaggggaagctcatggcgatgggagtgagcatgaagccatccactgagcccacaaaccagcagcctgatgccaggaggagacataccctatggctcatgagcacagagtaacggagaggatggcagatagccacatagcggtcataggccatggcggctagaaggcagcactctgcacctcccaactgcaggtagaagtacatctgggtgccacacccaaggaccgagatggtcttgtctttggccagctggttcaccagcattttggggacagtgacagaaatatatgtcaagtctatgagtgagagctggtttataaagaagtacatgggagtatgcagagaggagtcaatgtggatcagaagtatcaatgtaatattccaagacacagccatcaaaaatatactgaagataagcaagcagaggcggccagggtgtgagatctggctgaagattcccaacaggaaaaagtcaccacccagggtctggttggccagccgcatgctgtatgatcggctgaagtggctttacctggaggacaaaagtaaactttatttataatcatgtgtgtaccacgtaaaagtatgtttgcttcactttaccttttaaaaatcaatgtgaaaatcagagtgtatttccaacatgaactgtgaatttgcactaaaaagagacagcacattagattgtgaatctgattccccatctagaatgggaatgaaatatttatattctcaatgaagaggtccatacaactgaaattaaattatttcctatagattatatagtcactaatagttatttttacttatatatgttcacattttgtgtgtgttagtatcttatagttgcatgttcctgtattgcccaaatcccattcccatgggattttacagagctaataaccaatatagatatttctatatatttgaccctcaagagtcatgtctgcaaaaaaggattagtaatacttgtgtttcttaaatctcgttacaaatctacgaacatacaatttttcaatacttaaaagcaatatattaagccaccagtaattgtaaacattttaaacataaaattccaaacccttatataacgttacaaatttagtcaaatttctttaaatgtattaaagacactagtacaacttgtaaatttctctaaaatgatttacttttacacatatgtgatttataaaatgtatttttatacttccacttaacctattacaaagacattaatcttgtgagttatttattcatattttcataatttccatcaagatgttctaatccgttgtgtttctgccaatctttcaagatatcaaaaaaaaattatggctatctcagatcaatgatgctttaggaatcagcattatcatccaatcagtttattctgaggtgattggtctgaacctcacttggaatttcttgatgtgaaccttctttataaaattaaagtaaaatgtaattggattttacaagcccacatcttttcttccaatctccccattttgcctgtagaattttggtgagagaaagtttgcctcaatttatacttatcttatcgtgacatccaacatatttattgtatgcaggtaggtcatcctaaggtttcttctcccagtggttcaagcatgggggtctctgaagttgcaattttttttaaagactactcaagtgcactagtgagaagggaggaaaatgtagaacaaggaattctatctgtaactggctgtgaacaatcaattgagataactatcttcagatcatccaagttccaatttcttctcagagcatctagtcaattaatcaccttgtaataggctgtaggactcttcttctacctggctattttggggggtcagtggtgctggtcagccctttcccgttgatagcactatctttctcttgttcagaattctgtgatttacatatggatgctcattattattattctctacttaaagaaaatgcatatcctttataaaatgaatagttttagatatcattaatgttcaatatattaataacgtgtcaaatgtttatttaaatcagacacatattcatcctttttatattgcagcttttcttatgtaaccttttacattgtaatgtacactttatattttttatcattaacttaaaatttataaataagaattattgcaattggtcatattatttccttttttatttcaaatatcttgccctggccaagactaaactcgtgggttttcattttgttttagaaatacttagcaaaggacacagaaagcataagagtaaagtaatgccagtttttaacaaattgctttcttatgttaagagacttaaaaccaaaggggacttaatgtattttcagtaaataaacatgtcattggccataacaaatggtagattttagtcaattaataaattactagactaataaactatattttcctggagcagaaagtaattttctaagtataaaggcaaaataaataattcccaataaacttcaaaaattcagtggaattatttagtagattccaaaagacaatgaagcaacatcatctagaaaaatttgaaaaaaaaattatggtccaagaatgaagcatatatccagcagtgaaacagcatagaggccctgtctctcagatatccaagaactcagaaagcagagaatcaggtaaaccgtttcagaaattcactatcagccctgctccagccactgtcagtcaatgtctgtcccgtcaaataaaacaactgcaaaatgtgagagtcatggtacgcctggaccaaaggcgaaacctgagacaaataaaacacacatgtgccaaattgaatgatcatcgtccatctgtatcacataatgtctcaaagaaaaatcaggaagtaggcgcaaaaggggtaaggaaaagtagacttaacggaatttccacaatttataggagataagcattttcacttgctgcccagcttctcagtgaaataagtgtatttaatgtccgctcccaaaaatggagtccatttagggacagtgtccaggataagactggtgcctgtcagagctaattaactctaggtctatgtaaggaggccccttcccaagttgaacaggtggtttacaatgagtataattatgcaaatcagcagtgagatggacatgagctagtcagggtgagcatatctcaggtttattcaggagaacaaaagtgagagtggatattgcatttcttggccatgtagttcaagctaccgttcttccacagacactgaaacaaggggactgagtccataaggctgcagaacaaaactccccttaaccaaatcaattaatttatccacttctaggaaacaaatgacaccagcacagacggccacgcaaggcaaaagaacagcaattaggttcattcaaaagcaataaaatattttaaagatgaactgctatttccaaaatgaaacctttatgacaaagcaagcaaaccagttgtgacaggcttcacagtagtaacatctgcactgtaggaaggagagcacccctccttcttgagtgggtatttatactccaaagtgatgtgtcatgcttcacccaggaagtagaattatgttgctcaccatgaggctgaaacctctatcaaccatctcccactcatccacatcttcctgttttggagtctgggagatcagttatttaaaaacaaggggaaaaaaggaggaaaggaagggagggaggaagaagagaggaaaagaaaactaatattcaacattgctccgattttcagaggaaaaaatgtttataatttaagtcagatttgcctggaaaaatataccaccaggaggaaaaggctcaagatctgaaatcagttatttttttagtttagttctcttcttttccgaggtacgttgcaagtcacctaaaacttttgagtatcttttttttccatttatacctgtaggggtacacactacttatttctacagcctaattaataggattgcagagagtttcagatataatatgcacagcaagtactttctaaattatagctttgtattaggttaaatatgcttatgagttattttatgtgatctataatataacaatgttagtataattttaccaattatatttgctgtattaaatatatattaactgttacattggtgattaatatcaattgataatataattctataatacatatattattaaaagttaataacaataaattattcctttcttactggaacaaaggaagaaatgtaataccctgaggaattttatttccaataagatacttccagtatagtcgtcccgatgaatgacagccttgtcattttcgttgtgatcaatctgctctgtgatcagtgaaacaccagcctgcttttctgcgaaagggtttcagatgatgaaacacttatgaacttgatgactctccctgaagagcagctgatgctgccgagtctaacacgtgcggtcctgggacgacaaacttgaagaatgatgctgtccacagggacccctcacagggctgtggtggcctccatgggagcagtcctgggggagtctctctggcctttgttgaatggtagggcctgattctatagacttttccaattgcctaactcctctaaccctccaaatgaaaacaagcatctactaatggcaaacagacttcaccagactgtttccttgaagacaacttcgctcacaggtcaaaccattgcatcatcttgccatgagggaaaagagtgaaacgaacctgaattagacaattgataacacatttaatagagtatattcttccatttatttattggttttcttagtaataactgtagaaaattttaaaactaagtattattataaaaaggagaaataacaacacatactataaaaagccaaagataactagagtttgaatttttcttgcttttaggcaggcattttcatgtgattttctttatagaattttgtatccatttgtctttgaaaatatgacattttaaaccaaagtgtttgcatttgagtgtccataaaatgtaaaacttatttgttatttctaatttcttatttatctcaaacaattgtgcataggaaactttttaattatgaaaatggacattcgtgattgatatcgctttgttaaatgtataaacccttttaactgaaattttcatcagaagatagggttattgctgaaaatttgaaaagcattgaataatgtaaataatacaaaataacattttttacttttaacccttagaagcaccaatttaggaataatgtaacatttccctccaggatgtgtttggagacaactgatatatccaaaaatttggtttttgcatttcaaacagaagattatagaatggcctttacactgtagcatatgactttgaaataattaatgtagaacattggctgagtaaacacattatatgacctccctgtgtcttaagtcttcagggtgtttttcacgttttgtaacatgagtgatatttcaataaacagttctctgttcaatgtgtttattttggtggaattacaaatttgaaattccaggtgtgatggtcagaggatctatacctcttagaacattccactaaatgactttccaaaatgtaaccactattaaaagttttatagttatggccgggagcggtagctcacgcctgtaatcccagcactttgggaggccaaggcgggtggatcacgaggtcaggagatcgagaccatcctgggtaacacagtgaaacaccgtctctactaaaaatattaaaaaattaaaaattagctgggcgtagtggcgggcgcctgtaatcccaactactcaggaggctgaggcaggagaatggtgtgaacctgggaggcgaggcctgcagtgagccgagatggcaccactgcactccagcctgggcgacagagcgagactctgtctggaaaagaaaaaaaattatagttatttatggtcccaaaacaacacattcgttataaaaaatttacaaatacaaacttcaaggaaggaataatctacagaaattgaatgtgccattgaatattctagtgttttatactaaaaagtgtatcaaacgtactttaccatgtgagtgttattaacatcagtccacctccaaaaagtgtgtgcatgtcacatgaggatacgttccaagcacacggaaagtgttcagtgattgatccaatcagtagtcatgcagagtaggtgctaataaacactaccccgagtgaggatgcagacacggagacgcaaagggcataggggaatttccccaagtcagacagatgagtaacagggcagctggactcaagacagactgataagtaacaggacagctggactcaagaacgtgcttctagaaccacaatgctgcactaactcctaattgcaattcctggtaacagctgaaggatcttctgattatattgtagtccgtatttagtagactttttagaaaataaacagacaaaaaatgcaaaagtcattagcgtacagctcaagtagtctttggaaactgaactcaccacagcctgcccacagatgcacaatcagaagtgagttagcccccacgtagacccccagcctgcatcccaataccctccccaaagaaactgtgactctgccttcctataaagtagttttgcctggatttgaaatttatgtaaatagagtcacaaaacatgcactctttcatgcctaccttcttttactaaacattatgtaagattcaagcacatttacaggtagttatgttggtggttttttcattcttactctgtattgtatgctctaagaacaaagaacaatttgtttattttgttgttcatggcaacttgttttctatctatggctattataaataataccctgtgatcatttttaatttgaaattcacaacttaagaagagataatcagcacacctttacatccactaataacacacagattgcatagtacaagctaaaaggataacgcaaaaaaacaataccacagctaaactgaccattttgacttttattaattggagaaatttattgtaaatcatttaagttttataaaactatatacttttaaaaatatatattaaccactacaaaaaatttattcagtaaaatatttcacctacattttaaaacatgtattttggtaaacacatgtttgcatttctgttgcatatataaccaggagtgggatatctgggtcatagatgggcacatattcagctctatcagatactatcaaactgttttccagaggttttatcaatttatagtctcattagcagttattttaatcatcataaccacactgacagatgtgctatttcattgtggttttaaagtgtcattttttgacaactagccaagttgaaaaccttttcatacatttattggaatgtacattttgtacatttattggaataatttattggaatcatggctatcatatttgtaaattcccattctagtcttttgccatttttaagtggattttctgcttctttattgatttgtaggaatttcttctatgtgttctatatgaatccttcatacatatatctatttataaatatttccttgttttctatgggttgcttttttacaatattaattttttaaaataaattttaatttaatgaagtccaacttactatgttttcctttagtgttagcacttttgttttctgtttaagaaatacttgcttacctcatcattataatgtgttgttctatattttcttctaagagattattttaccttttatatttcaatctatacagcccatctgaaatatattttcttatcctgtagtgtagggatcaatattcattttttccatgtggattgtgcagtggagtcagaactattaaaagcatcctgcatttcccactctgagtggttgccctggtcataaatccaatgtacatgtaggtgttgatccatttctaggctttattttctgttccatctgttcatttgacaatttgcacagataccatgccgtataaattggtatagttttaaagtaaagcacatggaaattggctgccaccagcaaggaatggtggtatctgtgagaggagttgacatttgaagagtaactcccagggctttgtttgagagtgctaatttagaagagtacaaagaatggctggaaataatgtgttaatatccaccactgggagcactaacttggctgactcttccattttcaatgctaaaatttactgaaacctccaaggaaaactcatacttcacattttgaagaataaatgcctcagatggaagagagtgatattgattcaagaacctggaaaacaaaaacttataagaggcatgaagactattaatataatggaagtctttgttatgaagataaagttgtcttggaaaatcacatgaaacaataaaaagtgttattaatatggaaattaaaatgtgctgtgtgaaggagtcagtggatgaatttgaaggtttggattctccggaatttgaaaatttattcatggtcttgaactttagggtttcacttttaatgacctgtgcaaggctgagtgtagagttagtgcagcaccagttgtattcaattgttcacataaaggaatgaatgttctaaaagcagtgacaacccagtagcaatgaatgagcacacggagtgcctagatcttggtttctaaatgctaatggtagtttgtatttctgtgggatcagtggtgatatcccgtttatcatttttcattgtgtctatttgactcttctctcttctttattagtctagctagtggtccatctattttgttaatcttttaaaaaaaaaacccagttcctggattcattgattttctgaagggattttcgtgtttctatttcattcagtcttgctctcatcttagtcatttcttgtcttctgctagcttttgagtttgctcttgctcctctagttctattaattgtgatgttagggtgtcaattttagatctttccagctttctgttatgggcctttagtgttataaatttccctcttaacagtgcttgagctgtgtgtcctagagattctggtatgttgtgttttgtgctcatttggtttcagataaattatttctgccttaattttgttactcagtcattcaagaacaggttgttcagtttccatgtagttgtgcggttttgagtgagtttcttaatcctgagttctaatttgatagtactgcgatttgagagacggttacggtttccattcttttggaattgctggggagtgttttacatccagttatgtggccaattttagcatacatgctatgtggcactgagaatgtatgttctgttcatttggggtggagagtcctgtaggtgtctgttcagtccgcttggtccagcctctcttaccactcctattcaacatagtattggatgttctggccagagcaatcacgcaagagaaataaaggtattcaaataggaagagagaaagtcaaattttctgtttgcagaggacatgattgtatatttagaaaaccccatcgactcacccccagaactcaagctgataagcaacttcagcaaagtctcaggatacaaaatcaatgtgcaaaaatcacaagcaatcctgtacaccaacaatagacaagccaagaacaaaatcatgagtgaaccccattcacaattgctacaaagaataaaatacctagcaatacaatttacaagggatatgaagggcctcttcaaggagaactacaaaccactacttaaggaaataagagacaacacaaacaaatggaaaaacattccatgctcatggataggaacaattaatatcgtgaaaatggccatactgcccaaagtaattttagatccaatgcaattcccatcaagctactaatgactttcttcacagaattaggaaactatttgaaatttcatatagaaccaaaaaagagccagtagagccaaaacaatcctaagcaaaaagaagctgggggcatcacactacctaaattcaaactatactacaaggctacagtgaccaaaacagcatggtacctgtaccaaaaacagatatatagaccaatggaacagaacagagacctcagcaataacaccacatatctactaccatctgttctttgataaacctgatacaaacaagcaatgggacaaggattccctatttagtaagtggtgctgggaaaactggctagccatatgcagaaaactgaaactggacccattccttacacattatacaaaaattaactcaagatacatttaaatctttaacttaaaacccaaaaccataaaaaccctagaagaaaacctagtaataccattcaggacacagggatggacaaggacttcatgactaaaacaccaaaagcaattgcaacaaagccaaaatcaacaaatgggatttaattaaactaaagagcttctgcacagcaaaagaaactatcaccagagtgaacaagagacctacagaatgggggaaaatttttgcaagctacccatctgacaaaggtcttgtatccagaatctacaagaaagttaaacagatttacaagaaaaaacaatcccatcaaaaagtgggtgaagggtatgaacagacacttctcaaaagacatttatgtggctattaaacatggaaaaaagctcatcactggtcattagagaaatgcaaatcaaaaccacgatgagataccatctcacgccagttggaatggtgattattaaaaagtcaggaaacaacagatgctggcaaggctgtggaaaaatagaaatgcttttacactgttggtggaagtgtaaattagttcagtcattgtggaagatagtgtggaattcctcaaggatctagaaccagaaataccatttgacccagcaatctaattgctaggtatatacccaaaggattagaaatcattctactataaagacacattcacacatatgtttattgcagcactatttacaacagcaaagacttgggaccaaccaaaatgcccatcaatgatggattggataaagaaaatgtggcacatacacaccctggaatactatgcagccatgagttcatgtccttcgcagggacatggatgaagctggaagccatcattctcagcaaactaacacagaaacagaaaaccaaacaccgcatgttctcacccgtaagtgggagttgaacagtgagaacacatggacacagtgaggggagcatcacacactggggcctgttgggtggtggtgggggaaggggagggagagcattaggaaaaatacctaatgcatgtggggcttgaaacctggatgatgggttaatgggtgcagcaaatcaccatggcacattatacctatattatacctgtgtaacaaacctgcacattctacacatgtatcccagaacttaaagtaaaatttaaaaaagctctagagtctttgtgtggtgttaaaccatatctctaaacaaaatgatactaaacaaaatttaaaaatactaatatgtgtgatttgttgtttgcaactttctctcgtgttcatactcccaacgtgggtaaattcaggttgctaatatgatgtcactgaccacacagttgggaaaggatatgaataatcatatctcaccagctagtgcaagctggccccagcacaacactgcagaaatgttagaacagagactacttccaggaggagaaaataaggagggttaacaggacaaaataataggaataaatttctgaggtgagaaatgacacctgtctcaaatccaaaaggtatggtatagatactaaactgggtaaatgaacccaacatttttattttattattattactttatatttttgagacagtcttgctctgtcacttaggctggagtgcagtcgcacgatctcactgcaacctctgcctcctgggtttaagcgattatccttcctcagcctctgaagtagctggcattacaggctgtgccaccacgtccagctaatttttgtattttagtagaaacttggtttcaccatgttggccaggctgttcttgaattcctgacctcaagcgatccaccccgccttggcctcccaaaatgctgggattacaggtgtgagccactgtgcctgaccaacagtagctgtttttttctgcttctctctttcctcccaccctccatcctctagtgggatccagtgtctgttgttcccctttgtgtcctcatcatttagctcccacttacaagtgagaacatgcaatatttggttttctgttcctgtgttagtttgctaagaatgatagcctccaacttcgtccatgtttctgcaaacaacatgatctcattcttttcatgactgcatagtatcgcatgatatatatgtatcacattttctttatccagtctaccattgatgggcgtttaggtcgactctatgtctttgctattatgaacagtgctgttatgaacacatgcaagtatgtgtccttatgatagaacaatttatgttcttttgggtatataccaagtaatgagactgctgagtcgaatgctagttctgtctttatatctttgaggaattgccatagtgttattcacaatgattgaactaatttacactcccaccaccagtgcatatgttcccttttctctgcaatctcatcaacatgttattttttgactttttgataatagtcacgctgacaggtgtaagatggcttcccaatgtgggtttgattttcatttctctaatgatcacagatgttgagatttttctcatatgcttcttggccacaagaatatcttcttttgaaaagtgtctgtacatgtcctttgcctactttttaatttttttcttgtaaatttaagtttcctatagatactggacattagacctttgtcagatgcatagtttgtaaatattttctcccattctgtaagttgtctgtttattctgttgatagtttcttttgctgtgcagaagctccttagttagattccatttgtcagtttttgcttttggcatcttcatcatgaaatctttgcccattcttatatgctgaaaggtattgcctgggttgtcttctggggtttctagaggtttggattttgcatttaagtctttaattcatcttgagttgatttttgtaaatggtgtgaggaagtggtccagttctaatcttttgcatatgagtagccagttttcccagtaccatttattaaatagggagtcctctccccattgcttatgttttaagctttgtcaaagatcagatggttgttggtttgtggccttgcttccgagttctctattctgttgctctatgtgtctgttttttggacaagtgccatgctgtttggttactgtataatcttgatgtggtcccaaaatgggaggaagtgcaatatgctccacctggagagggagatggagaatgccaaagatttctggagaggtggactaaggcagaccctagagggcttggtagggacgataatcatttctaccacacagtgttgttaaaagattcagatgcaaaatctcccataaatcatagcaggaactacacaatccataaaaagcaacctagtaagatttcagtgagtaggctactaattaatcagtatgtttcccctaagccagcaaaaaccaattctaaaacagagtgagaagaaacctactccagaaagcgagcatagaaatacaggtctagaattaaaggttcacaacatgtgcaatatctgtggtgaagcatcatcacactcttcaaattggacaaagacagctggatggaagtctctacatggtacacaggtagatttcacttaaaatagtacaaaaatcccaatatgacctttatcaagctttgttgatttattattcttgttatgctggttctattgttcatacctcccaattctgtgagctgctgtacgaaaaataaagcgtctccgtgctaaaagaaaaaagccaaagaacaaggcggcctccacacttctaccatctaaatctcctcacgtgcacctcatcaatagaacctaaattactggtgaatctcagataccatggagtttgtatacatagattttagttttccagctttaccagtcaaaagacatatgaagaagttgggatgaaaacaagcaagccaactacagtatcctcggcttctgcaacacacatttaggttttgcctttacttcaataccctttctctttcaataggtctgtccgttcaatttatgcaaattatgcaatttcaatttatggaaattagaaatggttggtctcttttctgacaccttatttttgctatgcttccttttttaactttttatttctccccatgtatagttaattatgtgtttgtgtttgagagctcggtttttaaaattaaaattttttactttttcattttattcattttttccaacctcagaagagcacattgttcttttagatctttggattactcttatatttcaaataatatgctcaaatgtctagtttttccacaatctaattactatttaagtacatttacacatttgccactctctccaccatgcactcaattttagtttttcagttacattattcctcttaaaaccttttagcatatccctatactttaatcatataattatatccgtattaactgattcatcaagtataaattgtaaagaggttggtctgccaaggaaggtatggattttgtgaagatataaaagaaaataaaagacatgtaaatactggtagaaggagacatctttattagtcatttccacatccatctccccagtttctagatttttttatattgttatcacagtctatattgtctcagtttgttacatttctattttagtcataccttcatttacttattcatatagagtcattttctcatgtgtttttattaaatgcttttacatattatcaggaacctttccattatagtttctccaggcatcctttggtgggttaaggtttgtcctcaacctgttttattgtgatgtatatatgtggctattctacttttcctttctcttaaatcttaaagaatggctttgttttttaaaagatattccactaaaatattgttaagtattgctctattttttatcatttaatataaataaaattcaaagaccggcctaataccactatattgtgatattttgcctagatttcctagtaattctaacttagacacacacagtaccatatttttgtgggacatatctggatatagaaaatactatatcacattttgaaaaagtatctgcatgtacattttcattctaatcatttacatgtatttttcaaccacaatatttatgtttgaccctttttgttggtttccaaatccactgacactttttaacctctctctttattttcctcaggatttttaagcctctttttctggtccttcattatttttaagctgtttctcttcatttgttaacatatttttattttacttttatcttctatttattctctaacatctgtcacctcagtattgatttctgtttttgctttataccgattcctttgaccctcatgtagcatttgaattctattacaaagaaatatcagatttcatttcaactttatttcaagggaaccaacttttcataattttggtagatattatgttgtatgttttctattttgctttagctttctttttacttttgatatatgatgttgcctaaaacgaaatatttaagtaaatgtatttccattcctagctacctatgtgttttaggcagatatgagttttgaaatgtatttgaaaccttttggatcctttatatatgctacatagctttcataggacaccaagcgacgcaatgttttacagccttgtcttgtatattctgtcctatccattgttacatgtctgagaccaaatttggctgtttttatcatttctcttaaacatcagaacctcatctccatcatttttctgtaaaccttgctttgaattcttcagtctctcctatctttagttatctaataacacatgcaatttaattcagactgataaaggatattgtcttaaatctttctgcctctcttttgtccttactgtgcccccagtgaccagcataggaatgggcacaaagcaggcacctgactgtggagtgaataaaccaatgcctggcaacatttagaatttataatcggcaaatccactacttaattatattgagaggattaatttaaaacaatcaacttgaaaacagttaaaatggtagctcagttcatttactgaaaacaaaggaagcattttaaacaattctcttggtcttcgtaacctttcgggactagccccctaattacctgcaagaatagaagagcccagggacctcctgagaagcccagtttcctccgtgttccttatgctttttcccttcgtggaaaaaagtgattgcacctttctttccatttcctaattctacatcatgccttgtatttagctggagactcactcagagtgggagagcctgagagaagagctggagacaagcaaggtctgcaggggattccagggcaggccggcccatgacctggccagccctgccatgacctgctttcccacccaggtaagctgcttacacttccgaggtgaaactattagaaaattaagaaaaaaaaattagacgtgtgtaaatttaggaggcacaacatttccctggagttgaagggaactatactaagttctacagaacttgagtatttgaagatgcttaaattatcattgtgctctattcagccacaaggatcttgtgctataaatttatcgtagaatttgctgttaaaacacacccacactaaagaagccaccacattactctatttgtgacttttgttgcagaaatattactatacatttatttttcatatttcagctgtgaatttttaaaatcacattcaaaggcatgaagagttaggtagtgaattgtttactaaagtgtcattttaaaagaaattcaaaagtttgttttacaagtttaaacatttcatgtatactaatcagggtcagccttaatgaagctatggtctacttagaatcgaaacctgcatattaagctattaaatgttactcaacaaagtcactgaaaatttctagtgccataatctgatgaaaacagaaaagttatttctcctcaatagattgtcaatggttatggtaaaaaattaaccagtgaaatgtgtggttccttggcacgactgcaacacaattctgggaaaatactacaagtctcaaactttccattgtgattcactgaactaaggaagcattactcagtaaattattatgaaaatttagtaaaaagttaggtgaaactaggtcctgttatcacattaatttaaaatatcaaatcgattaaaggtttacatgtggaaaataaaaatataaaacaagacacatgaatgggtaaagatttagctaaacggtgagcaaaggcaatgaagaaaacatggaaagtaaaattagtatttgaaaactgaaaacaatctctgaataaaacaaattttttctaattaggaaatttatggttcacatgacgaatcaaaggctgaggatcggtaatgtgtaagattctcttgcatattcataagacagacatggcaatttttaaaatgacacaaacatgttagtaaacaatttgtggaagacttgtacatacaaaataagacaatgacaaaaagcacaaaaatgtccattaatttgttgaataacagagaggcaaaaaaatgtgtgattatcagtgttgctgtgagtcagtgaaaacaccagtgcggccttttgtggtatgccggggtagatcactgacgggtacaacccgagtatatgaacatgaaagggacactgtttaataaaaatgtaataaccgatacaataaaggaattccttacacagatattcattatagtattgttttagattagtaaaaaattggaagaaatctacattggaaataagaaaactcagattctgttattaaggtaaattgtgaagttatattcaaaacaatatttttaaaaagtaaacactgaaaatatgtacacaagaatatttatgcagatgtagagctatatacagcatgattctaatctatagtattttaatatatctatgtatctatatattaaaaatatcattttctcccacaaaaaataagtatgtgagatggatatgttaattatcatgacatggtcattccacaatgtgtacatgtattgaaatatctcactgtacccaaatatatatacaattgtcaattaaaaacaattttcaaaatcctattttgaaaatttttattctgacttgatcattatacaatgtatatatgtgtcaaaacatcaccccataccccataaaaatatacaattgttatgagtcgattaaaaacaaaataaactaaaatttttacaaagaaaaaattttatagtaaatgtggtaggatttattttatacctttatttctccttttagttccatctatgtcttaaattatgtatagcactcacagatgtatttatagagtgaaaaagatgttttaaaaagataatatagttttaatcataagaaattattgacatgaattttttttgtcaccacgcagggccccctggtttgggcccaaacacagctgccccactctgggctgaccacacctattggtagcagctctgcatttctctgggatggggcccaagaaacatgtgaaaggccctcttccacaacactgccaggaccctgctcacactgcctccaggctgaggggaacataaagcctgagtcaccccagaggtgtggcctgtagcccaggagtaccaagctgagatctacagccagcactaaaggaggaagaggagcccacactttcagagcactgagagggagcaagcctgcaattgtgagaaaataggcccttgttcagccccacggctcctctatctaccggccattatgcttaagcaccatctactggatcacagcccaaacttcgacaccaaaaatactctaatatacctccccatgaaaccaaggccaagaactcagctatgagtaaagaccctgcacaaagccttgggccctctgaaaacatccagaagtcaactgactgtactcaagttacaccacagtgaaggggacatgagcccacacagatgagaaggaaccagtgcaagaactctggcaactcaaaaagccagagcatcttttctccaaacaaatgcactagctcccccaactagggttcttaagtagtctaaaatggttgaaatgacagaaataggattcagaatatagataggaatgaagaccatcaagattcgggagagagttgaaacccaatccaaagaatctaaggattacaataaaataatacaggagtgatcgatgaaatggccattataagaaccaaactgatctgtgagagctggaaaacacactacaagaatttcttaatacagttacaaatattaatagcagataggactaagctgaagaaaatctcagagcttgaagatgtactctaaactcagaaaaaattaaaaattaaaaagagtgaagaaaacatctgagaaatatggaattatgtaaagagaccaaatctatgatttatatggtatctctgaaacagagcgggagaagacaagcaatttaggagacacatttcaggaaattgtccatgaaaatttccccgatgttgttagagaggccaatattcaaattgagagcactgagagagaacacatttggtctcccctgtgagccctttgtcctcttgctcatcaccaggaagggcccccctggtttaggcccatgacacagctgtaacactctggatcaatcacacctattggtagcagctctgcatttctccatattcatgtggggtaaagtgtggttggtcggaggaaggtagacactctggcaactcaaaaagccagagttcttgcactggtttgttctcatctgtgtgggctcatatccctttaactgtggtgtaatttgagtacaattaacttttttctgcaagacacaacacaagaagtccatcactaagatacatagtcatcagattctcgaagatggaaaacaagaaaaatgttaaaggcagctagagaaatggggcaggtcacctacaaaggaaaccccataagctaacagcagatcctttagcagaaactctacaaaccagaagaggttgggggcctatgttcagcattcctaaagaaaagaattttcaaccacgtatttcatatccagccaaaggaagcttcataagcaaaggaaaaataagattcttttcagacaatgctaagggagttccttacaaccagacctgccttacaagaggtcctgaaaggagtgttaaatgtggaaagaaaagaccattaccagtcactaccaaaacacacttaaatacatagaccattgacactataaagcaaccacacaaacaagcctgcaaacaaacaaaaaaacacctaggaataggatgacaggatcaaatctacacatatcaatgttaatcttgaatgtaaacaagctaactgcctcaaagggcacagagtgggaagctggataaagaagattcaaaggtatgctgtcatcaaaagacccatttaacatgcaatgacaccaataggctcaaagtaaagggatggaaaaaaatctaccaagcaaatggaaacaaagaagcaagggtttcgattctagtttcaggcaaaacagacttcaaaccagcaaaggtcacaaaagacaaagatggccataatataatgctacaggtttccattcaacaagatctaactatcctagctatctatgcatacaacacagaagcacccaggttcatgaagcaagttcttaaagacctacaaagatactcagactcccatacaataataatgggagatttcagcatcccactgacagtattgaggcaaaaagctaacaaagagacttgagacctaaactcaacacttggccaaatggacctaatagacatcttcagaactctgaaccccaaaacagaatatacattcttctcacgtgtacacagcatatactccaaaattgaccaatcggacacaaaacaatcctcagcaacttaattataccaaccatattcttggaccacagtgcaataaatagagatcaatactaagaaaatcactcaaaacaaagttatatgaaaattaaatatgctaatggtgacctttttgtagacaacaaaattaaggcagaaatcaagaaattatttgaaactaatgagaacaaaggtaaaatataccagaatctctaggatgtagctaaagaagtgttgaggagtctgcaacactaaatatccacatgaaaaagtcagaaagacctaaaattaacaacctaacatcacacacttagaactagagaaacaaaagcaaaccaactccaaaactagcaaagaactaatcaaaatcagagcttaatgggaggaaattgagatgtgaaaaaccatacgaaagatcaacgaatccaggagttggtatttgaaaaacataaagagacaaatagaccactagatagactaagaaaaaagagaagctacaaataagtacaatcaggattgtcaaagagttcattaccagcaacctgacagaaacaccaaccaaagaaaaccctcagactactatgaacagctttatgctagagaatctagaagaaatcaatgaattcctggacacatacaacctctcaacattgaatcaggatgaaacagaatccctgaacagaccattaaaaagttctgaaattaaattcacaatagaaagcctgccaactacaaaaagtccaggaccagacagattcataactaaattctgcaagaggtacaaagaagagctcatatcattcctacagaaagtattccaaataattgaggagagacccctccctaacttattctataaggccagcatcatcctgatctcaaaacctggcagagacacacacacaaaaagaaaaacttcaggccagtatctttgattaacagatgcaaaaatcttcaacaaaatacaaatagaatctaacagcacatcaaaaagtttatccaccgtgaccaaagtaggattcatccctgggatgcaaggttggttcaacatcacatcacatagaattaaaaacaaaaaccaaatgattatctcaatgattcagaaaaggcttttgataaattttaactcccatgttaaaaactctcaattaaactagtcattgaagaaatatacctcaaaataacaaatgccttctatgaaaactccacagtgatcatactgaatgtgcaaaagctggaagcatttcccttaaaaaccagcacaagaaaaggatgccctctctcaccactcctattcaacatagtattggaagttctggccagagcaatcagcaagagaaggaaataaaagacatccaaataggaagaaaaaaacctcaaactatccctgcttgcagacaacatgatactatatctagtaaaccacatggtctctgtcccaaagctccttgatctgataaacaacttcagcaaagtttcaggatataaaatcaaggtacaaaactcagtagccttcctatgcactaacattcatgctgagagccaaatcaagaatgcaatctccttcataatagccacgaaaataaaatatctaggaatacagctaactggaggtgaaagatctctacaatgaaagttacaaaacactgctcaaagaaatgagagatgaaacaaatggaaaagcattacatgctcacgaataggaagaatcaataccatgaaaatggtcatcctgcccaaggcaatttccagattcagtgctattcacatataaaactacctatggaattcttcacagaattagaaaaaaatattttaaaattcacatggaaccaaaaaagagcccaaatagccaaggcaattctaagcaaaagaacaaagctggaggcatcacactacccaactttaaatcatgcaacagagctacagtaaccaaaacagcacagtactggtacaaaaacagatatatagaccaatgggacaaagtagagagcccagaaataatgacacacacctaaaaccatctgatcttcaacaaggtgaacaaaaacaagcaatagggaaagaactccgtgttcagtaaatgttgctaaaataactgtatagccgtaatgcaaaagattgaaactggaccccttccttatactacatagaaaagtcaactcaagattgattaaacccttaactgtaaaacctaaaaccataaaacatctggaaaataacctaagaaatatcattctagacataggacccagaaaagattttacggtgaagatggcaatagcaaggtcaagcaaggtcaacaaaagtgaaaactgacaaatgggatctaattagactaaacagcttttgcacagtgggcaaaggatattaacagatacttttccaaaaatgacttacatgcaggcaacaaggatataaaaaatgctcaatatcactaaccattagagaagtccaaatgaaaaccacaatgagataccatctcacacctgtcagtgtgtctattactaaaaagtaaaaaaataacagatactggttaggttgcagagaatagggaatgcttatacactcctgttgggaatgtaaattagttcagccattgtgaaagtagtttggcaatttctgaaagaacgtagaattaccttttgacccaaaggaatataaatcattctaccatgaagtcacacacacacacatatgttcttcacagcatcgttcataatagccaagaaatggaatcaacctaaatgcacatcaatggtagactgaatcaagaaaatactgtacatatacatcatggaatacatgcagccagaaaaaacaagatcttgttttttgtggcaatgttgatggagctagaggccactatactaagtaaactaacacaaacagaaaaccaaataccacatattttcacttatgagtgggagctaaacagagtacctatggacacaaagaataacagacccccccaccgggcctacttgagggtgtagggaggaaagtgaggactgaaaacctacctatcaggaactatgcttatcacttgggtggtgaaataatcagtgacatgcaacttacctatataacaaacctgcacatgtacccctcaacctgaaataaaagttggaaaaaaaactttaaaaaagagagaacgtctcaaggacaaatgctgttagaataaaactaccaatcccgaattgtaaacccagctatactatcattcaaaagtaagggtagttagacaggagaaataagtttagatctattgtataacatgatgattacagtttatatctacgtattatatatttattttcaaattgctagattttaaatactccaccactcaaaaattataggatgtgaagtaattgatatgttgattagcttgattttgtctttccaaaatgtgtatatatgtatatacatattaaaacattgggttgtacaccatatatacaattgtcaattaaaatataaacttaaaaatttgaaagaaaatggtaataaaaaattaaaaggattaaattaacaaaagatattttcaggccttttttgaaacataagtgtttaccactcagtgaagggactcttatgtttaaagcataaatacagaagaatcaagatgttgggagaaaaaacagcaacaaagttttggaagctggaaagccaaaggaaactgtttttgactcaaaaatctcaaagcagaacactgagctggtgagtggagaagttcggaagcaagttgattcctgctggaagaactcctaatcaggtctgtctaaatattacaggtaacattgaaatgggaggcttggctaaaagtttgtataaaaactgttatacacgcactttagttagacaacccttcctccccgacctgacgcgacactaacttgggaggtggtggtgtacccaaagggctctgggattggaaaacagacattgcgtgggtgtaagtgggaagtctgcaccctacattgtgaagcacaccagcacgtttccccaacgtgggttctcagaatgctggcagcccccagaaagatttgcagaggaagcagaccataccaaagaaaatacctaggaatactgacatttgaggtttccaaaataagtcatttacatcatagtttagtgactcctactcgttaaggcttgtccttatccagagactaacattaggagagagacagggattacaaaacttgaggaaagcttctaaaataaaaggcagaaatcacacaaatcagtgaaaataagaagaaatacagtatgcagtaattagagaaactctttctataaaagataactgactaatctgctatgacagataagaacatacaaacagatattaaactagaacagggtgttttaaacagagcattggagaaatttttaagagttcttgaacatttagattatggcagtgtagactgtaaagtaggacaagacagatgcaaaagaaggtagaagaagagatccagtttgtgagtcaggaggcaaatcaagtaataaaaattccagaggaaaagaatgttttagatggaaggaaagcacatatttcagtcatgtttcagagcaaaaattctggaattgaaagacacgtttcaagattaaaaggttcatcaattgcccaacataattgttaaaaagagcccttatgaagacattatgaatgtttaacacgactgccaaaggagagcctgaagcctccaggggacgacaacacaactaaaattgagagcatggaactcccaggagaaatactgaatgttagaagacaatggaggagggacatcctcatattcatgagggaaagcttttttcaacctacacattgacacctggccagatctactgtcaaagtgggaggataaaaaaagtcattttcaaacatgcaaggcctttaaaaaatttcctcccacgtactttgtttataaacctgttgaaagacatgctccacaatggggaggttttaaagtagaagacgtggtacacagacaatcaagaatccagagggtcatggggaagaggcagcatctcaggaggagccccgtgcagcgcagcccatctctggggcaagcagcctggatggaagcggcagagcaggggctgcagaagagggagggctgtgaagacggcaccgagaattcctgagggagtcacagtttcaacaggatatttatcagaaggagattctatatacatatatatatatacacacacacatacacatatatatagagattagtcagttttctttcatgtatacatatatatgtatatatacacacacacccatatatatgtatatacaaatacatatatctcctagctactggggaggctgaggtgggaggattgctagagaccaggagctcaatctctttcttgacccagctggtcaagaatgattaccaaccctcaaaacctgtcctgtccccactcagtcaccaaagtgattgtgactctgacttctgacatggtattctatcagtgtcaatcttccatctctgctctttagacctatctgcctctcagagcatgctcacaggagactgaaccacacaacctgcttgtgccccttagagtcctcttgtagcccagcttgccctctgcacttgctcttctgcatatcactgatggcagctagttttgggaccttgttcaccaagtcaggttttgagaggtgaagtcaaattttgttcataactactctaggctcttcattaatggctgggactctggaaataagctcattctgatggaaaggctaataaggaatctgttttctttttaaaaattcttttaatcttcccatttttgtgtcttttctctttactggtatttgaaatgcacatctttgtaaccaggtcacaagaatgattttgcttggattgtttggtggcctcagacatagggttcagaagcatctttcaatgtcattatctttttatcagatcttgaattgcttatttgttgtttgtgtatgtttatgtccatgggcactaatatgggttcttctcactacaaaaatcagggtccccttcctaaaattccggctaaatactaaagggttttaaaccaaaagtaaaattctaagcctccctcaaccatctgaatagggccctcgtctcagcaaaggcattccaaagttaacctgataaactagttcaggccatgataggaaggaagagcttgacatgcctcaggataccctccctcccttttggaattactgatagaacagattctttaagacttaagtctaattaaaaaacatttacaatcttctctctgaagcctgcttgttggaggcctcatctacaagatcaagtcttggtctccacaaacccttaccataaccagacatttctttctactgataaacaactctttcagctaattgccaatcagaaaatctttgaatctgcctctgacttagaaactcctgcttccaattgttgtgtgtttccaggtcaaaccactgtacatcttatacatgttgactgatgtcttatgtctccctaaaatgcgtaacaccaagttgtccggccacctcagacccgtgtttctcaggatcttctgagggtggttccatgggccattggtcactcatttggctcagaataaatcttaaaatacagggtttgacttttcatcgacagggtatacaatttatataattttcaatgaatagtaaaaattaaactgtagtatttaggaatatttatccagtcatgcaagaagaaatccagggaataattactatgaaattcatttggcaaaataactgaccaatattcttcgctgtcaaggcccaactaaagaaatgttagaaacttaactgaaatgagtgagaattgctcagtcaagtttcattaagccaatattagagtatgtctagaaaaataagccacagacacacccatggccatttttccaaagaggtttttagaacactcagtacgtatatattttcttaaggtgggggaaggcatataggaagacgggcgggttggtggtaaggtcaatggttacgtttctgtgagacttcagttagtgcccagtaaatgtacattttacacaggataaggtgaatgtctgaagagatagaaggagccaaggaagagtcaattatgcagaagtccctgggtaggtggaggaatgatttgtctcatccggtctttcttctgctcctggaaagaagcttgtcatcaacattatcagtgtgcaattgagcagacagaagagttcaagaccagcctggccaatatggtgaaaccctgtctctactaaaaatacaaaaaattagccaggcatggtggtgggtgcctgtaatcccagctacttgagaggctgtggcaggagaatcacttgaacccaggaggggaggttacactgagctgagatcatgccattgcactccagcgtgggcagcaagagcaaaactgtttcaaaataatgtcagcattaagagaaattgagtgacggccacattggaagctcattgtgctaattttgcacatttttgcatgtctaatagttcaaatgaaagttagagacatttagaataatgcctgtttttgccctggggcatgtgcggtgatcaaacaagagcgccctggagtgctggttatgttccgtttcttgatggggtgcggggttatttcatgaatggtttcacaactgttttcttgagatgattaataatgagttttgcatggcatttctagtgttatatttcatagtataagaagagattaacgctgatttataatgtgattttcttagaagccctgctgttgcctgcgtcattaagtggtgattcaattcactccctaaaattacaaagtggctggaattaaatatccccaagcaaagacttctttcctctatgttgtagcaaattcagtaacttttcaagttttaccaaataaagtgagggatattaactataatatttaaagctattaaattctatctataattacagaaatatatatggagaaacaaactttttggcaaattatttggcaataaataatcatagattcaaggtttttatacaattcattgtattttttccaattgattctggagggattacagagtaaaaataactgctaaaatgcagaaaatgtttaataacaaaaatgatgtcaccatcagtccaaaggtaccgatattattcatttttttttttttattctcctaatgatacatgcagttttaaagaatagagaacacatggtgttgttttaggataatgtcatattactaactggccacaaggtgtcaggaggaggatgtcatggtgtcccatagtaacaatcacttgggacttcatattcatgtatagatttcttcttcctgtacagatagatcagcaagccaagagaaagtggggagatatataaccatcttagacgcaatcgcaaatgtctcagtgcagtacctgaggtagaagctattcaacgaatcaaggaactcctgatgagagctttgcccagggaacccacagaagacggcttggctagatcactcaggcagagcccccatggcctgaaggagcaacagttgtaggcttagaaaatatctgctctaagaagcctcttcctcattcttcaactatgatagactctgagcaagatagtaaactatggcacagagaggttaggtaacatgctcagggcacacagcccagaaagaaataggctaatattcagactccagggggttcaagctccaagcatatggccttatcacccttaaattgcctttgaaattggcagatggggtggaaataattaaagaacagttaaatattcatggggaaaaaaccttataaaaagctgttcaacatctgaacaatctgttgctgggcatatatgctggtatcacacagtattttagtgaaatctgtgtgcccatctcctcttggtgccaactacaactaggacactcagagcagggacattttcccacgctaaatgggaacccatcaccagagaagccaccaccaaagccaagattacagagagaatgttttaggagtagggtggaatttaacttctaaacgtaaataattaacattttgaaatgaagtgacagtgtcaccttataatgcaaaatcatgccatattatacaagaaactccacaccatgaagaattctgcctatacaacttttaattgcccaaagagacaaatttattgaaataaacagctactgaacatctattacatactgcaaattatatgccttggaaaagcataaatatgacacactttattcacaaaggaataagtttgtagtagtaacagcagttgctgctgttattttgtccttgtttttaacataattctagttaacatattgagtgcctactattttctggccaccatcccgaacacacatcatgaatcgtctgacaaatgtgctgtgctaaattcataaattcaatgcaaaggagggggagtccgaaggttgtcctacaacccagatgtctctactagcttattaacttacctcttctccaagatgattctcttctcctctcaaacttttgacgggaccaccctgatctttactcatagacgctctcattgattctaactgcaccgagaagatacaaaccatcggaagggatcttagttataacacacgctctgcctgacctcctgctattgtcactgagttggccatgctcttacaaaagttcaaactctccacttctaaactggtttctgtgctttcggccactctcaaaggccatctttctgaaactttcctccatttctcatatatcgattttctttttgtactgaattattcctttgaacttcatactcaatatcacatgacagcaccattaacatcaaacacattggtatcacgtttttctagttatactccatttcctttacaaaaaaatctaaaaattcatactcaacttaccttatccacttcctcccccttgattttaccctgaatcatctctaagcatatctccattaaaaatggtcactaaggttacaagtaacctttcatgttgctaaatacagtaaccaaatctcacttatttcaaccatagactgcacttgttgcagttgcttttactttctttaaacactttgtcttagatttcttctaacctcataaaaccctatctttctaatttttcatgtgacgccagctgcctcagatctcagtctcaagctttctcttaagaaaactctcaaaaaacctgtttttaaatgctcttcgtactctgattattaaatgtatgctttatgttcagaactctaatctgaagtacaattgactttacatatagcttcaatatctttctgtatttatgtatttatcttgagacaaggcctctctgccagtcaggctggagcacagtggtgccatcacggctcactgcagcctcaacttctcagcctcccgtgatcctcccacctcagcctcccaagtagctgggactacaggcatgtgccaccacatccaactgatatttgtgtttttggtagatggggttttgctatgttggcaggctggtctcaaactcctgagctcaagcaatccaccctccttggtctccactaaagtgctgggagtacaggtatgagctactgcacccggcctagcttaaatacctaatagatatttccaaattatcttaagtgaattcttgacttctgctaccgacaagttttccaaatatcaatattccatttttttattcacttgggcccaaaccaataagttatccttcactctacacctgttgctaacacacgccaaatccatgagccaaatcctttgtgtccacaccctacacaagccatccttgtttctcatctctgaaacctcaattgtcttcctgtatccatgtttgccctttgttctattttcctacactgtaggcatagtgatgctttaaaaacgtgtctgttatcatgtaacacccgcatggaaaactccagggacttcccaccccactcagtcagtctcaaagtgccttaagtgttgctgttgaatcacagaacttggaaaagggaagtttctggccatggatgttaacgaacctggtatcctgttaatacatcctcaaggaaagtggcagtcatgttctttgatgctaagtgttagagtctattccctgtgagtagctgtgtcatgctgaacctccacccattcatactcagttctgttcaattcaccaccatttattgtggcctagtatttgatagctgctgtctgtactcaagagggtcagagattcaacgataatattagagcttatagttacttggggttaatactaaaataaaaaacacgactaaagtgtgtgcttttatcttctttgccacttgtgtattggcattcttttactctattgctgctaatcacagaatttgactgtaaacatttgatagcttttgcaggtttctttcattgtgttgtttaaacatgaacaaatgttgtgaaggagatctagttcagagtgaaaggttgctgtgaactctaatatttggggtttttcttccctaaataaaaagactagataaattatttaacttcataataaaccatttttgatacttcactgaaagatctctgcataacagtaaaacatctttcccttgctcccgaggagcaagaatccagacagggtgaatcatcttaactgccagtagtaagtgtaggttgatagctgagcagatcatctccagggaaacagggcaaatggaggaagtccttaggaagccttatcctctgggcagtgactctctaagcatcacttgttgctactttctgagcagatgagcaacatgcaaatacctttttaaatgcccctatgacgtccttgtttctgaggctgtagatgagaggattaagcatgggcgtgacaatggtatagaaggctgacactactttgtcctgctcgggggtgtggaaggactggggcagcacgtatgtgtagaaggcagccccatagaagatgctaactacagtcaagtgggaggaacaagtggtgaaggcctttttgcgaccttcagcagagggcatgcggtggatggttaacaagatgagggagtaggaagtggagatgatagagatggggatgagcaacatgaggacacagcagatgtacatcagagtttcatacaaggacgtgtctgcacaggccagtttcagaactgctgggatctcacagaaaaaatggttgatacttcgggagccacagtaagggacattcatggtgatgggagtgagcagaaagccatcgagggagcccccaaaccaggcaccagcagccagcaaaagacacttcttgcggttcatcaggactgggtatctcagagggttacagacagccacgtagcagtcataggccatgaggcccaggaggaagaactcagaaccaatcatggtcaggtagaggaagatctggatgccacaggccacaaaggaaatgatcttctctttagaaaccatgtctgccaggagttttgggacagtggtacagatgaaaagggtgtccatgatggacagctgactgagcagaaagtacatgggggtgtggaggcgagagtccacctgaatcaagaatatcatgaccaaatttgcagtcacggcccccaagaaaacagcaaggatcactgtaaatacaatcccggcagcctcactgttcaccagaagccccaggagggtgaagtcagaggatgatgtgttcgtcattgatatggcccacgagcgtcccagggcaacgggaagacacaaggaccaggaaggaggcaagagaacacggtcaagatgggaaaggtctgcagtagaggtgacacttctgagggtaccgtcaggatgaagcttccaggctagaggctagagaagaacaggcagaccaacatgcacatcatgaagcaaaaaccatggctgcatttccctgtcagagaacagctccttctatattgcgtctatggttcatcatgctgctggaggttatggtaactgcgtgatacaattgctgtatgctacaccaagaatggggttttaaccatatctgttctgtccatgctgcatttcttgtatccagaaagttatccagcccatagtagggttaagtaaatactagttggaaaaaagggtgattcattgaccaaatggataaaggggagtgaagtaaatcactgaagaaatgaagggttaggataactattagggaacgttttattcacgaagccccatgtttctgttctatttctttttaattatttgtataagtttaaggacgacaagtgcagtgtcatgacatggatgtatcgcatagtggagtcttgtcttttagggtaaccgtaagtcaaatagcgtaggttgtgctcacattactaatttctcacccctcgctccgctttcaccccctactcttccaagccttcgatgcctattattccactgtttatgtctaaagttgggactcctcactgttctttgtgctgttttgctaacctttttgcagatctttcttcagataaattagaaggtaaaaaaaactatttgcaaaaagctcccagaattaagtttttaaaaagcagtttatgacactaagctgactccctgcattgctctccattgctactgtaggtttgggaaatgggcagggaaattaaaggaaaatgttggtaggttgaagctatgtcagcagcagacacacaggagcagggttcaccaagctacacgtctgccagcacttaccagaactgaggccagagccaaactcaggcttagaaagctacggagcagatacatggaaatgtgacagcaacaggccaccgtttaagaaggaattttatctttaacataccaggtggaagatagatttaactgttagacaagagaaagaaccatacatgtagtaagaatcgcccccctctccccgccagcacctcctccccggcatggtaggcctcagtggcttgagtctcaaacatttgtgtaaaaatgaaagtccgatcaacgggggagcccggatgctgcagggtttccccccattcacatgttgctagacacaccttggctccactatctagtgttgccagatttagcaaagatacaggattctcagctatgtttgactttcagataatcaaaaaatgttttagtgcaagttcataatgttcttaacaccaaaaaaaagggttcactgtacatctgaaattcaaatttagctggttgtcctttaccatgctgaagtcatatctggtttcacaaaggtaccagaattgttatgaccttgaaaagtgaccagtagaatcagtacaaatagagtctaaacaaaaaagttatttactaacatcaaaattaaattggcttactcccaatttccctctgattgatatattcatattactgtgaaaggggctaaggactgtggcctcctctgtcaggcctcccagaaatactccgtggtcaaaactctacttcagtgagtcttagcctcctgatccactcctgatcgtttcaattctattccatttcccaaggatagtgaacacaaatattgcctaaaaatatattctgctaattcaaagtccaaaaatataaaagaaacattctatattagactccaaaaacttcctaatagaattaacccacactaaggagaagagagcacatctctttgtcatattaaacaaattcaaacattttatccaaaatgtataaaacagtaaaaacaggccaggtgtggtggttcatgcctgtaaccccagcacttagggaggccagggcggaaggatcacttgaagccaggagtttgagatgagcctgggtaacagagctcgtctttataaaaaactagccaggcgtggtggtgcacgtcagtcgtcccagctactcaggaggtcgagttgggagaattgcttgaggctaggagtttgaggttacagagagctatgattgtgccactgcactccagcctgggtgacagagcaagaccctgtttctaaaaaagaaatgaataagtaaaacttatttattaacaattaaaaacctataatatttctcatgtccatagctagtaggtgcctggcttaatccatcatgacacattttaccctggttgttccacgaactttcccacgatctccctgctgtctcatgaatccctccaagtctagtctcagcacaaccatcaaagtcacatcgggacccgtgcatcccgccacgccactttctgcttgaaaccctgcagttgtgctttacatcatacattaaggcccatcacgttctgaacattttgtcttctgaaatgatctcccgccgactccagtctgtctgtccctgggctgcagcgacggtggcttccttgtcctctgtccccactttgcaagagccctgagcccaggccattgcctctgctgctccccttgcctggggctcctcctccaaccgtgcaaggccatccatcccctcatgtacttcagggctttgctcaaaagccacctgctcagaggtcctatgactatttttcttcacttttcttaacaccgtctgacactaccttgtgttttgtgtctcttcaagctagaaagtaagcttcatgtgaataaggatttgtgcctattttgttaactgtactctcaccatctaaagatacgactggcacattgtaaatctttgaataaatcatttttaaacacattcagctagcaaaaatgcaaattattttatgctttttaaggaatacctctagaattccttcaaaacacctcctgattttatataatgtgctgaagagaaataattttttttaatgctaggcacttgtgtttatcttcaatgcaaaatagacaaaaaaatgggatccaccaatatttgatcaaaaaaaacttcattctaggaaaaataaataacaagtttctaagatcagacagcaatacaacttctaaatcattaaggtttatatacagtacaaatttgagacaattacgctctggtttaaaatacttatagagtaattaagatgtcagcataattcacaaaaaaaggagggacttgccacttcttctgtcttctgaatctgtccttgctctgacagctcttcaactcaggtaccaattaataggttgaagataactttagcttcaagtgttattatacacccagagattgtactgcagatgttaatctagttagaattcaccttatgttaaacagataaaattgtgtatgatttattgcaaaatgtcatctgccttctatgatcagaattgtcttcaataatgccatagggcttattaatttgctacttaaattgaacgacactgtaatagacttagtgttaaatataaccacatgtgggcagaatcatcttccacctccagcaaaggtcctcatgtgctaatgtctggaaccgatgaatatgctctcttaagtggcaaaaaagactttgtgggtatgattaagaactctgagatgaggagattcttctgaattatgctgttggactcaattgcaaatgccaaggccttacatgggagagaggaggaaggagagtcagagacgtgatatgaaaacaggtcggagggactcagtcggtctccgggtttgacgatagaggggaccccaagccaaggaatgtagatggtctctagaaactggagagggctaagaaatagattatctcctaaaacctcatagaaaagtaggtagccttcccaacatcgtgatttcagtccagtgagaccggtttccaacttctgacctccaggctgtgatattatgaactttgtggtcatttggtaccacagccatagggagcttctatgctgataaatgattttcttacttagcttttaaacaaaactgagacatgttgcaataatgaattggccagcacttgtgtagtgcttcttgctgggtctcaggcaccgtggacgtgtgccaacgtttccacgtgctcttcacagcacctcgacgggtcgatcactaattatcaccatctcacagctggtaaaactgaggctcagagtcaggtgggaggagctggatccaggctcaaggactcaacttttgtttttcatgctctctgccactacccttaacttctccccaaagataatatccctttgagcatcacttccgtttacaaccagccaaagagaagttaaatgaatgcagggtaaaaggccataaacacacccaaggaaaagttgaatttctgatcacaagttgtcaacaaagcaataaagtgacaacatgaagttaataattttccagaaacacaaaattctccctaactcttgggcaattctcagtcattacacacctgcctgcaggtgtctggctttatactgaggtacataaaaaaaatctcatcaaatgtaccccaagaaaggtcttacaaatgccactcacacacgtcactgttgtgcaattgcagagggcaatgactcatctcccagcagacatcataaagccccattcaataggcatgtttcctgcacagcatcaccgctgtcaacatgaagccctgtacgtactattccctgttggggatctgagatttgaagatctctgtaatgtggcagagttcacttaaggagaaaattccaatgtttctagcataaagaaaatacaaatatatatttaaggtaatggatatctcaattacattgatctttacaaatcatatgaatgtgttatcacatgtaccctaagaaaaagaaaaacagaatgacccttgaagaatcttaaaattacatgaaaaacaaattcatttcaaaagaaaaattacagaagtgtgaactgagtttaaatccttgtggaatcaattgaaatggtactagtgatcctatcaatgatttatgaaacaatgagttaaattatgataatttttttcaacataattgtcctcgtatcctatattttcctaggtactgaagacctctaatggacagatttttttaaaagataatttgaagggccaactgtgtagtcagactttatattcttatggtgatgtttacttttgttgtaacacactagatcactttcttagaagttccctaaagttgggggtttgggggaactaagttacaggagagtctccctgctgtggattggggacagttgagggaccatttctgaaatgattattcacaacttgagccagatcagattatctagacttcgttattgaactaaacatctttggaaaattaacgctgtttttggcctcttgccaatcaagcggtcttttcaggcctctcttaggtggagtcatgaaaacaactcatccctccctcttaatacatgtctatcactgcacagttagggtcacattcttcttactcttgcaaggcgatgaaatgcaatgacatgcacatctactcagctgggccttggattgccagaggcagagggcttgaacttaagtttattcttacctagagcatgatcccacgaagcttccttaataggatagcaatgtagaagggccacagtgcagaaatagagtttcagtcaatcttattcaacttgaacttctacatgagagctgggttgtatcaacatcgaggataaaggggggaatctcaaactgctggtgggaattacaatgggttttctgtcttgttttctggtttgagagcgtgcactgagtcaatgccaggagtttaaaaaatacgtacaagcttccgctcctagggaagtgtagtatggaaataatcagatgagtgggcaatttattaaaaaagtccattccggtgttatttgcaataagaaagtggaagtaacctaagcgtctgctaactggacatgtactaaataatttaggttttagtacataatagaattctaagtgaccactggaatgtgaggtgatctatgttcatcttcatcctatagcaggttcattgtattcttaagtgaaaaggtggcatattttcaacctatataatcatctccttacaactgtattctctatctttgaaatgaaatcccttaatacatacacagcatgtattataatcttgttcttagaaataatcaaaaaaggtaaagatttttacaatctttcaaattacacaaagccattatttgcaagcatccctgccttgggccaaaattatattatcctttctccctttcaagtagtttccccagtttatacagggagacagaaaagcagttctcttcattaaaacttcagctattcagaagctgaggcccaaagatatggttttaactatgttcaaacatgttttctgattttaatttttccaagtttatagaatacttcattaacatcactggtcatttcaattaaacactttggaaatccagggaaagaacaattttgacaacatcaactgacatatgtaatcctaaactttgcatttaaattttcagtcatgaaagagttttctgcttccacccttgagaaatgcccctaatgggacttacctcctgtttgcttcaaagaaggactatatgaagaatctagcaaaagccaatgactttttcacataagctccaattttaaaatagttaatagaaatcacttatcagtgaagctggaaataatttaagtagttttttggtgtttttttttttgcttctagcatcacccttgacatgcagttctatgtgagcctataaaagtctaactttgttaatcttcagtttccacgtcgtctcttcaaacccgagatgccaaggaaactttcttttaaagatttttagaaggtactaagccttctaaagtgaaagttttcattcgtttattacactagtatttattaagggcaaattctatgttaggaaaagttttaagtgcttgcgatgcctaacaattcttgtttttaggtatgtgatgatttaacaaaaccaaataagcttaaagtgctcataaaaaatacaatgtgaaacaaccagagttgaagctacaggtatttatttaccattttatattcttagctagttgtataaaccaaaggaatgtagtcaaagcaaaccaagtattttcctggcctttattacctgggatttagaaggaagcacacagtgaaatgctgctaagtgtgtgacatggtcacgggagtcacccaggtttaagaaatccatcctcagtacaatcccagctgaaaaagaagcttaaaaatgcatctggtttttatcatttgtgtgtgaatcagcctgttgttttaactaaataacctatcgatgccataaagttgtctatgaatacaattgctttatgtatggaacttctttgtagagtcaggacctgacgtttcagtcattttgttttcacagaattgtcagaattcttagcagaacttcacttcatttaaagtcagttgtccaacttgacagggatgttctgtcactttttcagatttttaatttttgtggatacagaggtctgcgtttttcctttatgctaaataattatctaattatcttcagtttctctgatcattcctttttgcctgatatcttcctgagcattgaataaagcagttaataaggtatgtaataagtagactttatgctttcttctattacaattttatattgcatatagatgtttattgtataaaacaagtctgtagaagcaagttaattttatatccatatcccttacctgcagaaagaccccacagggaatctgattacccctcaatgtgggtcatcaggtccttggctagaccagcctaactagcatccaacagcaaatgaacatggcttttatcagcatgttgctctgaagggacctttgtccccaggtcattattagggttaacaagctggcagatacacattgtgccatgtgcttctcccctttgttttgtttttgagacagtcttgctctgttgccaaggctggagtgcagtggcacaatcttgactcactgtaacctccactctgagttcaagcgattctcctgcctcacctaccaagtagctgggattacaggcatgtgccaccacgcccagttaattttttgtatttttagtagagacagggtttcgccatgttggccaggctggtctcgaactcctggcctcaagtgatccaactgcctcggcctcccaaagtgctgagattacaggcgtgagccaccatgcccagccacttctctcatttgtaaattgtttatcagtatcatggcttggcacaaaacaccagaccagaggttagaagacgtggttctgaagccccatctgcctcttgctggaatggggcaataatttgctgtgaacatcagcttcttcatctcccatggggctaattctttctctaaatactttataagaatttgtgaagatcagaatcaaaatcaggtaatgtagttaaatgttttcaaaactagggacagtcttctattttttcctcattacctggattagtgcatgccatgtttcaggtatacaactgataatttagtaacttaaatatgatgtgtattactcaatattaaaatttatatattattttaataaagaagcaaatctggtgaccacaaattaccttatgtaagaatttggtgagatgactggggaaaaatccttggtcactcccttttacagtgggactagttttatgtgtgaagggagtggatacacaccatgtgtaaaatgagattaaaatttttttttaagttgtattaaagtagagcctaacagaaaagcacacacatcaacagtggaaagattgataaatcaccaggaaaagaacacgttgatgtaaccaccatgaaatttgttgaatagactcaaacattgaataagtcacctccttccatgccccgatcactaatgtccatgatatccctagaaacttgtcaaaatgcatttcgcttattgcttcaggtatactcttgaaatgtctgtcaatgttagagttaaatattctagttaaatatgcaaagaattaatcttggaaacataagaataaaagtcctaatttttaatacatagcaactgaggaaatgggaaagaaaacacatatcccaggatagagcacaaatgcaatgtgaactgaaggagttttgtagagggaagatcgagaaggtgctagctaaggcaggagaatggagaatatggagggcattagtgcagagacacaaaagaataaaatgtgaatggagctgaattgaaataacaccgaggatatttcataaatgaatcctggtctgtttcttcacttaatccctccaggacattcttccatctcttttccatgtgtttgatttcagggtaaagatcaaattattaggaaccttctgaatgaaaagccacctaggggttagcatattgaagggaatattctttatctacgtcagcaacaatggaggaaacatttttccttctatctgtgttgacactagaacaacataaggctgagtaacctttgcttagtctttgtcaactatgtaaccgctctgtccaatgttttctaagcctcgtatcaacaaagaaaataaacaccaggtccgtcaatattttttatgtctcatatttcaggaccttacacacaggagaaactaaagttacatgaatcgtggggtcagtgtagtctttgcttagttaatattccaccaaagttacacatctatcaaagcaccacacctaactccaactaattacaaaaatacttgtcttcagcatatcaatgaagatgttgagaataagaaaattgagcaacttattccacgggaactaagttagctaataaaatgtcttggtttattcattctacatttatctattaacaatttgagcataaatggcagttttgtaggtttttggccatgtaacaatcttaatggcagagtcaattttcaatcaatgaatcaatatttccaggaatatattggactccatgtgaataaaggcagggcaagtatttaatttcagaggtaagtgataacattcataaaatgtaactaagaacatggaaccaaaaatagtatcaccttcctaaatgttttctaataaaattgctacacatttagcactagaaaatattttacttgtattgaatgtttgaaattaagtcatcaaggaggtggcaaatgctccttccaatttccattcaaaagttggtcagcaatacagacagacaggcaggactcatgatcacaggttaacaatagagacaggcaggactcaatcacgtgttagcaatacagacaggcaggacccatgatcacacgttagcaatacagacaggcaggacccatgatcacacgttagcaatacagacaggcaggactcatggtcacacgttagcaatacagacaggcaggactcatggtcacacattagcaatatagacaggaaggactcacgatcacacgttagcaatacagacacagaaggactcatcacacgttagcaatacagacaggcaggactcatgatcacacgtcagcaatacaggcaggcaggactcatgatcacacgttagcaatacagacaggaaggactcatggtcacatgttaacatgggcacttccaagagctgcttggcgtgccatgaatggtttgtagggctacttgactgagaatgccctctggaaatgtttgtgaatccagttgaacaaagttgactaatgcggagatgctcaccaacttcgctactgttcctaagtaatccttgcaacaggatgattttgcctgttaattttgaattgctgaaagtgacactgaacattcttcagaaccaataccatattttctgtaatagctgcgttattggccgcagcaccgcagatgtttgcactagtccctgctagtccttcctgatcagtcaccacccctgatgctctgggagtccccgctaatccttcccgatcacagtcaccactctgatactctgggagtccctgctagcccttcctgatcacagtcgccaccctgatgctctgggaggaaccacatctccctagtactttcctcagagctgcagccacatctttattcctcaagctgtagatgagtgggttgagcatgggggtgaggatggtgtagaaggcagacaccactttatctttctctggagtgtggtaggagtggggcagcacgttggtgtagaaggctgccccgtagaaaacgctcaccaccataatgtgggaggaacacgtagcaaaggctttgcgccggccctcagcagagttcatcctgtggacagtcaggaggatgtgcgtgtaggacacagagatgacagatagagggataagcagcatcagcacgcagcaggcatacatcagggtctcatagagtgacgtgtctgtgcaagacaacttcagcacggctgggatctcacagaaaaagtgattgatctctcgggatctacagaaggggaaactcatagtgacaggagtcagcatgaacccatccaaggaaccaccaacccaggagccgaccaccatgaataagcaaaccctgcggttcatgaggagagggtaccgtagagggttgcacacagccacatagcggtcataggccatgagacccagcaggaagaattcccctccaatcagggtcaggtagaagatttgaactgcacagcccaggaaggaaatggtcttgtccttggacaggaggtcctggagcatcttggggacagtgatacagatgtagatggtatccatgatggagagctggctgagcaagaagtacatgggtgtgtggaggcgggagtccatgtggatgagcagaatcatgaccaagttggctgttatagccaccacaaagatggagaagactactgcaaagagaagcccggggaaggcaggatgggtgatgaggcctgtgaggacgaagttagtggagttctggagaagaccctccatgcccatggtccatgacaagctccttgggctgtaaaggcagaaatctggcagcttatttaacgacctgatatgtaggaagagcccaccaggaatagtatgtcagaagcagcgtgagatcaagaaaagatcacctacttcaggatcatttgaaatcctgggtttcagtattaatgatctgtatgatattggacagaaaattaatctctcaactcaatttcatcatctgtgaaaggtcatcatagttctgtactctacaggctggatgtgagatgtaaatgtaattcatacagtacctggtttagaatctgatttttactttgaactatcttctgaatacatttcataatcttatcacttttagattgaaagttttctgagggtggttactgtgccttatttcccatttcgcctagcgaaatgatttgaatttaaattgctctctgcatctccatcgagatgattgtactagagtcatccacagacgtctatttgtgacttaaattgatagaaaacatctagataactgacttttttggctgctgttgttactgaacagctttatgaaagtcaggaacatcaaagcagtacagatgacctcatttggggtcaggagccacactgtcttgtggttagacttttgtcctgcaaaaggagttcatcttttaggcatggactgctgtgagaacttgtgtctatttgttctcacagaataatttggggatcataaatctggcaggacaaccaccacaaactgcttcagaacagggctttagtttcgttatcctggtggtctttccagttgacaatgaattctgctaaaatttagatgctgcatcatagaattcaatcatgacctcatcttaaaatattgtttagccaaaatgttagagtttctctgacagagtggcatcctgaacctgtcctaatattatatcatcctagtaatccactgctacttgggttttttcctcaagtttatttctctaccattttactgatccttcatgtttataagtaaaaataactacagtcgggtgcagtggctcccacccgtgatcctagcactttgggtggccgaggcaggcagatcacttgaggtcaggactttgagaccagcctggccaacatggtgaaacctcatctctactaaaaatacaaagattaatcgggcatggtggcaggtgcctgtacaatcccagctactcaggaggctgaggaaggagaatcgcttgaacttgagaggcggaggttgcagtgagctgagatcgtgccattgcactccagcctgggggacaagagtaagactttgtctcaaaaaacaaaacaagaaaacaaaaactatagatggtaaagaaatttctgaactcagacgcgacacagcagtatcaaacattccttgaatcaatggaatgaattctcatgcttttttgagtaatatgaatgtgtgtcccttttatatgttcaggaatactgagggatgaatttttctttattagattatggtgtatttcttctcattttagtgacaggattactgaagaaacttgttttctgtcaaacgttttggccaccaatactacaaatgtatctgaatcttttggttctagaatagtcaaaatttacagtccctgaagcatcaaggaataaactctccttatgttgaagcaaaaacaatagcaacagtagagttttccttcttagtgctcagagatggagatatgagtaataggcctaaaagatgaataaacatccaaagggagaaagaaaaaaaagcaatttttgtgttggtctgtgctgaaacttcagtttgtcacaccttggttgaggagaaaaaaatacatgagcatcaaatattaactcctgtcaagcgtgataaaagtcagctacttttgccttctctaacaggtgaaagattttcttgtgatagccacagcttcgaatcatgggtcaagagactatttaaatatacaattccatttgcagtggcttttgcaatagcttgttggaaattaaaaatattaatctcgcagacagtaagtttgtcttgacccacatctattgtttcagttaaatgcattatggatattatacattaattactatagtgttaggttagctgacaatcatccttttaaaaatatactttgaggaactgaaataggcaagaatgagacaaatgaaaatgacctaagaaaataaccaattacttttgaatcagaacatgaaccagagcattttgtttcatgtaaataatcagactccacaaggtattcaaagaggaggtaaaacactattgcctcaaatgtctatgataaaaggataagaacgttttcaacccctagatcttatcttactgtaggatcccagaagaggagagtaaaaaagctgaaacaggagaaagatatgattttagccacctcatttttatacaaccgagaccgtgttaaaaaaaaaaaaaaaaaggttccttgtgagtgtgagcgttgtgcgtacatgtgtgtgtagtgtgttcatatgtgagtgtgtgagcatggtatgtgtggtgtgtgcatctgtgagtgggtggggatatgtgtagggaaaaggccctgctaaagagcagaactacactgcttggcacaaacgagcaattcacccatttcaatgaagccaatatttagaaccaaatgtgacatgttcaaatgcatgcctaatgttattccataggctactgggcattgcaagtagacagggaaaatatctgcattatggacaaaacatgtcatcagttacttctgtttacatcggttccgagcatctacattttaacattagagttgatgctatttagcattacgacgtgtggtttgacttattcacacatacaagatcctagattccattccccatcagctcatctttccctcactatcatcattctccactctaagacacttaggttccccttcatcaactagtctttccaaaaaaaaaaaaaaaaaaagaaaaagaaaaagaaaaagcttttatttgcgtgatcaaagcttcaggctcttcaaggcggcgaatgatttctccccagtgcagattagaacataacccagaacccctgacccccaggaccagttataacatcacccagtgttgcaacataatcatctggcaggaatgggagggtgggaagatcaagccgagaggtggaggacaccaagcacaggagctccacatctgttatctgcacacttggggctgatggatgagggatgagtgagctcgccaagaggcatttattctacctgtggtctgccacatggagaagagggaaaggagaatctctgcagggtgccaggtgatcaaagctgtatgtttcaggacaacagccctggagttgttctgggagaagccatagaaatcaagaacaattggtgactcaccgaaaattgaagagatctccaagagaagtcacaggttcttctaccagggagaagagcttagagcaattcattctgacacccctttctgggaattcagcatgactagagctatgagaagtatctgccagtgtcctttctgtggcaataaagctgctaaccagaactgatcttctccacttgacacaacgtacctgtaaagcttgaaagggaagggttttccattccatccttagagacagaatgcctgaagcacaaacacattccgtgttcaaaacactcacctagcactgggtgagctatgaagattgatagaactgacaatattcttaaggggcacatagttaagtttgattaatgtatcatatcaaaaatcctcatagaagcagatcattttaagtctaaagtggggatttctaaaaatgaaaatatattggggactttttaaaggtgtttagccacaaataacagctaatgccattgtgctttgctcagctgtcaaattgctctggggatgacacgcatagttacttctccagacctcagtgttctttcagtaaaagaatggcatgtcaccaacatgttactaatcctaagtgccacatagctctaagagtcatcgattatttgttcctgaatgagaaaaagggggccaaggatagtatattgggatctttctgctttgattaaagcttatgagagaagataatggtgtggaaggcactaagagacggaggaagagaaacaggaagtttggtattccccaaaccataaaccaatagggctttacgtgtgccaggtactttagaagttttacatacatgaagtcatagcaaaccagaagatgctatgcatcagtttgagtagtggacaaaggtacagtttccccttatcagtgggagacagttttcaagacccccactggatatctggaactgcagacagtactgagccctatatatataccatattttatcccatgcatacatacctatgatcaagttgaatttataagttaggcacagtaagagattaacaataataaaatagaatacctaagacaatatactgtggctataactttttcagtttgatgtgacagcaaaacttgcataattttttccttcatgatttcaaagataaagtttttcttaatatagatcttggcaaagtcagcttatgagggtttctctctccttaagtcaagaactttcacctttttagttaaagcaagcaccttacagcctctctttggcacatctaaatcgccagcttcactaactccatctctttggggccattaagaaaaactgagttacttgaacacaagcactgagtccgccacagtcgatttgataacctagacagctactgaatgactcggggtagcatagacagtgtgaatcaactacacagagggatgatatttccaccacactactcaaaatggtgggcaatttaaaatttgagatttttcatttaatattttttacacatggtagatagcaacctggcggattgcaggttaactaaaactatggaaatgaaagtgttaaagagaggaataccatgtcagaattctttacctcaaaggttcaaccctagggctagagactgaaaggatcttaaagcatgaaacttttgaagagcatctaagtgatcactgctttgaaaatagtggatcacaagaaccaggagaagacaggagtcagttcagttaaacagtgcaatagtagagagggaaaccggtctgattccgaaactcgagactgaaggagagaggacatgatcagagacaatgtaaataatgtcaaaaggctcgaaaatgggaattagcaggcactaggggtggaagagagaggggagagtccagtctaactacagctgaagagcccgtggagagctgaggtgtgtggggtggagtgcggctggaaagtgaaggcagagagaccagaactcagcgtcgagaaataaggtgcaaatgggagttgtttcagtcagaaagttacatgctgaaataaggtacttatgaaagatccacctggcagttttagtcttgaaagcaagattaatattaattgctactcataagtgttcatagccacagtgggctttggccaggaactccttttcttcttctacctacacaagctactcctgtactccgtctgcttttatgaatgaatgcatttggaccttgcttcctacattaatcagattttatccccttctctccacagcaacgtagtatccaatgatgtgaatttctcttttcccttaccttatctccagttctaattacatactgccttagttaccacccccctttatctgcctatttaaatggtaactgttttcattcgtggaaaagtagtctactttccctcccatcccaactgacaatttggaaattttcagtgtggaaagttaggcataagatagaagaggtttgcttggcttaaaaaaaaaacaaaacaaaatcagcactataatggcatgtaggtgaacatttattgaacacttactatgccagaaattagttcagtttgatgaatacaggttttaatgctacatgccaacttacctaaactacattgtcaaggatatcaccaatggactagaaagaaagaagtacatctagtttcctggagcattgagagtaaaaggtctaaattccaagctgccagcaggagggctgtgatgtggatgtgcaggggaatgcttctgggcagcagtgtcagttcgtgtggtggcaaatagaaatcaaaggatctggcatatggcccatccagtccaccctgctaacgctgtggaagaggaaatggagagtgagggcatggaggattacacaggagcagcagtggtgaggtgagatgaggtgaggcgagctgaggttggcccatctagtccaccctactaacgctatggaagaggaaatggagagtgagggcatggaggattacacaggaacagcagtggtgaggtgaggtgagctgaagcaaggggcagacacctgcagctataaacacaatgcactcattattatacccctacagtctgagcttccaacatgtccacatctccccctaggctccagttactcagctcaacaggcttttatatgccatgctaagatggcttctacgagacctctaatagttttattaaaaaaaaaaagattatcttaaggcacacgtggatgccttatgggttaaataaaagaggaaggaggttaaaatgaaataaagaataaaatcataatttccctccaagcatgaagtcttcagccacacctaaatgcatatgaacggaacaatcatttaacttaaaatgtaaattaaaattttaacaagatattcagagggcaatctatgcttatccaatagtatgcacccctgctaccaattaagtctgaaactttctcattgtgaataccaagcacattcttccaactgtcggctcttacatgccattttccttcagtaaatctattcatgttcttctgaactattagatttcccttagcttcccacgtttcatactaaatgcccttttccagttgtctgcttgccagatagtgaatatatgttatttatgcttaatcttgagaagaccactgcctcagttattagcagataagctcacagtagtaacgtggccttctaatagttacagagtaatacctgaagaaaacatcccagtatctgggtgatgttctgtttttcatgaagatctaaggatcctacctcagaagctgggtccaagtctttctaaagcagtagtggaatgtcagacttcttaaatacattgtgtaggggtgaggctaggtcaaaaagtcttttcactaagagtcccacatcccccaggaagaattcctgggttagcaattaatccaagttgactgggtttaccatgaactttagaagcagcctgtcctttcttgcagagggtgcattgttttcccaagtgaaggactggaatcgtttcttggtatttcatcatgaaaatgtcttactgaatcttggcatctctccagagagattttaaaggcagtgatgtggggataagagcctcgctctaaattgaaaattagattttaaatttctttagaaatagaggctatgacaaactaaaaaagctctttctcaaaagtcactagcctcttttgtttggggagaaatctttaaagttataaataagtgtgaatcaaaaagcattggagccaagtctcaatcaatgtagatgtttctggtgccaaggttgaggatgcacctgggaaaaaggaacacaagatgacaggagcatctgagatttgtgcttcttccaaagacggttgggagacttcaatatttaaaagggaaacagtgggcattagaggaaaaaagaaaaaggaagtgtgaataaatgaagtagtttccttctttccaggctttaatcagtgttgactgaattcgcactttagatgtgacaggagagggtttagaggaacactcaactgggcgttcatctcctgctcagtgaatctggattgtatataagataaggtgcacaatagaggaagcagtcaaatatgcatttgtttcaggggagtggagggatgactcccaggcctgtctactgcctgtcaagataagccattcatttacattgtcagcatgacattcaacagaatggttttcagggaaagatctttgggccagccaggaatttccttgctagcagattgtgagggaggtcccttggggaggtatgtagcctacctgtgtagctgtccattcaggaacagtatggaatctgtagccatacagtcaggtacagatatggaatatagttttgcatgacagagttcccaagcttgacttttccctttggcttagtgagtttgggtcccaagagattttccttctactttctcctatcttctattttcacaaaagtggcatttgtcacttaggttaagtgtttttcagaattatttgtcttacgtgtactacagaatattgaattcagtacgaataaaggagacataagaaaaatgatggaaataatgcaattggtagagaagaaaaaagtgagggtaatacaagttatgcattttctaaagttttcaccagagcacattaagatatttaaacattaggaaaattgaacttcctaacatttattttactaatggggaaaagaaggtggtcttattactaaatttttgcttcccaatcatcattgaatgcttttcatgcattaagtcagctaatgggcacattacttatgatttctagtcatcacaaatccattggacacatattttataccctctgttgcaggtaatcagaaaaccctatacctttttcagcctttagaatgtgattcaataattcctgaagaatattttatatgtcatccataaataaagttctccaactattggattgattggatacacttccctctggtgtgatgtgtctttctccagagccacaaatgggttacaaccaatattgatcctctcaaccctggattggtcttcagtgcccgatttggctacagccacaggggagttgattttgctgtcaacagccacatcagttttcctcaaggtgccatatcactaatttttatagttatgtcatgaaagcatttgagaagtgctgctgtatcagttgggaaaattgttaatacaagcccaacctaaggaaaaaataacagacctgtgaacagtgtattgattggtattagtttctaactcctgttcatgtgtcacaatactttgtctagtgttgaacttagttatatgatttagactttttacaagaggtattttgtggtgtcttaatcttccatgtttcttattcaccttttttctcttttccttccctttaactctcttcaggaagtaatccttttatatcatcagtaggtatagacttggttgctacaagccaagactgactcccacagtttggagtttagattctgttttaatttcagataattctgcctgcccactctcactccattccaaagtgccacttgacatttttgggtgaatctgtatttggcaaaaccttgctagctcctataagacttaatttttaagtgttctatatttctaaagatattggccctctgctcatgtctctgaaaaacagactattaattcattttcacactgctataaaacacccaagactgggtaatttatgaagaggttaagtgggctcagttccacatggctggggaggcctcacagccaatggtggaaggtgaaggagaagcaaaggcatgtcttacatggcagcaggcaagactcatgtgcaggggaaccaccctttgtaaaaccatcagatctcgtgagacttattcatcatgagaacagcatgggaaaaacccacccccaggattcaattaactcccaccaggcccctcccactacacatggggattataggagctacaattcaagatgatatttgggtggggaaacagccaaaccattatcagagacacattctaataagttcttaactggaggttctggcaagaaaaaaagatatgctgagattgccaagatctacagtaagaatgaatcttctttgaaattgtgtaggaggaaaaacacatttgtggtaattttgctgtcacacctcaaactgcaaaacctacagccacagtgtgtgataagtgcttaggtaagaaagaaaatgtattacatttatggtagaagatgagcaaatatgttgtgactgacagcagtcaggttctatagttctatactatggtttcaggcttcccccaaaaaagacttagaacacagcctgaggataagatggtgactgctatatttgaaatatgataaatatttgagttgattctttataatggtcaatggacagactgtctaaaggggaaaagtcgagagaagtcagggaagtagttgaagatgaccgtttttgtcatgactgagcagagccagaaacaggctactccatgatttttagtggaatacacaccttgttaagagctcatgggtgactactaaacctcaactttatgcctaccccagcccaaactgttcattgttcagagccttcatacctttcaaaaaaatgaaatccttaaaatcccaggcagctttccaaatcccataaatgccccacagttggtggcatgtgggtcacttgtttccaggcagagaatatttaaattcaagggcaatgataaagtcttgtatccttcatttcaagtctctagcagcatatgaaatttctttagaaagtggttacctttcctgaggacacacacctccccacaaccttctgtagggcccctgtgacatccttgttcctaaggctgtaaatgagtggattgagcatgggagtaaggatggtgtagaaggcagatacagctttgtcctgctcaggggtgtggtaagaatgaggcagcacgtatgtgtacatggcagccccatagaagaggctgacaaccaccatgtgtgaggagcaggtggccacagcctttcccctcccctctgcctcgctcatcctataaacagtaatgagaattcttgtgtaagagcccgagatgacagagaaagggatgaggagcatcataatacagcagacatacatggctgtctcgtaggctgatgtgtccgtgcaggagagcttcagaagggcaggcacctcgcagaagaagtggttgatctcccgagaggcacagaaggggaactgcatggtgacgggggtgagcaagaaaccatcgatagaccctcccagccaggctgccgccacaatcaaccagcagatcttgcggctcatgaggacaggatagtgcagagggttgcagatggctacgtagcgatcataggacatgagtcctaggaggaagaactcagcccctgctaaggtcaagtagaggaagtgttgggcagtgcatccagcaaaggaaatggctctctggctcatcacctggtcgaccagcattttgggcacaatggtggaaatatacaggatgtccctgagggagagctggctgagcaggaagtacatgggggtgtggaggcgggagtctatgtggatgagaatgatcttgaccacgttgctggctatggaggtcaaaaagaccaggagaatgagggcaaagagaagccaggggaaacgggcgttgctgaacaaacccagaaggataaagtcggcatacacggaataattgctctgctccatagctctgtagggtacacaaaagagatatgacaaagttggaaaggtatctgatttacataaaacattatgatgtagtcatgaacaaaccaaggtcaagtcgatcttatttcttgaagctcataatttccctgagagaactgcctgagcaggattgtgctacatctcattataccatcattgttcatttaaggattttcttgatttggtgattactatttagagttcatgatcaaacaatctttttgttcatgaccatttatttctgtctttcgagtaccaccttacattggtgaggatgcatataagacataagaatggaaccagcctgattcaataggatagggtggtggggaggaaaggaggattgtccacatcctacactgctctccttatactagactctaagttctcacacttagaatccagtttgaagatcaccacgagtatatatttgcctatggaagaataactgcattatttgacctaatttacaccattcttgacacacttgtacattgtaaaatgagtactcaacttacatgtatcaggtggagtattgcagaatgagcctgtgttgaataaaaagagctgagttctgagaagtcatccaagaattcataggaggaaaaatcatgggagaaaacgttgagggtcaagtggtgtttgctttccttcttgcagcagcaaactaccaattattaacatacaactcgttaaagtgttagaatcccatttaacttatgaaaaaataaactagtttaagtattagacctagtgtatcccaaaaagaagggatctctcatacttgaagttagattctgcatatgtatccatatcagttaaatattttaccacaatttaggaacacttgagttatttggatagcttctccctgcatcatatagatctgcactatccagggtggtagccatgaggcttatgaagctgtggagcccctgaaacacgactgctccaaatcaagatgtgccatgagcacaaagttaattcaaacacctgttaaaaatatatgcaacacatctccttaaaactttatattatggtaacttttagatatatttggataatatagattaaaattagtttcacctattttttacatttttaatgtggttactagaaaatttagaattctctgtggctcccctaggatttctactaggcagcactggtctagagttatccctgagaatatgacagctccaaataccttcatccaaacaagtcctccagagttaaacacaccacaaattagaattgagccaaaaaatttaggtgtgtaccaaattagaaaaatggctttacttgtatatgcattcaccctcaaatagcagtaagaacattaataagtgattcgtaaattttacgtttccaaacaactttgtaagatactagaccattctacagttgaaaattaggcttaaggaaacttccccaaggaggaacattgttctttaaacagtgacagtgtaattgttctatgctgttttccaacaggacaaagtagacatcaattcattccataaatatttctcaagaggcacattgggtaagccaaagtttgatattctgaaaggccctgaaagaatgtaagacatcatctgtcttcgagcctagaattgaggcacatgaacgtgtgttgtgtgaccacaggtgcactttcagaatggttttaagacctcagcaggtttgacttatttggtatgtgaacaaaggacaataaaaatgatggaagctgcagcccactggctggtagacaggaacttcacaccagggcccctcagtacaattccaccacaaccatgccacagtggatggatggaaaacgatgaaaattcagatttttactgatgaaacccacattatatccttatgcatttttcagttctcattcttgaaatattaccagctttatgccagagctttccatcagctgatttataatgtatctttattattttaaaaactgttaaaccagtgggaaaattaaaggcaaacatttagtagcaattcgtatgatggagagtgctgaatgctcacccagacctggttgtccataatttaataagaacaagatccttggagggccgtgcttgttatttcacagtaaattcagagaatgatggctacctactggggaccagccacagtgactgctattggtccactgggaatattaaagcccaagatgaaaaaattggtccaaaaatatccttatcagggcagctgtgtcctgaaccctgaccatgaatactcctggccctgaaacttgctaatgagaccctggggatctccccagcttacttcacaaagggaaaggggagatatgagtggctccataaccactcagattttacaaccatcttccaactctggtagtgttgattcattcactgtattttaagagttacccagtatagcaacatttaagaatacttggaaaataaaggaatcaactggattatgccatgccccatgtaataactgtctatgcataattccaaaccttagtaaacgtccagttctatgtatacctaataattagcacatctttcccagtctttatagagaatattgctgtgattgaatatgagacactcagcttggttcacattcacgttgttgagtttgcttataatgcaagtattgtgaggtgaattctctggcataattcatggacaacggtttactatgctttagaagcttatcaccaagttgttaaatgcttaacagtaagagaacacacttgcggcagcatcatgcttgccccagcatttagcactagtatcaaaactcacaatatggatttgattatgaaaaaaattgaacatagtgtatattttggctattttgatttttcatgaccttttctatatataggtgatttgtcgagattagtctatagatttttattttttattaatattcttttgttctatttagtgcagctattttgccccccgagttacatacatgtaattgtaactttgatgtttaggccaaaaagttttgaaatatttcagacattttcattctgtgtgctggatttttgaaaaaaatattttccatcgaggtatgtgattaatatacaatttaaaatttttaatgtaatttctatgcacttaaaatctttggtctagacattaaaactatgcaaccattggtttatgagatcaacaatgataaatttgtactttaagatcatgccagtgaattctatctaattggagttcttcaaataagcaggagttcaagtgtgaatgatgagcaggaatgacctaagtaacaaggagaactgttggaaatgtgggaacactgtcatgggtaaaattagttttcacccttgttgcatgtacaaattctggtataaaaagcgagtactaaaaatgagtgccaggttaaccttaagactgtgatagcgacagttagctttgggaatctcaccctttgctgtccattatgtttttctcttcaatagcaggtccagcagcaggtagccaagttttctactttttcatttttgttgtcgttctgtcagaccctgctctgcatcaaagattggcacaattcttggtgaccatctaactcagaatacgtttgagtgctaaaaggctaagctagacaggacatgaggacaacaggcataagaaagggaatatcttgagaagacagggctaaatggtgaccctgactataagacatttaattctctgtacaatcagattcattatgtttcctccccagcagtattttcacatgaagtgtcacttctagaaaatggcttttcttccacaactaaagtaaaatcacttggggaatctttagaacgatagagaagttttgattaaggccgagggattgtcttgaagcagaccaagggcatgatcaccttcagtctctacagaagttgaactgagttcttcccctgtctattcctaacccttgaaacattcttggcatgtttaatgttcacaatgctacatgacatggtttttaatcaaagctggctttatattctatcttcatcactgataagcttctggacgtctggcaagccactcacattcttttcagcttctgggaacttctaagtattaagtatgctgcaatggtttctcggagcaggatatggagggtcttcctaactaaaccatttttagagatgcttatgaggtacctaaacaaggtggaatactacgatttagataagctctttatgaagattttaaaattataggtgaatatatgttgcaatgataaaatctgttggaatcattatgcagacagatctgcatagaattcaagtaatctgctacattctgatgtacagaaaagataagagtccataactactaagaaacgagattgaattatctaagatttatatattagtaccatccacaagtatctgcagttcaaagtcagatgtatcaacttcaacattctccagtatttctctggtttgaaccaaaactttctaggaagtccagaatctatttaaagcatcctgcgattgatcagcatcaagactgcaaacttaccttacacagtatcttccccaaacacgatgatctgaatatttagagagaaaccttacagaactaaggtagtacatgcaattgttcagcatttccttttatgtagtaagtatggggaactaagaggcatacatcagactttctaaactggaggtattctatgttctgtatttcaaacttgttttctgaactgaaacagtacaggcagggagagtatgaattcaaacaagaaggtacagtggattaggcgtgggaattacatcttgttggcagaaggataagggtcagtccctaacttattgagactttttaaaatacagtgataggtgaatcctttgaagatctagaaatagaacagcctgaatctgtaaatgcctaacgtcagttgacagcagctgcattatgcaggctgttaagaagatagagatccagtgacaaatagagcttgcatcatggtgatggctagtactcccattcaggagatacattgacatcactgtctctggggtccttgtccctagcctgcaattacagttcatataaaatgtgacagactccttaagaaaaatgtaacctctcaatttacaaagtaaacacccaagataagtcaggttgctggcagctgcaacttaaattgcttttttctcttttactttgttcacgacattgttttgaaagtttctctttttacacttccaactttcgggcatctctcttgaaatagaaatcaatgtttctaaggaagtattgtcttgcaaaagatacattttgggccattccccatcactcaagtattagtatgtaatcatcctgtctttcttgtaacttgtaatacataaaactttcagcattgcaagcatttaaaaatattcattttactgatctcagtgtatataagatctttgagttacttcaagaagacagaccttttctcatccagtattctcaaaagggcccacaacgattcctggggggagcggggaagggtgggggggaattttagaccctgcagtcttgttgtgctgcaatctatgcctgcatgatcttggctttcatgtaattcatatttacctcactggtgtttaaattagtgggggttggaattcaggttttctgaggctgaagcttatgcaatctggggcatcttaagaaaacaggctacaaatcatgattgcacaggtataatattctcttcagtgaaactccaacaaaattacacctttagaaagctgacaaaataccacaaagaaatacataaacaccccaacttaaatcttaactggttgaacttaccacttaccattttttccaacaactggctacattactatgtactctaatattttctataagcaagaagagatgattcaatcctagtacggttggttgaaatttttaaattttttggtagtttagaaaattctttgggtctttcccctttgttcaggattgaggtccaatctgagaaagccactgttaaattactttcatatatgacctgccttagcttccccaaaaattgaccttagaaaatatttgaaactgagaaaaatgattcagagcagtctgaagaatgtgagctttaccaaacgtcttaggctcagagacacgagcatgagaattcaataacttccctacccagccctgctcacacatgcgcacctggggttgtttaaaggaattttatacttccccccgctcccccgaagtttccagactagctgataagttacctaaaatgttacaagttgtacaatatgacctttaccaaccatcttcatgttccctacagagaatagtgtatagctgatcaatagctacaaaagaacaatgtctagttgatcaatagtttatgtcagcttagaacttctcttttcccttagaggccccattataactgctgttagttggagcatttatttaaggctactagaatctgtctcctcagattgcatttcccaatcttggtccaaatatacgtgttaactttgcctcaagttttttcctttaggttgatacaaccatcaccaccatccatctccaggactttttcctcatcccaaacaaatcttctgtacccattaaacattaactctattttctccttttcctcatctctggggtaaggtgtattctgtttctgtggattttcctcttctaggtactgtagcaaacctgtacaattgctacttgagacggtcactaccgcagttactgttactgcttgagatgctcattacagggctgagcgaagggagggaggtagaagtggggggaaaacactgttcgaaggctaagctcggggaagaagagctcccagcttctagtgagcaagggcagccgccccagcttctcagccctccgcatggatcgagtaggagcagggaggaggacgcacgattgatcagctgcgtgattgatcgcaggtgcacatggttgcgatcggaccttcccacgcacctaatgacacactcgtgcctgcgcgtgacgccctccgctccacctccgcgcggaaacgcagtctctcagtttgccaacattctgcatttgtgagaagcagttttgctgcttactcgtccggcctccagtggtaaaccgagccgatcgcgaccctcgccctttctgcctccaacccttttttaaattatgtctgtccctgtattatgggggttgaggtcagcgggactgcggtcggccctcggtcccgagggcacccacacggttcatctcctgtaaagacacaggcatgtcctgtccccacgttagtaactctacaaaagcaaaaagctttctggggctgcagccgggagccaggccattgctgaggcctccgctccacaagctgcggcgcagcttctgcctcttggcctaattgctgcggggtaaaactttccgttgatagtgaaagcagctttttctgatgaacagaaggcacagagaaaacaagttgaggcttatccttctcgtgcaacagtgtagcaaaaaagcaatccttaaaccttccatttgcacttacacaggcgggtctattagatgctgtgggttgtgatagctttctcccagctgtacttccaaatgcctgacctcctcgcttcttacgtagagaagggtacaatttacaggggatgagcaacagctgcgcaatatattctcctgcttcaaaacccagagatcttgggacatgaccgctacctgaatttctccataagccgaagaactcctgggacttcagtaatgccccgcaagttaagatgacttttgcctaaaattaatcccacctatcctgttggcaaaggtccccaaacgccagtgtgagtcaggttgctttccccccaaagccggttgctttcccctaaacccgttcgtttgggagatctaatcctgtgcttcctactgcgtgaggagggggagtcaaagcacctccagaaacccccctgaaacggagttgtggcctggactggggaagtccttgttcgaggtgcccaggtccaggcccgcttctggtttccccacagggagtgccgttctggtcaaatatagagtagcattgattagcctagtgatttcccttatttcaacgacggcaaagtcctggcactttttctgttgagaactgttttaagaccccttctgcccagaggtctgacggcattctcttttgcaacgtccaattctctacacttacaacttttccactctagggctcaacccttggctccttttagatctgtcaactaccaaaattagctgttgcctgaatcaacattataaagtagtgaagctcagttcccacatcttgaaaaactacgaaaacctcctgaactttctgcacacctcacaggtgccactgcacgttcccaatccacatttgtagcctcaataagccatagtcaaagtgagcatttctgtagccacaaaagatgctgccagccagttttcattctccctcttgtctaccacttttgataggtgctctaagtggggcaaaacagtctctccggccctgaaataacggaaaaggtatgtaccaaactccaaatgaaagaaaaaaataaccaaattcttccccatgctaccctgattcaaaaacttcccgttcttcaaacctctggggcactgacaagtacctttttagagcactagccttatgttgctgctggctgacttgtaatggggtttctcgtttgtctggctagttttagcttctgttccagcagaccttcctcgttcaagtctctataggaacctgtctgtccctgcaagtttctgctagtctctgctagtctttatctatccctatctgtccccatggtccctgttagttcctgcaagttcctgtctttccctacctatactctgtctttctctctatccctgctgatctatttatccctccaggcctcttcaggtctgtacttgtccctagatgcccctgttcaggcaacacttgtgacagacttgtacaattactacttgaaaccatcattacaggactgaatgaagaaatgaatgtagaaatagtaacaaaagacagaagaaaacggttttaaggaaaggctcgcttaggggaagaagagagatcccagctcctagtcagtaaaggcagccgcccgaacttctcagccctccgtatttattgggtagaaagagcagggaggaggacgtcacgattggtcaactacttgattgattacaggttcacatcattgctatcagactttcagacgtacctaataataacaaacacttgtgcctggggcgtgaccgccctcagcataacctctgtgtggcaaacgcagtttgtcagtttgccaacattctgcatttatgagaagcagttttgctgcttactcacccagcctccagtggggtactcagttgatcacgaccctcactctttcggcctccaacagggtacctcaaatgagtagaatcatacaatatctgcctttatacttacttcacttcattttcagggttcatccatgtggcagtaaatatcagagtttcattccttttgaaggcggaatagtatcacattgcttgtatatatcacattttgctcatttatttgtctattgatggacacaacattttggctaccgtaaataatggagctatgaacattgttgtacaattttctgagttcatgattttaattcttttaaatttcaaaaataattttgaaattcttttgaatggtatcttcaataagttgagacacatacatttgttgtgtaagtcactgagattttggggtgttgtaagtaagtcctatgaaggactcagtgtgagcagactggtgcactgttctcccttttcatggatgcataggaatatggtcagggctagaatgacaacacactggctatttaccttgaaagactttaacataataataaagggagtttaaaaaggaactgattgtttgagatactgaagaaatagaaatagattcagagattaatgaagatagatacttagagccagaactacagttagaaacagagatatagattcaatgttctctctctcccaagatagacagatagctagatagatagccggaggatatgaatacaatttggcaagctgattcttaaaaagatgatcaaagagccaagaatagcagccaagataatgttaaataagaacaacgcagataaatggtcatgccagaaattcagacttactttcaagttaaaccgttaaacagtatacaactcacacatcacaagacaaaccaaaaaaaaaaaaaaagaataaagagttcagaaataggtccatgcatctacagaaattttatgaaaccttatttcatctgacaaatgtttgttgaatttatactatgtacagccatctattgaactattaagacccttgggatatatttgtttgcaaaataggtgcctgtcctcatgaagctgcccatgtagcccagaggcagtgaaaaataataaacagaagaaagaagttaactatatagtctgtcaatgtcaaatggtatagagaaagggaaaaagtagattaagagagagaaagaattgccgaagctgtggtaacgtttgttgctttttacaatgtcatcgatagtacagatctctttggaaggataacattcatgcagtcttgaggacataaagaatttagccctgaagagagtgttggggtgggagggatcccaagtggagaaaaaaaaaaaaaaactggtgggacaggcctgaggtgagagtgtacatggcttattcaaagaatgacaagaaggccaggatggctggagcagtgagggaaacagtggcacaagcagacatctaagaggtaatggggcagaggagcatgtaaaagggccctgtagagcttcctgtaagaattttagattttactcccaataaacagtgagcgacagtggggttttaatcaccaaagtggcatgatctgacgtttcttcaactgttgctttagaaataacccttagaggatttaggtaaagcaggaacatattgtagaaatggttggaacctagatgtcttctgaaggtagagccaacaggattcctttactagttggatatctgattcaagggaaagagaagcaccaggggcaactctaagggcttggattgagcaactgaaattgtggacctcctaccactgggcctaaggaaagacgcagttgcaggaagtttagggtgggaagacagaggcacagatcagtttggtgaatgccaagtttgctttgaactgcagtcattaatacatagatattattatatagatacatgtttatagctaagaaccccaatgagcttaacagagaaaaggtacaggaaaaaaaagaagaggacccataactgagctaggagccctccagtattaagaagtgagcctggagaaatgacacaaggagaaaaaaaattaaaaggaaaaacaaaacaatgagttaggaaaagccatcagtatggtgtacttgaagacagatgaaaatgcaacaaaacaaaatacacatcttcaatcgagggaacagacagttatatcaaaacaaggaaaaaaacagacaaacaaaaactgtgctgattgccctgaaagatttgatttatccacataaagatcattgaaatgagaggtaaatatcctgaatagagaggacagtggaggaattagggagaccaagagcaggcaaagcttttatggaatgtgactataaaggagacagagatgtcactgcagatctgggaaaaataaatttatcaagttgtattgggaaaattgtttgttcatatggggaatggaaaatttgcctaaagtcacataccacagatatgttttaggcgggttaaaaactaaaaggtgaagaaagaaaaaaaaaaaactatgagcttttagaagataggataatattttcttgacttcaggttatgaacagattacttaagacaaaaaaggctaatataaagtaaaatattggtaattcaatttacaaataaaatttgaacacttggataggtcacaaactagcagatgtgtaacaaaactgaaaacaaaatatccagcacatgtataaaaaaattcttatgtgtctataacaaaaggccaaaatttgatagcaaatgggaaaaatacttgaataggtactttacaaaagggaaactctaaatggctaataaatcaaagaaaacttactcaacctcattataagtcagaaaaatacatacccatcaattctacccataggtatatgcactatattttttgcatttatatatgaaaacataaggacataaatgtcaatagcaaaagcattcataatagcctgaagctgaaaataacatacataccaaataactatagaataaatatatcaattaagatattcaatgactttgcatatgctaaggaaaatgagcaaaccatacacgataatgagctgaatatcacaaaaattatatttagcaaaaaagtcaaaaaaatattcaaagtaacttcatttttaaagttcaaaaatagacaagagtaaactctgttgtttagagatagatactgtattagtccgtcctcgtgctgccataaagacatacctgggactgggtaatttatggagaaaagaggtttaattgactcacagttgcttaggcttcacagaaagctggctggggaggccccgggaaacacacaatcatgggggaaggtggaggggaagcaggtacaatatttacaaggctgagcaggagagagagagtgaaaggggaagtgcttcacactttcaagcaactagatctcaggagaactcactcagaatcatgagcacagcaagggggaaatccaccccaggatccaatcacctcctaccagctacctccctgaacactgggaattacaattcaacatgagatttaggtggggacacagagccaaaccatattgacacataagatgtaaaactatgaaaataataaaggaaactagtcacctatcagctaaatgacagtacctgattcattcaggccaaaatgtgaaagtattactaaccacaggttcttgggctcctgtgcaatagaaatggacatgagaccaagcaagttttccagacaaggctttattaagggcttatgctcgaacacaagggagacagcactggaatgacagttctctggctggttccccatggctaggtctttgctgtgttttaagatgagtgacgtggataatcatgaggtatgggaggctctttatacatgtggagtggagcacaggatatgcaggcacagtgagaaattatgtgaacacatacattgcatgatcaaaaaatggtaggtaagcccttccctgggtggagattttagtattataatgaagcaaggggtaaagatcagtcattcttctggtcttaggcacacgtgagtgataaggttaactcccttgaataagatttatggtggaatgctgcttaacttagtttcttcaagttatccatccagtgggtatcgtgccagtggaggtggtggtgcaaggtctggaagttggcaggtacgggaaaaaaatgtgatagtaggagtgggggccaagccctgtccttactgtgtctcagaagtaggttatgtgtattgatacagttcagacacacattctgtccctgatataatgaactgatacagttcacagacacattctatccctgatgtaatgaactgatacagttcagagacacattctatccctgatataatgaacggatacagttcatagacacattctatccctgatataatgaacggatacagttcagacacaccttatatccctgatataatgaactgatacagttcagagacacattctatccctgatataatgaatgcatacagttcagacacattctatccctgatataatgaacggatacagttcagacacattctatccctcttagtgatgctaagcctaagaatctaggagtatagaaactgtagcaaaatcccgtataaatggactgcatagaccacatgagctgtgtttggacttccctgtgaatgagatgggtcacaccataagatgatagatagtatcaaaactttgcaaagtttataattagtgctacggggggggggggcgggggggaagtaagacattttttccttgctcatcaaaaggttcgtggttggtaacttctaacaaaagacagattagcaacagaaaagtatagcaaatttacttagtagaagtttcatgaggcatgcgagccttaaaagtatgattagaacatttaaaaatatgatataatggaaataaacttaggaggaggacttagtgaggtttgttcagattcttagtggcctccccatgtgacatttttttccctctgggcattggtcagggcccctctggaataaggggcttattaccttctctcagaacaggtaggtctgagaattcttttgtggacagctctcaggggagaagggcagaaaaaatcagaaagtgacctttctacctcttcggttttctcagttttcttcagcttatttagtatgtcaagtttgcatctgatgaaaaagctgaacactgtaaaatatttaaagaggtttattctgagccaatatgagtgacgatggccagggaaaagcctcagaagatcctgagaaagtgtgcccagggtaacttctgtctccctaaaacttagggaaagaacttgcaggcaaagtcataaatcaatacatgtaaaatatacattgttccagcctgaaaaagcaggacatgaagtggaaggcttataagtcatacgtggatgcaaagatttttctgattggcaattggttgaaagagttaaactaaagacttgaagtcagtagaaaaaaatgtttgagttaaggtaagggagtttgtggaagctaagattcttgttacatatatgaagcctccatgtagctggcttcagaaagaatagatggtaaatgtctctttttggaccttaaaaggtgtgagcctcacagtttatctttcctagatctggaaaaggcctagctgcactaatggcagatgcaaaatttcccccacaaaagatagctttgcagggccatttcgaaatctgtcatataaatatattttgtggtaaaatatttttatttctttcagtgtctactatctgtcatgtgatgctatatgggagtcaggttggaatttggtatcttattgttttgtcagtcctgtgatctctattttaatgttaattccacaatggagggagtgcaacaaggtgtgcccaatcccccttccctcatggcctgaaatttactttttcagattgctctcagctccactggccaagaagggggatccattcagttgattgggcggcttaggattttacttttagatttcatcaagaagccatatttggaaggatcatgttctgaaccctgacagaggagtttaaaatttttcacatctgtctattaactcatcatagactaaactagtttatgcagttaaataaaataatgaactatttcaaaacaaaatttgactctagtagacagtgtctgcacaatcatagcaatccagttgtgaaaaatgttataaaagaaccaagaaataaccatgtgactacaaaacaatgagggattaggcatcagaagactgaaaataagcaacatagttgagtgtactctattttccatctctctcattttattgtatttactcttgcattccatgagacagtgtttctgcctctatccaaaattagacctcctacttgggctttgtgttgcaacctcagaaaataataataataataataataaatcccaagccctgtcattgactgattggaaactctcttgcccagggagatctcaaagaaatctgaaaaactagttcaggccatgcgggaagggaggtcagacatgactccttgtatgccatccctttggagtttaggcaaaactgaccagtattgacattaacacagtgattataagactgacaaaacagactgtagcaacaatagcagattccaacctgactctggtgtagaatcacatgacaggtaacaggccctgaaggaaataaaatattttaccccaaaatgtatttctttgacatgttttggaatggccctgcaaagccaattcttctgggggaaatctgaattctgtatagaatttgcttccctttctaagtcctcgtgaggatccagaaaacatttaactaagagtctgacaccttttaccatctatcctctctgaagcctgctacttagaagctttcataggttgattaaaaaattcttgactggcagttggttgaaagagttaaactaaacacttgaggtctctagcattaccattgaatgctaaatgactgaccagcattaacattaaaacagagatcatgagactgacaaaacagattctaggtggtaataagatactaaatttcaacctgactctcatatagcaccacatgacagatagcaaaccatgaagtaaataaaaatactttaccctggaacatacttatttgacaaattttgaaatggtcctgcaaaggtatcttttgtgggggaaattttgcatctgtagagaaacttgattaatgccgctaagccttttccagatccaggagagagtaaatgagagtctgacatcttctaaggtgcaagagagacatttgtcaactattctttctaaagcctgctacatggaaacttcatctacataacaagaacgttggcttccaggaccccgttatcttaactcgagcatttctttctataacaaaaaccttggcttccacaactatgtaatcttaagcattcctttctactgacattttaagtctttagacaaagcttaactcaaacagttgccaatcagaaaatctttgaatctatttttgacttgtaaaccttgactttaagatgtctaaactttctggaaccaatgtatatccctcatgtattgatttatctctttgattgtaacttttgtctccctaaaatgtatcaaaccaagctataacccaaccacattgggcacatattctcaggaccatctggggctgtgtcctgggccatttggctcagaataaacctcttcaaatattttagagtttcacttttcttcatcaacattatttggtgcccaatgcaggacctcagagaagactaaggactcttctccccaaaaggagtcatgtgaacttggaaataaggtaccaatttgggcttgttaccagtggaaagtcttgactacaagttgtccaggtcctgctcccagaccttggtgttttctcttttaggaagttagcataaattggccttaagttccctgtctccaggtctccagaccatattctcctgctgcaggcttattgaaagcctcctgactttgaggttctccataggtggaactggtaagtaagtactcctgagccacagatcccttatgtagttaatagtactttggtttattctgagctggtcttttcctgggaacttgtttcagattctaattttggattcacaggttcattctagagttttctccattgcttttttctccaaaaattagtctcaattggttcatctgtgcatttgcttgaaaaacctgatgtttgtataagtgaatgagagacaacttctgagccccactgcactgaaacccacgctacagtctggctcctccactaaaaaacaaacaaacaaaaaaaaaaacttgcaaagcaaattctcaaagattgagaaaagacaaggagatgacctcctttggggcacccctgggggttttatggcactctacttgcaaatgtttgtgtaaatgtgaaggtttgagagcatgcttggttttctagtactctggctggttatgtattatagtctgttctggcacatttttaaactgatgggtaaattcagagctcaaagttgacctgcaactatagaattaaatatagcatctcctaaattctcaatttctctattttatttttctgttttaaatgtactgttgcttttctactggttttgagataaaacccattgtttaaattaaaccatcttttgcaagctggtgaatctgtattgctgtcttgtgactagagttctgaaataaaacctatgggatctttgtatctgtgtatctatgttgagttgtgtttatgttacatgtacatgtattttcttatatgttgtaactgcaaggtatcaaatgggcttaaaaataaaggattactcataaagtccaaatgctcttcaagttcacatgacaagtaaatcttcaataaataagctggctttataattattagtaaaataaaatttgaaatgccttcagaattgtcagcatacatttttgtctggatttattggtgaaatagttttatatttagcggtgtttgtattataaggtaccaaactttgtcatgaaggttataaaactttaaaacccatcccttaatgatcattgtgtaattttttataaataagacatttaatactgttgatttattgaaaataggtaaaaccttagtggttggccaaaaaaaaatcaaataaacatatatttaacatttggttcttatgtaggtaaacacctgaaatattcacagcctataagaatggttagctgaaaaataactttaatgatgactagctttgtctaatatgtcagtttttgtaagtaacctaggaaaactgttttaaaaaataaattaggtagctttaatggcataaatgcttataaatgaacttgtcatataatttaaaatcttaaagttaaagtaaataatactcattaagtgtctggatcatttctaatttaaaaaacagaaaaacatatttctaaaataatataaaatggttctcatctataaaatactgatatatgacagacaattcaagatttactacttcctaggttttcacaaaaatttaaggttctaagaataaaaattctagttaatatataattctgtatttagagagtaccaaagtaaatatttttatggaaaagaaattataataaagacataaaaatatgttcttattaaaaggaaaataatctttgtcaaattcaaaggctattatacaaatccaaagatgtatttatttttaaaaatgggtaaaaagtataattttgtatgagaaagagacttgtatagtaaatgtagttctaaaataaaacaactcattatttaagagggaaattttggacaaaacagaaagtccaagtatgtcataaatagtctgtgtaagatatgataaggtttataaagagaatttatgaaagaaaagtttttggagactaaagctactctttcttagatgggaggctcaagtaactccatcttgaatggtgatctgccctattggcttctgattaactccaggggggaaggcctttaagatttccagtttatttattgctcctcgtgtaagaacaggtacttattataaatcctgcccttaggtcaaacaacttttatgttatcatacttcaattgtcctacacatgccttctgaatcattccttccctatggcatataagtcctgggttttggggttaatggcacaggaatttgccatctcatctcactgctgcctgagacacacacatggcttctgttcataagtccctattaattgtttctgcctaagaaactgtatttatcagcctctatcttcagcatctcagcttcctccaactttggataggtttgtatagacctgctcattgtgaaacaattttgtatgtgactaagttgtcgataacttaaaaagaattatttgtattagtgtttctagagattgggatttaatattaaaaatacacaaatagaaaaactacctatagggtactatgcttattacttggaagatgaaataatctgtacaccaatcccttgtgacatgcaatttacctatatgacacctacacaagtacttctgaacctatgtaattggattgtttgtaatgcaaaggataaatgcttaagaagataaatgccgcatcctccatgatgggcttatttcacactgcatgcctgtatcaaaacatctcatgtattccacaaatatatacacctaacatatacccacagaaattttgaaaaataatttgtggattaaaaccaaaatgacactctaaaaaaattaattttttatgtagcagtattcagatgtggggcctttaagaggtgatttggttgtgaggcctctgctctcataaatgaattaattaattcatggattaatggattatcatagaagtgagattaactttataagaagaagagagatcttggctagcacatcagactgctcagctccctcatcatgtaatgtcctgtgccacctcatgctctgcagggaatccacactggcagaagtgtccccactggtccacctgaggctctgcagggagtccccgctggcagaagggtccccactggtccaccttaggttctgcagggagtctgcgctggcaggagggtccccactggtccgcctgaggctgtgcagggagtccgtgctggcaggagggtccccactggtctgcctgaggctctgcagggagtccccgctggcaggagggtccccactggtctgcctgaggctctgcagggagtccacgctggcaggagggtccccactggtccggcttaggctctgcagggagtccctgctggcaggagggtccccactcatccacctgaggctctgcagggagtccccgcaggcaggagggtccccactggtccccctgatgctctgcagggagtccctgctggcaggagggtccccactcatccacctgaggctctgcagggagtccctgcaggcaggagggtccccactggtccccctgatgctctgcagggagtccgtgctggcaggagggtccccactggtcctgctgaggctcttcagggagtccctgctggcaggagggtccccactcatccgcctgaggctctgcagggagtccccgcaggcaggagggtccccactggtccccctgatgctctgcagggagtccctgctggcaggagggtccccactcatctgcctgaggctctgcagggagtccccgcaggcaggagggtccccactggtccccctgatgctctgcagggagtccgtgctggcaggagggtccccactggtctgcctgaggctctgcagggagtccgtgctggcaggagggccctcgctgcatgtggacccttgcccttggacttctcagcctacataattgtaaggaataaatgtattttctttatagaaaatgaactaagagaatgttatgggttttcataaaagtgaatttttaaaattcctcatattaggaaacataaagaggtagtggaatatttatttaaatattgttttaacataaaccctactatttaattattctacatatgcgcattttatgtgtgttaactagaaacagggctaggcagccttagtggaactatggtctatttcaaactaaaatctatgtattaatatatttattaaatagtagtacttaatgaaattactgaagctttctagtgtcataaactgatgaaaatataagagttggacaagagagggagaggtgttttctcatcaacagattggttcattttggacattacatggcaatggaaaggaaggtgtagttccctgccatggttttagcacaactctttgaaaacacaagcagcaaagttgccactgtgattcagtgattgagaaaaaattacttaaatattctgaaattttaataacacgttaggaataaatgttatatactgtttttacatataaaaaataaaattgattacagctgtagaaaatgaaactctaaaacaactagaaaatatatgggtaaagatttgtctaatgtataaacaaagacaacaaacaaaataccatgtattcatggatataaagatgtcaacaattgaaaccagggactgctagatggggaacgagtcgggggagataaaggttagaaagctaactactgggtgctatgctcagttcttgggtaatgggatcacccataactcaaacctcagcatcacacgctatacccaggtaagaaacctgcacatgtaccccctgaatctaaaatgaaagttgaaaaaacaaagtaaatactatggaaaataaattaggatttgaaaagagaaaaaatatatatatatatatatttgggaattaaagagtagattattattttacttggaaaatttttttggatctatgacaaagcaaaagataaagattagtaacatatagccatcacttagatattattaatatcagaataatgtagacatattttttaattgcacactttactaaaaaagaatttgcagataacacaaatacaagacattaatgataaaaatgtaaactatatccagaatatctacaacaagatctcactcttactgctgaattacagaaagaaaaaaaataaatgatcatcagtactgttgtgaataaagtaaaaagatgtcaccaggttctgccctctgtcatgatagattgttgagaggaagcaacttggatatataaattagaaatgaacacttttttatttaaagacctatcacaaagagaatcgaggaattctttacatagatattcatttcagtgttgttttagataagcaaaaattttaataagcctacatttaaaataagagaaaaatgttttataaattctgtttcaaaggcaaaatgttatgaaactttaaattatatccaaaaatgtaatatttcttaaagtaactaaagacatgagcctctgtacacaattttatttatgcagatatagagctatatatggcatgattctatagtatatatagaatctatggtatattctatatgatatatagtatatatacttctatagtatatatagaatataaaaaagatactatatattatccatattatatattaaaaatatatattgaaaataaatttttataggaaatatatttgatgatggtattgcagataactttatttcttctttttgcttcatatatatgttaaattacctatggtgctcataaactgcatttacagagcaaaaaaagatattccacaaatataatcaatgtaatcaaaaccacataatggcattgacctgaatttattattttttacatgaggaaaaactgaacacataatatcatttcaaaaacaaaagctgggtggacatcttgaacattcttgtccaaatgccacagtctcaggccctattgccttctgagccaagttgaggtaagtagatatactagaatgctgtggaaactgaggtaatgaaagaagtgatacagtttaaggagacagaacgggcattgtgtagttaattcagcgtgacttgcagacttaacaatgcgataagttcatggtcatggtcacagaaacatgaaagagaaactgagttcagctgacgtacctgaccacatccagtgcacatgaccctcgctttttcctggccatgctggatttcttggagctgacacacttcctcagcagaaaactctctcctcttttagttatccctgagtgaaatgatcctcatctggttcctgcatccttcactgctgtccttaattacaataccctgaccttttatgtataaaactggtcatatgaaatagtagaacccatttatttgtcctttctttgctcttggcgtctctctcttccacaggcctgtgagctctataggaggagggatatcatctctctagttcacagtatctccccacattatagcacaatgcctagagcatggcagtcacagaatgcatacctatgacactgctgagtagaagtagtctcccatagtgctccccagacacagaatatatacctatgacattgctgagtaaaagcagtctcccgtagtgctccccaaacacagaacacatacctatgacactgctgagtagaagcagtctcccatagtgctccccaaacacagaatacatacctatgacactgctgagtagaagcagtctcccatagtgctccccagacacagaatatatacctatgacattgctgagtaaaagcagtctcccatagttctccccagacacagaatacatacctatgacactgctgagtagaagcagtctcccatagtgctccctagacacagaatacatacctatgacagtgctgttgagtagaagcattctcccatagtgctcctcagacacagaatacatacctatcacactgctgagtagaagcagtctcgcatagtgctccccaaacacagaatacatacctatgacactgctgagtagaagcagtctcccatagtgctccccagacacagaatacatacctatgacactgctgagtagaagcagtctcgcatagtgctccccagacacagaatatatacctatgacattgctgagtaaaagcagtctcccatagtgctccccagacacagaatacatacctatgacactgctgagtagaagcagtctcccgtagtgctccccagacacagaatatatacctatgacattgctgagtaaaagtagtctcccgtagtgctccccagacacagaatacatacctatgacactgctgagtagaagcagtctcccatagtgctccccagacacagaatacatacctatgacactgctgagtagaagcagtctcccatagtgctccccagacacagaatatatacctatgacattgctgagtaaaagcagtctcccgtagtactccccagacacagaatatatacctatgacattgctgagtaaaagcagtctcccgtagtgctccccagacacagaatacatacctatgacactgctgagtagaagcagtctcccatagtgctccctagacgcagaatacatacctatgacagtactgttgagtagaagcagtctctcgtagtgctccccagacacagaattcatatctatgacactgctgagtagaagcagtctcccatagttctccccaaacacagaatacatacctatgacactgctgagtagaagcagtctcccatagtgctccccagacacagaatacatacctatcacactgctgaatagaagcagtctcccatagtgctccctagacacagaatacatacctatgacagtactgttgagtagaagcagtctcccatagtgctccccagacacagaatacatacctatcacactgctgttgagtagaagccatctcccatagtgctccccaaattttccattcttcagtcactttcaaaaatataacatttaaaatttacgctctccctctcccctctcccctctcccctctccctctccctctccctctccctctccctctccctctctttccacggtctccctctgatgccgagccgaagctggactgtactgctgcgatctcggctcactgcaacctccctgcctgattctcctgcctcagcctgccgagtgcctgcgattgcaggggcgcaccgccacgcctgactggttttcgtatttttttggtggagacggggtttcgctgtgttggccgggctggtctccagctcctaaccgcgagtgatccgccagcctcggcctcccggaggtgccgggattgcagacggagtctcgttcactcagtgctcaatggtgcccaggctggagtgcagtggtgtgatctcggctcgctacaacctccacctcccagccgcctgccttggcctcccaaagtgccgagattgcagcctctgcccggccgccaccccgtctgggaagtgaggagcgtctctgcctggccgcccatcgtctgagatatggggagctcctctgccccaccgccccgtctgggaggtgaggagcgtctctgcccggccgccaccccgtctgggaagtgaggagcgtctctgcctggccgcccatcgtctgagaagtgaggagcccctctgcctggcagccgccccgtccgggagggaggtgggggggtcagccccccgcccggccagccgccccgtccgggaggtgaggggcgcctctgcccggccgcccctactgggaagtgaggagcccctctgcccggccagccgccccgtccgggaggtgtacccaacagctcattgagaacgggccgggatgacaatggcggttttgtggaatagaaaggcgggaaaggtggggaaaagattgagaaatcggatggttgccgtgtctgtgtagaaagaagtagacatgggagacttttcattttgttctgtactaagataaattcttctgccttgggatcctgttgatctgtgaccttaccccccaaccctgtgctctctgaaacatgtgctgtgtccactcagggttaaatggattaagggcagtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccttccactattgtcctatgaccctgccaaatccccctctgcgagaaacacccaagaatgatcaataaaaaaaataaaaataaaaaaaataaaaaaagtaaaaaataaatttacatctcagttttctttcacttagtagcatttttgtatccaatgtctcttgtgtttttgacttcctctgaactattctacaattcttggaagacagaaaattaatattcaagggcaatgttccccacattcaatgtccctgattgatattattcatcgaagactgctacatcatcttttctccctgccataaaacagggttttaaaacaatcgcagatttcacaatattgtcacttggatgaattactatttttcaatgatacttcctggttgataattattgattattgtggtttttgccattaaaagcaatggcaaaaattgcaattactttttcaccaacctaatacttcttcagtcactcaaaaatactgtgctcagggtctcactgattagagtgcatactgggagcagtcaggtcttgtttatgcaatgatctccatttcatgcattcctattaatatcaccaaaggatacaagataataccctgctactttaggggataacagtatagatacatgaaagataaagtttgcattcaatattttattccaaatattttatagagctactacataatgacaaaaaggacaataaggcaggaacatataaataagctaaggtatctaatgtagtcatgagggtgtccacaggggatgttgtgataacagatttaatgtctttgaggacattccattcaacatcagaatatacttttatttcaaagactcatgaatagtcagcaagatagaccatttcacagatcattaaataaaccttaacaaatttaaaagattctaaatcatgtgcaatgttttctctggcaacactgaatcaaattggaagtcaattacacgaaaacaactggaaaaatctgtaactacttggaaattaaacaatatgtttctaaataatccacaggacaaacaggaagtctcaaaggaaaatgttaagaaatttatgaagttttaattctatttttaaattacacgcatatttcattaattatagttgttgtatgtgctatgaaataatttcaggttacctacaaagccttaattctaaatccagctaaagtatcattcaaaaataaaggcagagaacacaagaaattttcagatttctttttttagacaagagtttttaccattgtctgaaggaactattatatttaaagcataaatacacaaaggccaacagtttgggaaagaagataacagcaagaaatttttggaggctgaaaaaaaaataattagaattggacttcttagatctaaaaaagctgaatattaatgtggtcatagaagcagctcagaagcttgcagaattatactagaagaatccctccaaaagcttgaagttgaagtaatcaagtacctctaaacagttcaaataggaggcttgtctaaaatttgtataaaaagctgttagatcctgatccttgtaactacttcatgtaggtgagcagctactcctgccccaaatggtacaaccctagaaatttacttaatggaaatgttgaatgccaggggctctggatcaagaaaaatatgaatgacacaagtacataagtgaaactctgtataaaattaggagaagctgggtgagcactacataaaaactctgtacaaattttgcagcttttctgaatacttaaagttcaacgtaagcattaaaaaattagaataatgttaatatttttggtggggagtgtgtgctgattgggaggagtggcaagagggcttccgtgatggtgatgttctgtcgcttgatgtttagtactaatataatatatattgtaatatatattagtatgtttagtactaatatatgtaatatagctatatgctatattatactatgtgctttattatactacttaatattaaaagggattaaaaaccatttataatgtgcttgtctttcttagaagccctgttgcctctttcattaagtgatgagtcaacttgctccctaaaattcccttaaaatagtccttgacctcaagaaccctgagtagtcactcaggaacactcacacctgctctggtgggacaggtgtcatttgagccttatcaggtatagctggtcctgagtccacctccataaatttcaggtctagaagctgaagaaagctagcacattttccccatcctgggccattggcttctctgacatcagggtcataagactgagggtgaaagtacttgcttatctaggactgtatttaagtaaaaatattaatccatggcaaattatcttatagtttcagatgttcatcttatgagagaaaaacagtgatagcttaataacaaaggttttattatgcaataaaacatttacattcatttagaattataaacaatatttaatgttttaaatgtactttcaagaacaggaaaaaacacatattaagcattcaagtaaaattttatataaaatagttgcaaatagataggtctaagcaaagaattctttctcctgtgttgtagcactttgagtaacttttttccttgttttataaaattaaagcaggacagtttttaagaaagacatttaaagcaataaacatctattacattgataactacaaaagcatagttaaaaatgagaaaaaataattttacaaatttttatttggcagcatatcgaagaattatatttacagaattttatgttttattgtattttcccaattgtttgcaatctctctggaaagtaaaagtgagatttgggatgtaaagtccagtgcctaatggagaggtcagcctcacacacaactgcgatgggctaatgacagttcacacatcaagactcttatcctgaaccaactaagaatatcagtgtttccacgaatcctcttcccatcccatcaagtgaaaatcaggaatagccagtgtacatttcacgagcccagtcacctgagaatggcagacagcccatgtgccaagggactcacgctcaggtgttctgacaaaataatgacaatggcgatgatgataatcaccagcagtgaccaagaactcagacccaggaaagagctctgtatgtattaacacattgaatattaacacaggtgtagaaactgaggcactaaaacccaggaaagagatccgtttctatcaacacattgaatactaacacaaatgcagaaactgaggcactcagtgacaatctcagtagatgcattgatggaaattgtgttaatttcctgacagatttctaaaaataactaagtgaaagagaaatatccttaaaatatttggcaaaatctaaaacatacgttcctgttctaataacccttctgcttgttttatgttcttttttgttgactggctaaatcaggtactaaaactgtgtgcgtgtgtgtgtgtgtgtgtgtgtgtgtgtatgtgtgtgtcctcttccaaaaaattcatactaacaggagtgcaaggctacaggttcaagatgaggtaattaaagcagttcgaacatgtgtggaatgggaaggaataaatcaccacaacaagctgcagttacacaaccttgaaatattttatgaaggtacttttatacttttatacttttagtttttgaagaaacatttgcatttctatctacatatagtagtgcaaatattgtctttctcccattcaacaggttttttttttcaggatttttcatcatttcatcaacaattttttcatctttttttgtcataaagtatttatgcttttttggggttttgttgcagatcttctatagtaaagaccaggatgttctacttttgcagaaaatatatcttcacaaagagtctccacatggctgttttaatctccttattcctaagactatatatgatgggattgaggaagggaggcaaaactgtgtatgtcagagcaatcactaaatcctgaatggacagagcttttgcaattggtcctaaggcagcaaagagccctgtggtaagaaagagcatgatgacaatgagctggggggagcaggtggagaaggcttttgctcgactctgtcctgaagggattctgagcaccgttgagaagatttggaaataggagatcatcatgagaataaagcatcccagaaccaagcatgagctcagggccagggtcaaaaactctacaaagaaaacctcacaggaaaccagggccaacacatgagggatgtcacggaagaactggtggatcacactggatctgcaaacgtgctcccgaaacatgttgccagtgtggacggctgcgtaggaaaagcagcttagccaggtggtgactgccatctgatagcaccctcctgatgtcatcacggctctgtattggagggggtggcaaatggcaacatagcggtcataagacatgacagtaaggaaggccagctcagcagatgcaaaggcagagaaaaaatagacttgagccacacagccaagataagagatggagcttctgcgagtcagggagttacggatggatttaggcacagtgactgagatgtagcacagatccaaaacggagaggttcttcaggaagaagtacatgggtgtgtgaagatgctgatcgagagtgatgactgcaatgatgagcaggttccccaccagcactgccagataaatcagcagaaacagcccggcgtgcagcacctgcagctcccagataccagaaaactccatcagcaggaattctgtcacttttgtgagattgtccatttggcagggaaatctgtgatctgattgttgagaaaaaatatacaatagttttaaatgagacaaaaagtgaacacagtgtggtaggagtaatatcctcctaaattaaattcaatccactggacatcttccacactgcttaaacaaataaaatggtgggagatttttaacatggaaagatcataaaaaatatatgcctaagactatgagttgagtaaccaatttctaaaagcttttgattagtactgtttttctattatatggaacttctcaatcttgaaattaagatttttctcatcaaataatctagggtgcttattaaatatgcagaatttcaagtctcaaggcaaatatactaaataaaaatttgtgggataaaaccaataatttgcttttcatacaagtttctgggtgattttttagtacaaaagtttgtagttttaactgtggttatacatcctgggcagagtcaactgtctttagctatttgttgaataaattgggtggtaagccactttaaaatgaggatttactgtttaagacatggaatgagtatggaatatgattttaaaaccattgataattagctctggtttggagagagggaaatttattttgtgtcaatgtgcaagacatgacaatagttatactaacaatgccattacccatgtgttgcaccttctctgtgcccgatgctattatctctacaggacacaccttggctcaattaatattcataattgtacaataaattaaaatatgccgttattattctttttctcaagataaaacggaggcataacaagatcaaataagttgcccaatgcactgaaagagccagcacctgagccagcatttaaatcaaggcagttcatttccaggatgtgttgctgacctctgcattctaagtttttttcatagaaaataactttgactaacataagctcacaaaaataacttttttctatatattgtttatcatattttgtttattttcactggtattatctatatgtttaaaattagtttttctgcatcaaagtcatgtgtgttagatcctgttcacatgactcaaatattctcactaaaaacaacttattaatttttttcaaactagagccaactttaaacaagtgattttaaaatcaggttactgatcatctaaggtttagttgccttatttcattaatgataaactctattaagcacataaatgctatcccttgctaccaggcaaatgtgaaatgttatttataagacaggtagaacctatgttttatgacaaattttaaagataatgtgaaatgttattttttataggacaggtagaacctatgtttaatgaaaaaatttgaagataatcttttgtccaaatgctataaatgatacagtcactttgaagcatttcattgtatcattaaaacaagtaattgaaaagaattgcactcttggcaaagcgcggtggcgaactcctgtaatcccagcactttcggaggttgaggtaggtggatcacctgaggtgaggagttcgagaccagcctgaccaacatgctgaaatcccgtctctactgaaaatacaaaatagctgagcgtggtggcacatgcctgtaatcccagctactcaggaggttggagcaggagactcgcttgaacctgggaggtggaggtggcagtgagccaagatcgtgccactgcactccagcctgggcaataagggcataactccatctcaaaaaggaaaaacaaaaagaattgtactgtcacacaaagtcaagtgacgagcaatacatatttacaatgaaaatgacaaaggagcactatccctgataaacgacaaactataaaaacacattagcataaacaatgagcaaagtatatgaacaagggctcagaaaactggaaagctaatgacccaataacaattcaaaatgtgttcaactttactagttatggaaatgcaaattaaaactttaacatgatgctattttgtgtccattgctttagaaaacatatgtctggcaagtaaagtctcgacaaacatgtgaagggacgaagctctttgctgctgcttagtttgctgtgtaagcagcctacctactttggagggtcaactggaaattttgaacacaactgaagatgcgcaagtttgatgcagcaatgctccttctcacaaatgtacacttgagttttaaaaaatgacatatgtgaggatgtttgctccatgacgtttaaacccctaattaccatcactaggaaaatggataacataccctactttatcccagaatggaacactctctagaagttaaactgaatgggatactctacatcaatattgaacatttcaacatagttttgaaaaaaccccacaaactattacacaaaatatgttcccagtcatatgcatttaaacattcaaattgtgcagtgcattatttataaatacacacacatacatatatatatatatatatatacacacacacacagataagcttgtataaaacagttactggaatgaatacaaatgccaataaatggggtagcggagggaaaaaataagttgaaaacattgaacagtaattatatctgtaatattttaacagttaagatcattaaagcaaacaaaaatatgaataaatgataagcctaagtgctcgttcttaaaaatcatttgttatactctttctagattttggatatttcatatttttaatattatttatacattaatgtcaaagaagcaactgaaatacttttgtgtgttataaattgcttttatattttatatatttaaattgcttgtaaaattcagtgaaaaaagctctcttttttccactgttttctttgacattatagattaaataaaatacctcacatattaaagtaataatctcaaaaaatatgattaaacattaataaaaaagtaatggggactcaggtgattacattctgcatattttgacatccattataatactatttaacaatgcagagtaacttttaaaactgggtttttgttctgactttttaatagaactcaatgaaacaagtaataaaatggttgttaattggtttgtatttaaaatatctcaaccaaacaaccaagaattgcagctgtcccataaaacaaggcaaaaggttacccacccttccagcagaatcagcagtgtacaggagtatactatctcccgggttagcttgctatcggtagatgtaaaattctacaaaactgccacgtggccaattccttgtaatgtattatctagagaatgagaaaataataatgctctttccttgattctaacactcacatttctgcactgctaaaggaaaagcatcatataatttatatatagttgtgtatatatagtgcatatatagttcgtgtatatatatacatataaatatacatgtatagtatatatatacatatatatgtatagttgtgtatatgtatacatacatatatatgtatatatagttgtgtatatatttgtgtacatatagtgtgtatatatagttactgtttattgaaaagttattaaattaatattttccttgaaaattgtctacaatttgaaattgaggacatacaaaacaaatctatagggatgcaaacatattatcattatgatatataagcatatatacaatacacctattcaaaatattaggcaaattgatgtgcatttattaacaaaaacttagtagttaacacattggttaaaaagacacaatacattttcatatacatatgtgcatcattgatagatataagttgaaaattttgaatatattatttttaaccgtaaagcatattgaattaaatatgtataaagatttcctgcttccaagtctgtctattttaaattcacacatgtggtatgatgagtaataagattaaaagagacctgaattcttgtcatgttctgacacagctgttttaagttggggaacctacaaatacattttaatttcaatttactgaaatgtaaaactacactcaacaagatggcctctgctgccccacctctgagagcatttgtatctaatctatatgaagcctttttacttcagtgtagttttctctgagtggcctgatgctgaagagctgccctttatcccacttatatcaagcaaaagagcaacactgaggaacaaaaccaatacacactgcaccatgagctgcttccactctagtctcaaactaaaaatagatctctccaaaactgattaaaatgataaaaattcaagcaaactgaatgcactattttgtttgcttgtttcattggaaaaaaatatgaaacataattactaagagaacaattaaatcactttaagcaaacatgtcttgatttttttctcataaaaaatttgaaatgattgcttacataaatctcatgtagacaaattcaatttccttattgggtaaatatctgagaaatacaagaccagcaataccttgattaaataacatgtagcttctcaatatgtattcactgtctggaccaatgatgataaagaaacagttctgaagttttcctctgtgtctcaccagaagaagtgacccaatttaacatgcaaactcagtgatagagaaaacctgatgtataatatatcaaggagacaatcttctctgttagtttcccatagagactgggccgccacagtctggaggagattggcttccagaaggaagcctgggggacgctggtctcaggaggatgctgcctcctctgggttaaattgtaaattacctgctgaaacagaaagcagaatatggagtaggtgccaactgaactcagagtccgtgaggaagtgatgagcatgagatatagagattttcattaagagagtgaggagagtaaacagtgaaaaaagtaaaggatttatattttcacatttcataaaataatcttcgataaagtacaaaacccagacatttaagtactcagaaaataataaattgttttacttcatcactatgcctagtcagtatgccacatgagagcagttaagtgcgtatactcagtttactttgcagttacagcagcctgtttctgtattgcacatagactctcagaaaattattggcttaatggagacaatcatcatgcttctcatcttcctccaaatctatttgttccacaaccagtcacagaccaagaggatgggtagatctcactaaatacgatcatttgaaaattagaagtgaatagaaaaatctggcagaaatttaggagatatatattttatcatttcatttttcaaatgaggaaagtgagtcttaatataaaaacttaagacaaattaaacttagcagactttatttgatcaaagaatgattcattatcagatcgcactacagatcagaagaaattcagagagctctgcccagcagtgtgaacaagcttttatgggccagacataggagcaaagtagaaaaatcacctgcttgcctacagctagacatccgtcttgtttgaacatggtgttatttaattttggcaatactataaggcagtagaaaaatattgcacatatgtacatacatccagatatagatagacatgtaacagaaacattacaaatttttagccatgtgccaggtacaataatacaaatctcactaatttattaaagaatatctggatctaaattgtttttggctaatgccacttaaatggctaaagcttcttactaatatttgtgaaaaagatcattaatgtttttttatttgctcagtttccaaatatctatttttcttacttctacttctgatgagttatctaccctaaacttgcattttaaatagatacctattaaactctagagaagactgtgtagaaaatttatatctcaaaagcacagagcttggacttccagcttaaatgctttaatttgcccaaaccaagaaagaaagatgtaaagacccagttagggcaagacagctaggaaaagcactttaaaggcaaggcttctgtagatttaagccaacgctttcttccttatcagagtttccagtgttctctgtccagagaggtagaccttcttacaaatggagattccctttagggatgtaaatttctcttacaaagagtcctcaaaataagcaggtgaaaatagtttttctgccaaaaagttgtattttggagatttattctgctaaatcagtggttttccaacccaccttctgtcttttaactaaaatactaagtgggtggaacccactgaagactagaacaaatattttgtgtgcctgactcaccatggttacttctaatcttgctctataatcacagactggtacaacttttctctcctgttttgttttcaagattgcaagactgaataatatttccccccacccaccagaaagagtttggggcatagcaaagatcatgacaacaagaaagaattggcagagtatgtgtttagcgggaagtttcataagaggtgtttcagttgactgcagggttcccatgggagaagcaggattaaagagagaaaacagaaaagactcattcttacaaatgtttttctaaatatgattcaactgtcagtcagatagcttcaggtatggggacttccacatttgatttgaaacttccattttttttctctgggggattggttgattattgcccagggagtgtagcccttgggggctttctctagtaggtagacaggccaggtccatcagatgactggtatagaaatgaaaaatttcttatgcaaaggcctgactatttaaaatacaggtaaacttcttgggacacgcggtcctttacttttgaggcaactcctctggggttcaaaatagctacaaggaggtcttctcagtccccatagctggcgtattataaaggcatgcacctctttgtcctttgtaaaaagtctccccactgtggcctttgtaacttaaaattacctttggtcaggttcactcatttttctagaaaaacacatgttctgggtccatggttcttatacataaaatatgctgcagtcccacatggaagagttctagagcccttggattcaaaaaacacatgatatgctgtcttccaggaaccttacctaccagaggcctcctactggacccagtctggtttctttaccagatccattccaattctgaacccagtccagtcaacaaattgctcaaacaaagttagagctcaaaacataaatttgcagagtttgaatccaagaggaaatttacccataatcttcagttgcagcgtgagagcaatgggccctagtgggtatctacacttgggcattccttgttccggggggccactgggtatccttcaaatcttacttctaacaccaaatagttaaaagaaaaactttaccaatgagacagaaaattaacaggcctattcaggacttgaactcagctctggaccaagcaaacctaatagacgtctacagaactctctacctcaaatcaacagaatatacattcttctcagcaccacatagcacttattctaaagttgaccacataattggaactaaaacattcctcagcaaaggcaaaacaatggaaatcataacaaacagtctttcagaccacagtgcaccaaattagaactcaggattaagaaactcactcagcaccacacaactacatggaaactgaacaacctgctcctgaatgactactaggtaactaacaaaattaaggcagaaataaataagatatttgaaaccaatgagaacaaagacacaacacaccagaatttccgggacacagctaaagcagtgtttagagggaaatttatagcattacatggccacatcagaaagcaggaaagatctaaaatcgacaccctaacatcaaaattaaaagaactagagaagcaagagcaaataaattcgaaagctagcagaagacaagaaataactaaaatcagagtagaactgaaggaaatagagaaacaaagaagccttcaaaaaaacaatgaaatcaggagctggttttttgaaaagactaacaaaatagatagaccaccaagctaggctaataaagaagcaaagagagaagaatcaaatagacataataaaaaatggtaaaggggatatcaccactgatccaacacaaatataaactaccatcagagaatactataaacatctctatgaaaataaactagaaaatctagaagaaacggataaattcctggacacatacaccctcccaagactataccaggaagaagtcgaatccctcaatagaccagtaacaagttctgaaatccaggcagtaattaatggtctaccaaccaaaaaaaaaaaaaaaaaaaaaaagcccaggaacagacggattcacagaggtacaaagactagctggtacagttccttttgaaactattccaaacaacagaaaaagaggaactgttccctaactcattttatgaggccagcatcaccctgataccataacctggcagagacacaaccaaaaaaaaaaaaagaaagaaaatttcacaccaatatcgctgatgaacactgatgtgaaaatcctcaataaaatactggcaaactgaatccagcagcacatcaaaaagattatccatcacgatcaagtaggcttcatccctgggatgcaaggctggtacaacacatgcaaatcaataaacacaatccatcacataaacagaaccaatgacaaaaaccacatgattatctcaatagatgcagaaaaggccttttttaaggctgagtaatatttcatcttaggtagatatcacattttctttatccatttatcccttgatggatatttaggttgcttccaaaaagaattagagcttctgcagctgccagaaagtaagccatcaaaacagcagttgggtaacaggaagaattctaacactcttgagctcataggtagaagggacccttcattcattcaacacacactaacaatgcatttatgtcccaggtacagtgctaaaggctggaagtatgtggatcatgcatacatacacagtccctgtcctttcaaagtgttcagtctcaaggaggtgtgagtatgttagaaaatattctgaggtgccagaattgcactagatgcattgatgacttggagggtattggtagggtagaatgttcccgtcagagaattaagtatataggtaccctttcctcaaaaatgcttagactaggtagggaagagggtgaggcacaatagcatatctttaattgggtggggtgagaaccaaagaatcggaaaaacagacattccagctcctccaagttcttccaatcgtcagaactgtggaactagcccaccaggctttctccagtcacgtgagccgggagccaccaggatctcattggccaaggctcccagagggcgggaagagcgggaagtgaggaccaatggggcaggccaaagggactgtggaggccgacgcatgcgcagtgccctccggcctagcccggccaacccgcctgtcccggaccgcccggcgtcaggtacgggttcaccaagccaccccgcccacctcaggacgcagctgccggtccagctgctcccgcgggcccacagcgcgctgtggaaaggagcggacaggccagaggctctctcgggcctacaagtctctaggctaggcagtgtttccgagtcccaggtgcctccagaggccgagctcacagcgcggcccacccagcatccgggggcgctgtgaggggcgctcgcccagcagcggaaaggccattcgcgtggcgcgggagcgcgggcccggccgcctgggcgtgtccctttcgcggaactgagctcactggctcctctcttccagacggagcgacggggccggccgcagcctcagccacgcgtccctcggtggcgggcaggctcctcttggcctgcagccttactttcatgcccttcttcacaggtgagcggatggcttggggtcctcccgcatttcccgcagcgtcgctctctgcattcccgcattcccaggttcctgctgcattcgtgaattccctcctgcattcctgtactctccactcttccagcctgcattcccacatttccaccctcattcctgcattcccaactgcatcccccaacgttgccactttctccccatcgttcccacctgcgtttccgcattcccacatccctgctctgattcccacccgcatttctgaatccccacctgctttctctaccccagtccagcctttattccggcatttctgccttcattctcgcgttcccagccacattcccctttgcattctgcagacctccaatcacctttctttgttgggcagtgtactcatcagcacggcataaggaaagagcagacacggctcctgccctcataatgcttacagtctacagaacagtgctggggacacagtcctgagtgttgccttctgatcaaccacttaactgactgcctggcctcaggaaagcagctgagcttatctgttcttaggtatccttattagagtactaagaatattggttcctgcctattatagttgtaaggaacatgtgagctagtaaagggctgacacaatgcctggcatgtaataagctctcattaaagagagctttaatgtttgtctgtctttctccagagaccacttcatgttgggagaattgtggggagagaaaatgttcaccagtgaaacgtgaatcatgagccctcatccaagtagttctacttccccgatttccctgaaggttatagggtactgtgtgagcagcctctaactctccctggttgttcacagaagtaagatgttctgggtctgcttatcgggaggagtcattcagttagtgccacataatcattttaacatttctcccattgctgccagggcatcctgcatcacctcccaagccagcctcccacgtcacctgggtggtgtactaattcacggccaggagcactgactgttcctgctcccacgtcacctgggtggtgtactgattcacggccaggagcattgactattcctggccacctccttgcacctttcctggttccctcagcctctcaaagttctcatctttcctttgatgagaaagagaagggcagactgaaaatagactcaccacccacctgtcctttccccctgccccatactggtggaccagcatcacagtaaaaatagttaccacttagtaagaattcattatgagccaacttaggatttttgataagataaaagagttcagcataattttacataaaattagttttttcttgatatattttcttctcttctgctttccacacctaataaaacattacagaaagtcttgttttatttattttgaggacaggccttaggtaaaatgtggaagtttatcttggagcttccaatcttcaagttctcttctcctttccccatcctctgtcttctccactctatcctatcttatctcctctagagcccaaacccagccccactgatttttctcaatcaaagctcatttaaaaaaaaaaaaaggatgggaaaatcgtcgttcctctcactatgaatagctaagaacagtgctattaacttgcctggtatgctctgcattttaacagaaatcaaagtccagaactttttaaaaaaaaaaaaaaaaaccatttactggaatattgggcttaagagtgtttgtgcatttggttgagagggcaggaagacctatcagtctgcatgtggcacacactctaataattttcttcaagttcacatgccattgccttgggacatcagggccccagccaggcactggaggggcagagggaggcatgtgggcaactttgaggggagtgggagaaagtgatacttaatctcatacttaaccaggtgaccacttgtttcctcaaaagtgccctcctttgctctgctgatcagagattgcttagtggttatgattagtagtgaagtttgtttgaatataatattttctgtaacaagccttttttttcgggagcaaaaacaaattttaaaactttttttcatatattgtcccattttaaaaatttacttacatttgtttttaattgtgtaactgtaaaaataaataatatatgcctatgacgtatattatcctaccctcttcagcccccaacacaactcctgtttagcaaccatagttattcctttcttgtttacctttccagaaatggtctgttacttacaaacatatccaaatgcatcttttctttccattggcagcattttatatcaaatgctctacatcttgtttttttccccttaaaagtacatcttgaagagcttttcatttcatcagaatatggccatattctgtctatggtggtattcatctctgtttcatggatatgacagaatctatctaaccatgagaatttcagtcacttctgatcacttcttatcacagaggatgctacaatgaatgaccttgtacaaatgcatgtaggaaaatacctaggaattgctggataaaagagcttgtgcaaattgttctcaaaaagaagtattactaatttacccaccagaaatagatgagaatacctgttgcccctcattgcaattttaatttacattcatcattaccttctgcagtgatcaaaatgtctatgcctgtgctgtccagtacagtggccactagccatgtgtggctatccagcatttgaaatgagactggtgtgactaaggaactgaatttttaattacattttattttaattaattttaaatagatacattggacagagtagcttcagagcagagtagggtatgaaagagtttggaaagagacaaaaggggatatgagacatattgctgagaaattatgaattggaaggtctctctaacgttaaccattgaaattttcgttattttgtcttttaattttcaaaattactttttaaagtgataagtttttacgaattacttttgaatgtatgctttttttttttttttttttttttgagagggagtctcgctctgtcgcccgggctggagtgcagtggtgcaatctcggctcactgcaagctctgcctcccaggttcacgtcattctcctgcctcagcctcccgagtagctgggactacaggcgcccgccaccacgcccagctaattttttgtgtttttagtagagacggggtttcaacgtgttagccaggatggtctcgatcacctgacctcgtgatccacctgcgtctgcctcccaaagtgctggtattacaggtgtgagccactgcgcccggccgaatctatgcgtttttaaaattacatttggattgtgcttcctcaaacaagactctccagagaaagcaagcctggttagccctggatctctaatggttgtagtggtggagaggcatgtgggcgtctctagtctctgcttctccttctcttcatggcagcacccagctcccaggcctcagcactgccttcccaaccccttctcctaccccgggtggagggccagctgccctcacatttgcagggcccatggtaatatgtcacaatacttaaaagaaatacagtaagctaaaaacaataataaaatattttccatccttttacttacacaaatgtgtcctcagaatgacctaaaaggtttggaatgttcgcaagagtttcatgccagagaattgcagcactgagaaatctggatcctggtctccagcccatctcctttccccattccacactccccttcaactgtgaaggccatcgcgatcatgtgtgtggacacgccaatgctgaagtttaaactccccactcccaccacctctgacaactgctaggttagatctcagtctgtttgagcaagaaatcccaggattcttggtagccaggcaaagtggggaaagggcatacaggatctgggtgggcatgtccccttggtgtcacatactactcatcccataggggctaacagaggcagaagaggccctggtctgggggaggtgaacaaatcaaaactaccttttgatagcctaaggagaattcttcagggaaataccatggcttttactccttttttccccttgctcttaattttccacagatttccacctctttattcatagtccccaccattctctgctctgtgcctggacatcttttactggaacagccaagcccagtctttgcccatgacagcaggtggcagcaagaacacttgaatggaagcggggaatcagtcgacttctgttcactaggacattattatggagccccagaggcagatagtgcagaagaagctaaggctctttcttgttagggccccttctttgagtatcctgtgcattctgccacccgtgacctttacttgtaagaccacatttttctgtgtaagtgtttggaagtagacctttttcaggcctccactcaaaaaatgtccctttttctgtgaggcctttcctgaccaaccccgtgaattatccctaccctgcacatcctgtcctgttttgtctctctccgtagtatttatcatcatctgacatatcatatttttttcttctttgtttttttctgcttcctccatctgaaaatgagctccataatggcagggatttttatagtaactctagtgttattggatgcgtttgaaagtgtcacatgaggaaggcaggggtgaggattagggaagggtgaatggggtgggtggatctagttctagcggctgttctatgagaatgagtacatttgcttgtcaatggcaaataactagccagtcttctatctttttttaacagtctcctgggagattaagatgagtgatctagaggaggaagatgttgatgaattcagctccagtggttttaagtgcccaacatgctttgcagtgcaaggaaggaaatgcgatacagaactcaaatggtgtgcagcagataaaataaagtgtattgaattctctggcatcataaacacaggtacttttctaggatgtactggtattctctcacaagcttatggggtatgtgttccaagggtagggttgaggagaaatcagcttttgtccaaatctcttagaaatgaggacacagcagtggtctgactctgtaaatatgtccaactggctttcacattcacttatttttgaattgatacatgtattcattgacaggctctctactagctttgaggaagttggttcagcatattggaggaatcttcatcttctgcaaattttggttaggtttaaaaaaaaaaaaaaaaaaaaaacatggccgggcgcggtagctcatgcctgtaatcccagcactttgggaggctgaggcgggcagatcacttgaggtcgggagttcaagaccagcctgaccaacatggagaaaccccgtccctactaaaaatacaaaattggccggagtggtggcacatgcctgtaatcccagctactcgggagactgaggcaggagaatcacttgaacccaggaggcggaggttgtggtgagccgagattgctccactgcactccagcctgggcaacaagagcaaaactccatctcaaaaaaacaaaaaacaaaaaaccacgggggcaatgtgtgcttttttcctctgttgttgttgttgaaattttcaaaataagagctctggagagaggcaatgaccaagcttaaactttcttcaaaaagattgcaaattatattttactatgcttgctttaagaaaatacaatacaaaattctaaattaattgaagacatttaaatgagaaatgatttaggagtgatagtgtggaatagcacgaaatgcagtgggctgagttccgtgagggttgggttgtttccataattcctctttacctgctcacttcctcctgctgacgctggggagctccaccttcctgaagttcatctaagtgaggtaattagaaggctaaccatgttggttggtctcttggattcttatgtttctactttctgtaatttgcataataaaagagatgtatttgctttaaaatagcaatcactcgattgctattgacactgcagaagaagtaagatgaaatcatcgagagcgtagaatatgtgccatgtgaaagaatatgtctgaaggtgctttgaaaggcagggaacacaatcacagtcgtagcttttttatggctattgctagttcttaaatgataactcagaccaagaataagagattagatttatgttcctaaatttacaaagagtctacataactgaaacacagacataccccctcccctgagtatcagtagcatacaggatacccctaacaaagtcattaggacttcttactaccattggcataaagggtctataaaagcatatgctatctcaagtggtaatgtaagttggaaaaaagttcatataaagtttagaaaatatgccaatatgtgattgacatagattttgagaagatttaggaatttggaagtcccatctttggaggacacatttctagctcattgcctctgctgcagagagccctgtcagatggatcacaccagagtgtgacttgacttatatcctactccagcccagtctgtatgagtaaaatgcagagtataaggaaggaggaggagagtggaagtctcacttacagtttcttgcaggtattcgtgacgtagccattgaaatgaagagatgcacacaagcagacctatgcaaagagacgataacttcttagatgggttttccaattgctaacaagagtagaaattgcaaatcagccatcagaaatggggccagaatcagacccccatctcccatcttctttgttcttttcctggggagggtacttcatggagctctggcaagagcctagccacttccatttatgaattaaacctgaatttttttgttaatgtattctttcatgagtgttaatttctccatagttatattcagttgtccatttgtttactcattcaatgagtttacttgttgtgtatccagccttgcataaagtgtgttagggtcaaagtgaatcagctttgggtccctgcctttaaggtcccaaagcatttagagaatgaggacgtgtgcagttaaaatgctgagaaagcaatttaagaagaacataaaagagcagaagcactctgcttaaggagcctgagggattggtttggacatagggtaaaagtagaagactgtgggtttgattaaggaaagattgggattttagatggactttgaggagacctttactatatggcagcagaaataacatgcactgagacatggacatggggagatgggtggaggctaagatgcagtagctgaaattaatggtaggaggagtgggggagaggaaaatgtcagcaagtatatgggcctggctggaagcatctttctgagagggatggaaagtgctgccctggatgaacacagtggactcactgagctgaggacaggccagctctgtgatggaaaacagtttccttcaatccaccagagagatgatcaaaagccaaggtccctggttctcactgctgactactttttgttttgtttgtttgtttgtttgttttgagacagagtctcgctctatcgcccaggctggagtgcagtggcgcaatctcggctcactgcaagctctgcctcctgggtcaagcaattctcctgcctcagcctcccaagtagctgggactacaggcacgtgccaccacgcccagctaattttttatatttttattagagatggggtttcaccatgatgttagccaggatggtcttgatctcctgacctcgtgatccgcctgccttggcctcccaaagtgctgggatttcaggcctgagccaccgcgtccggcccactgctgactacttagtacagaatcacccaggagctttaaattagaatgcgcatcctaggccccctgccagaaattcagattcagctgatttgggatgagcctggccttgctcccgcatttttgtcctttgtgttgttttaaatgctccccaaccagggtgactttaattttcagctactattttttaaaataactgaagtataagtaaaagatcataatttattttacccaaagtgaaagacctccaattaaagccaaccaactatagcgtgtaaaacagaagattgtttacatgatatcaaatgtcaattgatataaagtttgaaaaattgcaagtactcttctttagctttagattagttgtgcaatacaagaacactaaccaaattaatggcttttcttctcaaaggacttcctaatttatggagaaatgtcattcatgaccccgaaaatcaaactcatggcataaatacattttaatcctttatgtctctcaaagaaaaaaattccaactaaatgtgattatatttgtttctgtcatgacaacttgtactccagatgtattaagtcaactatcaggttttattggaatttttaaacaagaggcaaatgcatttatttatagctttgttctcctgaaaatttttattctcagttttctcaaacactctatgaaaagtgtcatggatagagtttttttaaatcattgagttcatatgcgtcagtgccataaatcgtcaccagtttatggaataattatataaaagagaagatagtgaatttaatgaacttgtgttctttgccaatgctcattgggtgaatcatggaaaatttttacaaagatttactatattattaactcgaattcccagttttattcaaacagaaggaatacttgccaaccatttaataatcaaagaccaaaatgggcaatgtaatttatgttttctcgttgatgctacatttcacacatgagctaagatttagcctccaatcaaaggaaaagcttatttgtaaacttggtaaaaagatatgacactatattgaaatagaaactttttacaagacaaacaataatgattttacacacttttaactttttttttttgagacggagtctctctctatcacccaggctggagtgcagtggcaccatctcggctcactgcaacctctgccttatgggttcaagcgattctcctgcctcagcctcccaagtagctgggattacaggtgcctgccaccacatccggctaatttttgtattttttaagtagagacggggtttcaccatgttggccatgctggtctcaaactccggacctcaagtgatccatccacctcagtctcccaaagggctgggattacaggcgtgagccactgcacatacttttaactttttaataataggcagaagattttgattgtcatcaacattgttatgtaaagtggctgtaaaaactataaaaacattaaaacactcttggtatttataaatttagggttgattttcaatttttgtgataactttcattatgatgttcataatactgagtggacacagagttagtgaaattacttaatttggatgaatttagttttgaaattgatacgaagtgataggattcacttcaaatgaaatcaagagagcgatatcaccaagatgacagagtaggacatactggccttcattccccttgctcccctgcacccctccaaaaatagctatccacaaatcaacatggcactgacaggtctcaaagaccctgtgttagtctgttcttgcactgctataaagaactacctgagactgagtaatttataaagaaaagaagtttaattggctcacggttctgcaggctgtacaggaagcatggctggggggcctcaggaaacttacaatcacggtggaaggtgaaggggaagcaggcatgtctttcatggctggagcaggaggaggagagcaaacgggaaggtgctacacatttttaaacaaccagatctcatgagaattcacccactatcatgagaacaacaagggagaaatccacccccatgatcctggtcacctcacaccaggcccctcctcacattgaaaaatacaatcatcctttctcaacggtcccccaagtcttaactcatttcaggattaactcaaaagtccacaatccaaagtcttatctgaggcaagaaagttccttccacctatgagcctgtaatatcaaaaaacaattagttacttccaagatacaaaggggtacaggcattagctaaatactctcattccaaaagggagaaattggccaaaacaaagggactacactctacacaagtgctccctcactggtaattaagaagaaattctatctatttattgtccctcttttctcacattccacatcaagcccattaaaaaatcctgctgtatctactttcagagtatctttagaattctacttttttttgcctttcccactgccaccacctcgatccaagcctcatctctcactgtagtattgccatagcccttctgttctcccagcttccagccttagtcccctagagcctactctcatctcagcaaccaggttcatgtcatatggtgtactgcctctgctcaaaatcctccagtgtcacccacctcactcagagcaaatgccaaagccagaatgatgtgggcctgctgttctcctagtgctctgctgcttgctcaccttcttggttatcctcctactcatcttcttgttcttcttcttgctcacctccttgctcactctcattgcttatctacttgttctcctccttgcttaccttcttgctattctgcatgctttctgttcttgctcaccctcctttctcacctccttattctcccccttgctcacctccttgcttacctccttactctccttactcatctccttgcttacctccttactctcgttgcacacctccttgctcattctcattgcttacctccttgcatgttctcctggatcacctccttgctcaactcactgttcttttccttgcttatctcccatcttcacctccttgttctcctccttactcacctccttgcttatctccttactcttttgcccacttttctttctctcctccttgctcaccttcgtcctcttcttcttgctgtcctccatgctctccttcttgctttctctctttgctcttttccttactcacctcccagctgtcctccttgctcactacactccagccccagttgatctttttgccattccttgagcagccacactcccactcaaagcctttgcactgggtttttcctcttcctgaatcgctcttcccctacatatccatgaggtttcctccttttctctctcctaccctttcttcaggcattcactaaaaagtcactctttcagtgagaccttccatgatcactctactgaaaatattaactccatcttccaacagcctttcatatttccttccctactttatgttttcttcttagcattatgcaacctaacattatacttatctaatttactacacattatacttacctaatttaccacccatctgcccaactggaatgaaagctgtacaaagacagggatgttcatctgctttgttcactatcttatccccaacactagaataggacctgccatatagcatgagctcaagaatatcggttgcactgaaggatgaatgcatgaaaaggtggatggatgaataaacaatggaaaaagaaacttgacttaattagtagctacattatgaataaccacaagatggagacattcattaataaaatgttatccctctgtttttttgtttgtttatctgcttcttcctgtctgtatttgtgtgtcttgtttacctctgtttcgcactatctgttcatatctgtatggggcatgtgtgtgtcttttcttcccttttttattttgtgtcatttcttgtagagttggttatatttttctttctctgtccatgtagtctgcatttggcaatacaaaataaaagtcagcactgaaatttattttgccaaggttaaggatgcatccaggagacaggtctgtacttatctccaaagatgattgtgagggcttcaaaatttaaagggggaaagacagatactggggaaagaggaaaaaatgttttaaagtgtgggtaaataggaggcaagcagtggcatgctttcgagtctttgataagcccttcacttgtgagaagtaggtagaggaatagtcacttatgcattcatctggctcaattaatctgcatttttatataatataaacataaggcagaatgttggggtgatcagacccaacaccaggtcacgggagtgagaaagtctggcagagtcaaaggactgagaaaaagacagttggagaagtaaagtgggaccacgggaccatcacaattgtggaggctgtgaaggcccggagctctgggagcccagtgctatttattggtaatccagcaaagaaacaggtggtaagaatgtggaggctgaaagggcgtgttgcattaagcacatgatttacagctgtgatggtttagcatctgctctgctacttgagaaaatggagagcaggttcttttaactcaaggtactgttgatcctgggagggcaaggagcaaggagcaaggagccagcaagtctagacacattccagagctgcgagccctggattctgtccaagccatgagggattttatgccctgggcttagattatggtgcatcagggtagccttccacccattagcacagagcttggtgttccaaagaccacaaggggatttagaccctgaaccctggacatgttccagagctcttttacgttatgtcagatatgcaagccccacctcagcttctcccaacactcagcttttcccaacacagaggaagaaatctgatatgcatttgtctcaggtgggcagaagaatgactttgaattctgccctttgtcccatacctgtgaagatacactatcaatttacattttcaggctaaaattcagcagaactattttagggtaaaggaatttcctaatgtacaaattgtgaaggaggtatgtagcttttcttttcttttttttttttaatctttgaggttatcttatttaggaataaaatgggaaacaaatttccctgatgcagttcccagcttgacttttcgcttttgcttagtgagcccggagtcctgagatttattttcctttcacagttcccatgtcaaagttggacatggatttgctggagtggaggcaagaggcacagataccaaaggacctttggggctgagtgttggatgggtcatctacacagatttgaaagggggcaggcctggggttgggagagcaccatgcttttgtcttagagacctgacctctgagaaggatcgtcattgacccgaactggggtctgcccacccagctggtaagaccagatatatacactgaggtttgcagcagtaaaaaggaaggcagttatttgcagagcaccaagcaaggaggaccaggaagctaatgcttaaatcctgacctctgaggtggcttgcaggtaatggtttttaaaagcggggtaggccagcgcggtggctcacgcctgtaatcccagcactttgggaggccaaggtgggcagatcagctgaggccgggagttcaagaccagcctgaccaccatggagataccccatccttactaaaaatacaaaatcagctgggtgtggtggcagagccagctgtggtggcggcgcctgcaatcccagctactcaggaggaggctgaggcaggaaatcacttgaacctgggaggtggaggttgcagtgagcagagatcgcaccattgaggcggacgttgcggtgagccggggtcatatcattgcactccaccctgggcaacaagagcgaaacaccattaaaaaaaaaagaaaaaaaaaagcaggggtaaatttcaggaaagctacaggcaaagttgtaaatcaatcctggaggttacacattggttttgacctaaacgggtgggatatcttgaagtggggcttacaggtcggggtagattctaagattttctgatttgcaatggttaaagagttttgtttaaaaatcaaacaaaaaagaatattagtgctggctcatgggtatgaccttctccaggcccctcagaaagaaatttctaatggcaatcacagttcagtccttagttctcccttatctgaggtctgtgtgtctgcagttccattttgtggggctccaggtttctgaaaactagctcaggaacatatgttaagatattatctttaatttctatggggagccaaacatcttctggctctagtttctttggctattgttttaaactactattaccttcttgcttatcaaattgttcatttacttttctaagctagctaggtgcctggaattttccttgaaggtactcaagaatttcttttatgtccatgcctgggggacccagagacccctaagaggggtccctgctctgtctcaggatccaagagccagagcaatgaggagccagaaattagctgcggtcatcagcctctgtctgtggaaagcgaagaacagcctctacctgagattacgacagggaaaatcgttcctcccttcatctttaagcccctcaagcacgctgcattatgttcagttacctggagcaatggtctacattatatttcgtactcttttctgcaggaggcaacagaagattggttctgcatttttgtcaaatttcttgtagggccaagcgcagtgtggctcacacctgttatcccaatgctttgggaagccgaggcaggaggatcacttgaggccaggagtttgagaccagcctgggcaacatagacaccctgtctctaccaaaaacataaaaataaaaaattagtcaggcatcatggcgtgtgcctgaaatcctagctacttgggagactgaaacaggaggatcgtttgagcccaggaatttgagtttacagtaagctatgattgtaccactgcaccccagcctaagcaacagaatgagaccctgtctttaaaaaaaaaaaaaatctagtaggacatcatccataatgttcagagttccatataaaaagattcctataatctctctcaaaagtttgttctgttgatgatctaaacttgctttgtgtgtgctaattccctctcaaagacagccacagccataaattagtttcctggtacagtgaccctccccttcacccattgtataacacagctttgtaatattttccttagtgtaacagttccaatagtcctcatttatagataccttttgttgacaaaaaatatatatttgaagagattttattctgagtcaaatgtgagggccatgactcatgatgcaacttcagaaggtcctgagaacacgtgcccaagatgcgtgggttacagcttcattttacatattttaaggagacctaagacatcaatcaatacatgtgacatatacattggttcagtcctaaatggtgggacaactcaaaacggggctcacgggtcacaggtggcttcaaagattttctgattggccgttggttgaaagagttatgttattatctaaagacctggaatcactagaaaggcgtgtctaggttaacataaggggttgtggagaccaaggttctcattatgtacagaaagcctcaaaggtggctgcccttggaggcaagaggtggcatctttaacacatgtgatgctgatacttagttggtgcttgttaatttttgttggtgaatgattcttattcttgatctaagatggcaattttctgttatttgaggctttctatgtaactcttcaaacatggaaaacaacatggagtactatgtgatgatagatttcaactttaggggcaacatttattgattttagacttttaatagaaatcagctgtcaaaaaattagctgggcatggtggcggatgcctgtaatcccagctactcaggaggctgagaatcgctggaacctgggaggcagaggttgcagtgagcccagttcgcgtcacggcactccagcctggacaagagcgaaactccatctcttaaaaaacaacaacaacaacaacaacaacaaacagaaagaaagagatcacctgtcaaaccccaaagactaatgaggcaatgtgccatagtcaacataaagtttttatttcagctagaactactgagatgaacaggtcatgtagaatcggccacactcctcatctcctcaaatgctggagcatcttctgtccctagaaatgtgtgcggacaagagattacaggcttgttttttattcattatcaccctcccaaacgtaaagcaataggcaactattctgcaacttctcctcagtcactggttcccaactcagcacaaaaaagcactttcaaaattccattttctgacctgaagtttcaccaattgggtgtccccagtctttgaattttcacctcctctaaacattcctgattgttgtgtagaaatagaatatattcggcagctcatgtacccaacttttacacatgtggatagactaacagaagcatgtaaactaagcattattggttgttatgactgaatgttgcccctaaaaatgtatatattgaagacctaacccccagtacctccagatgtgactgtgcttgtgttactggaaggagggtcttgagtgagttgtctgggtccttggcgttttgaacaaagaattggacaaaatgcacaaagtaacaaaggaatgaaacacaggaatgaagtagcaaacgcagggattaaagtgagaaagcactccgcagggtgggagcgggtcccagcaagccactcaaggacccagttacaaggttttctgggcttcaagtacttcttttgaggttcctatgggtaaccccttatctggatgaaggatttggtctgtggctgaggctgaggtgaactggcaacctgtgcagatgcagggatggtccctgcttggccctcaggcagttcaaggcactctccctttcgctgtgagccttggtggagtggggaggtggtaaggagagtagcctttgagcctttgttatcggtgtgggaagatggggtttttcctttgggtttagctgtaggaagtttaagttaattggccttagggtccctgcccccagacacaggtgttttccttttgatccagctttatgaaattatcacgaatcggcctcatattccctgcccccagaccttggtgttttctcttttaggaagttagcacaaattggcctcagattccttgcctctagaccttggagattttccttgatttggcatgaattggccttaagttccctgcctccagaccctatttattctcctgcccccagaccctattctcctgcctcatttggagatagggtctttacagggtaattaagttacagtgaggttattagtgtgggccctaattcaatatgtcgacaaaaaaattatgaatgttgttatgttgttttcataaacgtttgtgtacaagtttttgcgtttacatgttttcagatatctggggtatatacctagaagtggaacttctgaataagatggtagctctgtttaactttttgtaaaattgccagtgttttacaaagtagctgcactattttatatttccattagtgtgcagggggttttgcatttctccacaccctcaccagcatttgttattgtctttttccttgtagccatcccagtattgggccccaggacaagatgtgctctggtggtggctccagtcccattcctgaacgtgccatgctgcagcaacctgggtcctgggccactgggggaacccagcataaattctttctctggaataataaagtcatatggactctaggcagcaccctctactgcacttagggactgtgagcaaccttgggctgtgaggtatgaagtatcatctcgttgtgggtttttttttttttttaagacagggtctcactctgtcacccaagctggagtgcagtggtgcaatcagctcactgtaacctcaatctcttgggttcaagcggtcctcctgcctcagcctcccaaatagctgggcctacaggcacacgccaccattcctggctaatctcattgtggttttgatttgcatttccgtggtggctaatgatgttgagcatattttcatgggatttctggccatttgtatattttctttggaaacgttaacagtcttttgttacctttcctttttacttttaatggctaaacacaatcttttccctttttaagctatttaagaaaagcaacaccttaaaataatacaacaacaattagatgaaactgaggtccagataactctcctttgctgattctattctttgtactcagaagtgccagtgttcatgaagacctgtagtccccacatgatgagaggcaaaaacatgagaattattagtttaggtcacattgtacactgagttttgtggtgggtggtttttatcttatttagggaagtttaaaacaatcttatttagggaagttttctcttatttagggaagtttattttatttaggaatgtttaaaaaagtttaaaacaattagggaagtttaaaactacatatttcatcctactgacagagttaagcttgcttcatctgcctagtgtcctgaagaaatttcacaagaggttacgagaaaatgtagtttcaaaaccagcaacggcagcaatatccacagccggttatggagattttaagcttttgtttgaaaaccagtttctaaaaatgaatccagttgcaatagcgtatgtattttaaagagaatgataattatatagggcagtagaagaaaagctggaaaaagaacacaacaaacttgaatgttgatgcaatttcatgctgctcttcatttatatctttgtatcttataaagataaaatagggagatataaatagggaatcaaaaatgtacatagttgagtgaaaattaagcataagcacaattatttaatgtgtagagtttgtgtttgagattgtgaaaatgtttcagagatgaatagtagaggtggttacacaacgtggtgaatgtacttaatgacactaagttatacacttgaaaatggtttcaatggcaaattttatgctatgtatattttgccacaataaaaaggttttttaagagtcagtagctcaaaagaagacagagagatcaaatggctagagatgcctagcactcaccttctccacaaagaaggaccaaagtaacaaattgataaacacacattgactagaatgtctaaggaagaacactggaattcagcagatagtgttcaaattcaaagaaaagaaactttgaggcacaaaaactcaggatgacagcatagagaggtaagcaatgcagcctaccgagatgtgcttggagccaggagggactccctccccattgcggagaaaaggttagcaggaggtccccagaagtctatatttccaccagacacctgcagtcatagctacaggagagccctcagccctcacagtcccttagtctagtatagggtactgcctagagtccacatgactttactactccagagagagaatttatgctggattcccccaatgtcccaggacccagggctgcagcatggcaccattttgggagtggagccatcaccagagtacatactgtccaggggcccaattgctccttcatctccacatccatccctggggtctcatccacatcccaccacaggtacccagagtgttgctgcataaagacacaactgagatctgttatagctgtgcagctgtgaccctggcacctgagcccatgcagccccttataccctgtggagccagaagactggtgtgtgtgctccccagaccctgaaagccacctgcctgggcttttgctgcttctgctgca

SEQ ID NO: 1249 - DNA, 146241 bp, Homo sapiens
attcaaaagactccagtaaaccttatcaccaaaaagaaagatactactaaacccaggctgccagcagattctaatctcctagaaaatgggagactttatgaggtattacagaatgttaaggagaagaatacctcatacttgtctatgccttacagcttataaagcattctcccagacatgtcctgttttgagctctgtacacaactatgtatgtggggcaggcattggggtgggtgttacaggggaatgacagacctcaatctagtatacaataagtaacttttgaaaatttttaagtgaaaaggtgatacactcagatctgtgccatagaagatacttttgtcagagggcaaaagatgaggacttaccagaaattcatttaaggagcaagaggtcctacagtaagctaggaccttgagccacagcaatcggcatgcttggaagctttttctccaagacaaaaaagtatttcagaaaagataaaaggtataaaatatttaaagagaatagggggcttgtacctcttgtacctcactttcagttttcttcctttctttttattattattattatttgttggtgttcctatttcatacacatccgtgcattcacatgcaaataatacatatcaacctttcaaatgtgtacagatgcaaggaaaagtagagattctgagcatttttggtggaatttctgtgattcaaatgaatgagaataaaatgtaaatagctggggaaaaataattatctgattgtacattaattgttattttcatttagagggtttcaagaatagaacagtatcctctgctaattgctgcctgtattcattatctattattgcataacaaatttccccaaaacttagtggcttaaaacaacaataaacatttattatctctgacagttttatgagtcaggagttctggagcagcttaagtgggtgcctggggtctctcatgggactagaatcaagctattggctgaggctgcagtcatctgaaggtttgatcccctttcaagatggctcacacacgtgacttggatttgggggcagggctcagattttctccacatagactctctcagggctacttgagtgctctcatgacctagcaactgactttccccggagcaagtgatctactagagtgagagccaggcagaaataatcctttttataacctagcattggctataacatgacatcacttctaccatgttctattcattagaagcagttcactaagtccagcccacattcattcaaagggagaggaattaggctacagcttttgaaggaggtgtgtgtcttagtctcttccagctgctataataaaatacctgagattgggtaatttataaagaatagaaatttatttctcacagttctggaggctggaaatctaaggtcaaggcactagcaggttggatgtctgatgagggcccaatctcttcttctaagatggtgccttgttgctgggcactttggaggggatgaatgctgtgtcctcatgttgcagaagaaatggaaaggcaaaaagggaccaacccattccttcaagttctataaaggccttaatcctatccatgaaagtgaagccctcatggcctaatcatctcctaaaagccccacctcttaatactgttacattgggaagcaagtttcaacataaaattcggagaggatacgaacattcaaatcatagaagtgtgtctaagattttgtgaatctattttttttaaaaaccacactttcttaacttaaaaaatgggtttgggtactttgtgctccagataaaattcccaacttactgaacagcttcacagaatcagatgtcctagggaactcccattctttggccaacaaaagcttgtcaacttactctgagatgtctcagagttgtgaaggcccacaatagtcatagttgtgttttttgtttgtttgttttttgagatggagtctcactctgtcacccacgctggagtgcaatggtgcgatctcagctcaccacaacctccgccgcctgggttcaagcgattctactgtcttaacctcccgagtagctgggattacaggcacatgccaccacgcctggctaatttttgtatttttagtagagacgggtttctccatgttggccaggctggtctcgaactcctgacctcaggtgatctgcccacctcggcctcccaaagtgctggaattacaggagtgagccaccatgcctggcccatagatttttttttaagtgtcaaccttgtaatccaaagagaaaaaggaacctaaaagtccaaaccactgtagcatcatcattcaaattattttccttggatatcaaaagaaagaacaatttttgaaagttaagtttcagtgtcagaggaaggaagaagccctaacaagttctgaggagcataaactgcaaataatgtaattacaacaatttgatacttattagaaatcaggaaaaacacctcctacctagaaaactgaaacattattacagtcaaacaagaaacttttctacatttagccaagtgaagaacaaaaaagtcctcaagacttttgagaatgctgcctgggagaacaaaagatcagtaccctaattactttggtaactttccatcataatcagtgtggcagtttgttttgctgctgcttctcctttcccttttaaatgatctgcaacttgtctgtcttttagatctaaaagataggcaaccattttcttctgtctgttgctttgattcttggcttatcagaatttctctgtatctgagctgaagtcaggagtcagcttcagagaacaaatctcaggaagtaaacaagtctgctaaaaaacaaaataacaatttgcaaacagcagcactattaacaaggaccctcaaactggtatcctcttaggagcagagtgtcttagtccattttcttttgatatgacagaataccacaaattggtaatttatatataaattccctttatatataaaaggaagaagtttatttagcatatggttttggaggctgcgaattcccagaacatggtgctggcatctggtgagggccttcttgctgtatcatggtatggtggagagcatcacatggcaagagggcaggagcacgcgagctcagatcactcttctccttacaaagccaccagtcccgccatggaggccccaccctgatgacttcatctaattcttttttttttttttttttgagatggagtcttgctctgtcacccaggctggagtgcagtggcatgatctctgctcactgcaagctctacctcctgggttcatgccattctcctgcctcagcctcctgagtagctgggactacaggcacccgccaccacgcccagctaattttttgtatttttagtagagacggggttttatcatgttagccagcatggtctgtatctcctgacctcgtgatcagcccacctcggcctcctaaagtgctgggattacaggcgtgagccactgcgcctggcccttttttttttttttttttttttgagacagagttttgctcttgttgctcaaactggagtgcaatggtatgatctcagctcccaggttcaggcgattctcctgcttcagcctcccgagtagctgggattacaggcatgtgccaccactcctggctaattttgtatttttagtagagacgaggtttttccatgttggtcaggcgggtctcaaactcctgacctcaagtaatctgcccaccttggcctcccaaagtgctgggattacaggcatgagccacggcatccgaccaacttcatctaattctaattacctcccaaaggcagccctatctctaatcaacataagaatttgggaatttaatttccaacacataaaatctggaggacacattcaaaccattgcaaaggagaaacataatatccaatggctattgcttttttaaaaacaaggagataaattgtctagtgtaattatgggggaaaatttagtatcttttggacctgaaaaggaaaaataaaatgtacttagagaaatgcaaccaagattgcctagtattggcaaaaaacccagaatatctacttttaaatcatggaacttggtgacaaaggcactatggtgcttggtacaatcataaaggacaaagtcaaggactgggaaaactgaatattaagagtgtaagaacttacaagtactgagggatcccagaggcatcctatcccacttggcctctacacattcatttgttctagaagaataaaggtagcattgatccaagtcatactgatcttctgtctctccagataagactgatttataagtttacaccatctgttggggttagtgatgttattctctctaataccagttaatacctcaaaaagggctctgtttagctgagacaaacagtaacttcaaggacctaatcataaattttttgcaattttcactatgaagaaattcagacttcatcttgatctaaaccagtgtgctttcatttgtccccagaccctcagggatctgtcttctcacttatgagacattcattcaccacctccaatacacacacacacacacatacacacacacacttttttttgagacagggtctcattctgtcacccagtctgcagtgcagaggcaacatcacagctcactgcagcctcaacctcctaagctcaagcgatcctcccacttcagcctccagagtagctgagactacaggcatgaaccaccatgccgagctaattttttgcaatttttggtagagacagggtttcgctatgttgcctgggctcgtcttgagctcctgggcccaagtgatccacccacctccacctcccaaagtgctgggattataggcatgagccaccatgcccggccttttctctccattttaagtcactccccctgccccccaactaccataattctattaaatacttcaagggaaattttgaagttggtgtccctgagccaaacttttagaagaggtacttttccctgtgctaacttcagccttttctttgttaggtcccttcacgcactggaagggaagtttgatagcgttttaaaagagtgagaaactcagtgtggaaagaaaaaaaaataaaaaataaaaacaagaaatgttagctttcagaaaagctatttcacaatacactgcaataaccacaaaaatcgagagttttgccttacaaccctaggtttaccactgaagtatgtatgacctcaagagagtcaattaactttctgattcgtagtttcctcatctctcaaatgagaaacttgaaccagttaccctaaggtatattataattctaaaatgacacgattttatatcaacatgccccaaaagttattgaccatgtgatatttgacactattattaaggcctgccaaattatattctatgtgtggacatgattccttctaaaaccagagtaaaaaccattccaaaaagatacttgagaaataatcgggcaattggggggcacccacataacgtttggttgttcagtttcataacagtaccactcttcccctcctacaaccaccactgctgtccgtttctacttccctcaatgctttttcaccctagactcttaatacctctccagggctagaagtcaccattttcttcagagcagtcccgatagtatcacctgtgtactctgcctattagatggtggaggtagcaaaatatcttacatgataaaagtaaggatcatctggtgggagaggtagagattggttttggacgtatttagttagtcccttttgcttctcaaaataaacatctttgtgctcagttaaaagctttccaagatgttcacaagggaagagggaattcttgccaaaaacttaagcccagccagacagggatactaaaattttgctgcctgtggaaacacgtggccacgcaggactttggcataaaaacagtcatctgtgcttaaatgatggcagtgtagacttctggtggttcagaggctatgttcagggcacccaggcacagtgtacagggtctgacaactccattggcagttcccattcaattacagttcacagcacactcttgtctatttacagaacttacaactcggcaaaccttggtccttatggttggaggggtaaagagaaacacttctctcactcttttcacagttttagttctgcttccaaatcttaacagttgcaaaatgctttagaagatctaggcccaagagcccatctgcaattttagtgttgtgaccttgggcaagacacttaaccatctctgagccgcaactttcttgtccataaaatggtgataatgatccttgttctactttgcttacaagaatgttgtacagatcaataaaataacataaataaaaatacattaaaaagtgctatgtaaatacaagatttttaaattatcaggtgcctcctcttcttctctgctctttcctttatctcatctgtttctgtgtcctttaagcatcttcatggtcttttcttagtccaaaattccccatgtggttaatgcttagcttcttaaacacgggctttttatcaaccaggcaaatctatacctatatatgatctacctacctccccattcagagccaatctattacctttagtatagtctcattcatttccagttgcatgaattgaggacttaatgtctctgtgtcctaggctagggatacaaaattgaacgagcagattcagccctcgaggaacacaccattagatctaagcatcttagaccagtcaaataggttcatcaggtctacataagttgcagttgaaccttctctccctggaagagaactctgcttctatgagtttaggtgtatctggacagtttggggcagaagttgaactttgaagtcctttaatcccactgttctggagaaggcaggcaactatccaagcctccttgaaattatttttcacattcctttgttgactggccccatacttccccctctttttttcctaattcaatatcttatttaatgttgagcttttgctagtgttcaagtccatgttagacaatgagaattggttccattagcttagctatcaggtcagagaaatgagaccacctgtagcaacatgacttactgtttgctctagtaaattcttgcccaggaagataaacttgtagagcaataaataatttcactgtttgtgtcaggaaattcctgaaaatcaatttatttgaaagttgctcatgtgggcaaatggccctcttctcagggcaataaattcacttacctgggcaaatagttctcttatcaaacaactatgcacttatcaagacttgctttaggaccctctcattgctgtgtccatcagatctacacctgctgggtgcggtggctcacatatgtaatcccagcactttgggaggctgaggagggtggatcacctgaggtcaggagtttgagaccagcctggtcaacatggtgaaaccctgtctctatgaaaaatacaaaaattagcccggcatggtggtgcacgcctgtaatcccagctacttgggaggctgaggcaggagaatggcttgaggggaggtggaggttgcaatgagcctagattgcaccactgcactccatcctgggtgacagagccagactctgtctcaaaaaaaagaaaaaaaaaaaaagatcaccctacaccctatgtatttctgcttctgtcttccctttctgggataatcctagaactctgtcaaggtgatgctctccctcattgcaggaggttcaacaaactcagccgcacttgatcaacagattattctggtggcttcttggggagttggcagttgacaacttggtgcatcattcagtaaagcaagggaaacagagggaaaaaatgtcttaaatttaacatttgccatttctttaaaaagacctctatagtcatcatcatgtgaaaaatcagaattttgttagagttccttattctttttatatgatttggaatagtctttattttgaattacatatgaggtggtacaccataattgttttgttacttggagcttctaaaaggctccattcactcctgggttcctccaaagatctttctgttacaaataactcccttttctacccattatactttttatatatgttgaaaagtgattagctagttgtgttcacactaaagtaattggctaatattcgaggaatttcactgaaagtctgagaggggctatgttggagttagttcactgttcacactaagcaaatttggcttgtaatctggctctctcaaccagtttaaaacctggaagtttatcaaaaatgtcacacatggaaatgagcacttgtggcacttgtttaaattcatgaaatagcagtcattttagagagaagagcttggtgagtcagaagccaatcttaccagctcagtctgagccctgctgaacctagcccatttttataaacctagaaaattgatgtctacatagcaatcatgatagttatcatgatatcatgataccatgacttgtatattttctaaaacttttcaagcctcagaggaaacatttgagttcagtatttggcttttgttgacttctaaagactaaggctgggcacagtggctatgcctgtaatcccagcaatttgggaggctgaggtgggaggatcacttgagcccaggagttcaagaccagcctgggtaacaaaggaagaccccagctctacaaaaaatgtaaaaataaataaatacataagtaaaaataaagacttataaccttctttgtaagtatgcatcccatggtaaattgagtcttaatttttccctcatggatgccttttattttaggtttatttcagaaaatccaaaggtggttactattttaaatttgagtattttgcatgcagaaattgagcacaggcttgtttcctaagcaggtaagctgggaacattatcatatcatttcttgagttctggtgtattcagcagagaccaagatgttttcaaatacattgtgctaattttgacaattgtgtgaggtggtattaatctccccattttaaaggtggtgaagccaaagctcagaatttaaatatattattaaagactttggaaaaaagtggtagagtcaaaatataacctaggtctacctaatttcaaagtctgatcttatttttaccttaccacattgtcacagactttaactcctagccatttttgaattgtttttatcttttaattctatcattaataagcattagtgagtggtatcattttcaaagaatgtataaaagatttttaaagcagaaacaaaagctcaaataatatctttatatactcacatgttaatcaagatccaggatattatttaagtaaacaaatagctatcctaagatgtaactattaatgaaactctaattaatgaatttgctcatttgtcttctttatttgaagacattactgcttctgatatatgcatatcctacaatgttatagggtaaaagagatatctcttcctcatccatcactatgttcctggttgaggcccctataacaaaagacattaacaacagaaaaacacacaaatgtatttaatatcttatacctgacggggggggcttcattcataaggaaatgaagacgtaacaaagaaacttgtgtatttttatgcttaggtttgatgaagagtagtcaattgtggagaaatatcactagaggacaaaaaaaatgatctaataataataaactgggggatcttagtaaggcctgtttgttcagattctcttctctgtgtccctgtgtcttcaaagataaagatgttccttccctccagctatcaggagggcacttctcacatgaggttcttatgacctgcttcaggggagaaacgcccgtaggtcaaaaagtgaccttcctaggttttatgacctccttcagggagggggaggggctcggggaaggtgagagtaacctgcctgcttctgctgttctcaaattccttcatcttaaatatatttaatatgccaaggcgccatattttggaatagcatgtcttaaaaccaatcaatgtatttatttacttatttattttgagatggagtcttgctgtgtcacccaggctggagtgcagtggcgcaggcttgctcactgcaacctccgtctcctgggttcaagcaattatcctacctcagcctcctgagtagctgggattagaggcacctgccacaactcccagctaatttttgcatttttagtagagacggggttttaccacattggccgggctggtctcaaactcctgagctcagatggtccacctccctccctgccccaccgcctcccaaagtgctgggattacaggcatgagccgctgtgcccagcaaattaatgtatttttaagtatttcaccttggacttattacatgtgttctttgttaatcttattaaaaagttgcttttctaacctagaaatttattttgtatcccattacatcttataaaatgatcaaatggccaaaacattatttttcaaaaattcactttattaagttaatataatatgaacctgcagcatttttatttagaagaaccatccctagtattacatattcagtacatctgcactttcttttttttttttttttttgacacagtcttgcactgtcgcccggggctggtgtgcagcggcgcaatctcggctggctgcaacctctgcctctcgggttcaagcaattctcctgtctcaccctccccagtagcagggattacaggcacatgccaccacgcccagctaatttttgtatttttagtagagacagtgtttcactgtgttggccaagctggtcttgaactcctgacctcgtaatctgcctgcctctgcctcccaaagtgctgggattacaggcgtgagtcaccatgctcggcctgcactttttctaactaaaggttcaagacactgaagacatgaagttgtattcgaccatttctgtttttaaaatgttatttaacaagttatgtgagtgatcggaagggcttcttttctgctgtttatttgcatcttatgcttttcctttttgctctgtcttctatctcatttcatttttacaccttcttacttttaaggacatttatcacacgctgcaaatgctgcttgtgcatctctattctgtttatgagcaggataatgtcattggcattttaatatttcacagcagcagcagtcatgaccaaacgttcccctcattggttttcctttttcctttctaactcttcctctttattttttgttcttcttaagcctgaacagggtacctatatgaaatcaaaagaaagctgtcatttaaaaagggatgaccctagccactagggcctagcattcaggaaaaaaacaaattcgtaccctgactgctccacaagtagcaagccagcatggatcctggactgtgaggccagtgaaacagacgcagcagctgggatggaagaggagtttctgattggcctgactacttgagaaaggttacagggagtgggaaaaatctgacctttctcgaaatgaggaatgtgcctggaggattccccacacgaaacaaagaatggttcactcatcacctgtgtgtttccattctatattcagagcaaagcagtgatctcttggttattctgtgacaggtttcttctactgtggcaaaaagcctgaactgatggccttccagatgtgtattaaaacgatgtttctgaatgggcaaaataacataactgctgttttaactcaggcatagcataacagctaagacacctccaccaggttcttcatttatacacaggcacttcggtctttctcttttatcatcttcttaccttgtaaactttaaaagtctccatggtaaatgtgataggtggcataaaggaaagcaaaggtcttgatgagagtaacataacatttacaaattaccctaaattactgctaataatagtactttgtatttgtgaaattttaaaaaatatttcatatcgctatcaaaactatccattcatttgtcaatgaatacttactggaaactatgtaccaggacctctgggtgatggggaagagagcaatgttcaagacaaataagattgctactctcatgtatctcatattctagaatggtgtgggatggagggagacaaacaataaacaagtaaacaataaatgaacagaacatatccagataatggccagatatacgaagataataaaatggtataataaagaatggctctggaggggtgactgttttagattgagtggtcacagagtctctgtaaagagaaaataggacagaatttcttagaccttgtggagaacctaaacctatctattccagtgttcttagcttaggtaagaaaacacaggtcctgggaacttaccagtgagaaaactaagatcagtagaggttaaagtcttactgtcacaaacaagtatacagctattctacacagtgcctgggcagacgtagaactgtaggcaattgcttggtcatcagacagctcctttgtgcatattagaagacaagtgcccctttctcagggaaaatgcccttgtgcaatgcacaacctacatagttaataatgtactatacgttttacaatatctaaaagggaggattttgtcttcaccacaaagaactgataaacatctgacatgatagatatgataattaacctgatttgattattccacatgagcccacaagtatatgcaattattgtttctcaattaaaaataaaataaatatttaaaaaagagaaaggaagtttggaagtggatagtttgtcagggacccaacctacttccatcttttgttctgccatatttaacttctattgctaagataacattacggctcaagattatatacatattttaggtagcactaacaagagacaaaggagatgcatgtcctgcctttaaggaacttcaaggaagttctacaacacacttcggtttacatgtcattggccagaataagtcatgtgaccttttgcaaaggcgactggaacatgtagtctgttagttaagtggccacgtgttcagctaaaatcagagttctgcttttaaaaagaagcagggcggggcgcggtggctcacgcctgtaatcccagcactttgggaggctgaggcgggtggatcacctggggtcaggagttcgagaccagcctgaccagcatggagaaaccccgtctctactgaaaatgcaaatttagctgggggtggtggcatgcgcctgtgatcccagctgctccggatgctggggcaggagaatcgcttgaacccaggaggcagaggttgcaatgagccgagatcgcaccattgcactccagcctgggcaacaagagtgaaactccgtctcaaaaaaataaataaataaataaataaataaataaataaataaataaaaagaaacagacaatggatattggaaggtagccagtagtccctgtcacaccatccagacccaggtcacctgtgtcagatctggggacaggaagtgtcagtttgtgagaaatgaaaaagctagtcattaagagttataatatctgggggctgactctaccacttactagcccagtgactttaagcaatttacatattctcttttagatttagattctttactcattggaagaataaagacactatctaatgtttagggtttcttgacgattaagaggtaatatttataagaaataaagcacctggccaggcgcgatggctcacacctgtaatcccagcactttggaaggccgaggtgggtggaatcacctgaggtcaggagtttgagaccagtctggccaacatggtgaaaccctgtttctactaaaaatacaaaaaattatccaagactggtggtgcgtgcctgtaatcctagctacttgggagactgaggcaggaaaatcgcttgaactcgggaggcagaggttgcagtgagccgagatcatgccattgcactccagcttgggcaacaagactgaaactctgtctcaaaaataaataaataaataaataaataaataaataaataaataaataaagcatttaactatatctagcacgtgagaagcatttagtaaatatgattttccttttttctatctgttataaatagttttcccagctctgcctactgcagctttttttttttgactcctttttttttttaaaggtcttaagatgagcctgtttatcttcatctctccctatctccttcttcaacagtcccaaactatgtgcacagaaagcagcttatgctccaggcacggtggctcacgcctataatcccagcactttgggaagcctaggcggatggatcacttgaggtcaggagttcgagacaagcctggccaactggtgaaaccccgtctctactaaaaatccaaaaaaaaaaaaaaaaattagccaggtgtcatggtgcatgcctgtaatcccagctacctaggaggctgaggcaggagaatcacttgaacccgggagacgaaggttgcagggagccaagatcacaccattgcattccagcctgggcaacaagagcgaaactccatctcaaaagaaaaaaaaagcaagctgcttatgcctcaaaattcctgtcacaatgaggctgagtagggaaggtcatttctggatggttcaaacatgaactagacaaatgccccttttggggtgggacagccaaaggactggtaaattacaaggctgccatgaaggcatggttgcagcctgtgatcttacgggttgtgtcctgcacagagcaccagattcagggatagagcaagggctgacatctaggctgaaatccttttgcaacaacttggggggaaaaaagagctttttttctaacaggtctaaagggtcaattcctatgcctgcaggggcccatttttctaaattccacaaaggaaacttccctgctggcttccctacaggcagtgtccccagtgccctgtcagaacaggtccaaacttcagtcattctgctttcttcagtgccctggccaccttccccagtccacgtgccatcaacaaacacaggatatagatctgcttgttcagtgtgtacctttctctgcgcctccattacctgagtcatgagtatgcatagtggtcacttggctccaacatttttttttttctttgaaaaaggaaaagacaaaactttgtggcttaaaagtagaagtgtcaagatggtgttacaattatagcaccaaagtctggagaaatgcctcagacatggaaagcattaaaatatagaaagctagttttctaaaatagttttatggcactgatgtaaatggtttggatttttcccctttaaagtttattttacttttttcttcttctgattgtaatcagtcatctaaaagacaactggaagaagcctttgagaacagtcgtttttaaatgatgagctatcaaaatgactttgggaagaaaaaaaaaaggaacctacaagtgcaatgacccagaaagtagctacacgtatgtaaggaggtataaagctccagtgcttaggttcaaggccatttctttttgcttaaaggcttgaaaacagagaagaaaaaattccacgaccccaaacaacagtaacataaaaaaactgtcacccaaagtctttcttcccagaggaaaaatgtcaaggatatttctaagttaattggacacaccattagaagtgacggtctgttttagatgttgcccctctgaaagccttttgggttgatatcactaaaccactctcttcatgaagatattttatttccaactaaactgtgtagtaaatcatatattatttttaatttttaaagttcttagagcaaattattttgagctaccaactctgttgggtcttctgctctagatgatccttaatgtgagaagtcacataatcctgaatcctgaaacactcttttttttttttttttttttgagacagagtttcactcttattgccccaggctggagtgcagtggcaccatctgggctcactgcaacctccacctccctggttcaagtgattctcctgcctcagcctcgtgagtagctgggattacaagcacccgccaccatgcccagctaatctgaaacactcttgaagtctacttggctaagcatttggtcagtgtttttttgtttagttggttttggggttttttgggttttttttttttttttttgagacggagtttcactctgtcccaggctggagtgcaatggcatgatcttggctcactgcaacctccgcctcccgggttcaggcgattctcctgcctcagcctcctgagtagctgggattacaggtgtgcaccaccacacctggctaatttttgtatttttagtagagatggggtttcaccatgttggtcaggctggtctcgaactcctgaccttgtgatccgcccacctcggcctctcaaagtgctgagattacaggtgtgagccaccatgcccggccggtggttttggggttttttttgagatggggtcttgctatgtagcccaggctggagtcagtggtgtgatcttggctcactgcagcctcaacctcctgggctcaagcaatccttccacctcagcctcctgaatagctaggactacaggcgtgtgccccaacacccaggtaatttttgtaaacttttggagagacaaggtctttttatattgcccaggctggtctcaaacttctggcctgaaacgatcctcatgtgtcagcctccctaagtgttgggattacaggagtgagtcattgtgcccggctcttgtgttcatagtttcatgaagaacttgtgattttttttttgtcagattccaccatcttctcattatattaatgaatgccacccacaatgaaaaattaacattttcggaactagagagagtaaaataaggtaagatactaatattgttggccattttttgactatatatcagcacctgcagcatatgccatagcagttcccatttcatgtaaatatagcctcaaaaagtgctcttttttgtcccacgcctacagtgcaaaaagataaaagtcaaaaactttagtttaaagttcacttttttaagtttatgtaaccaacttgtgacagctaatattataaccagagataactcaagaaagcctagttatggtatactggaaaaagaatagcagataactgtggaatgcaccatcagtgataaatgactctttaagcaaaagtgtcaggcagttcaaaaagcaaaaaggcaagctgtaaacagcagtaggcagagggcagtcttaatatgcatgctgttgtttgaggggcctgcagagcatcaatcttttcagttacaatttgcagatacataatacagaaaacctctatgataaaaccttctggaaaggaaaattgacatgtgtacaaacagaaagatttcaatgacaccccaaaatatactaatgtgaatggtgcagcattaagttctgtaggaaaaacaattgtcctcagaaatcatccattcattcattcatttagcaaagatttattggatatctactaagtaccaggcactgataggtcctgggaccacacagataaagaaaatatggtccctgcaccataaatctcaggttttattaaaacaagtgccatctacatatactcaaatgcattcatatgtgcaacaaaaggtagcacaagaatttcataagaaaagctgggagctgtggcctgtgcctgtaatcccatgctacttgggaggtagtgtgggagaatgcctgagcctgggagtttaaggctgcagtgagctatgatgacaccgctgcactcagtcctgggcaacagagtgagatcctgtctctaaaaaagaaattaaaattaaattaaagttaaaaaaaaaaaaagaattttgtaacagccctatttataattccccaaacaggaaacaaccgaaatgtccatcaacaggagactggataatgggagagtcatacaatgaaatactatttagcaatgaaaataaaagcaattgcagccacataaatgaattttacaatgttagtagatataaaattttacaaagaaggtagatataaaaatatcatattgcattattccatttatataaggtttaaaagtggcaaaatgaatttgatagagcacacgataaggcttagagtggagatgagggggtagtaactggtcagtgtacagagggcactgctgggcagttttgttttctgacctgggtggtggatacacagttatgatcactttgtaaaaatttattgatctacacacatgcatattcagcatttatcttacatttctgttaaaaagcacattgaaaaataaatgccagctcttttaagcaatatatttcaatgtatgttaattgttgggagtgtttcaagaacgaatttttggcctttctgtgacttgcctcaattttcttgtgcttggactctatccagaggaaagtggatgcttgaagatacagcattggaaatatcattaaagatctttaataattttcttccaattttgaaaaaaatcaaccacattttggtctactcatcgtttaacagcagctctaaaatgttaagaattctgctaagaacttaccctaacagcaaattcatatacaaaaattttgctaatttttcaaaatcaagttcagatcttaagttaaattgttatttgacatttgctttctacatattaaaaacctaccaagaggtttttgtcagcggagtgaattctgagagaaatctaacgtgggcacaaagaagttacagccccaccaaatactgttttgtttttatatttgagtgcctacctgccaattactgtttattagcttttgctcatgtgggcagatgcccttgataaaaccaaaatttgttattgaacaaagtcaaattctccaggtaggtacaatgttggagacagccacataattcatatctgcccagggctaggaccttgagttgacaaattttgccaaccttaactagtaaagcttagatttgctaccaggccttttcacctagaagtccatgaccatgttctcagaatgaaatgtactttcatgggcattctggaggtacaagaactactctgtttcatttgtattctaagcggccaggcttgaggactcatgcagtctttaatttataaatagcattttataaagcacagaattccaagaggtagaaaatgttgtgttacagaaatggtgaataagtagaaagtaaatagtccttcagcaatagtgaattttgacaggaaaacaatgctagcataagcctatcctacatagtgactgcctgtgttctttaagtgctactattgtattttgtttgatttaaaatagaatgaaaaattctcagcctgtaagtcccaagaagcagactgactgacatcagtagcatatgccccagaatgaaccaaagcagacattaaaaatatatttaattgtgaaaaattccaaacgtacacaaaagtggagagaatgtgccaattacccagtttcaacaaaaatgaacattctatcaatcttgcttcatctatcccttccacctatacctatttccttcctttatttctttttacttcctccctccttccttctcttccccttcctttttcttttcttctttcttgcttccttttcctgaaaattttatttttatttttatttattattattattttttttttttgagatggagtctcgctctgtcaccaggctggagtgcagtgacacgatgtcggctcactgcaacctccgtctccagggttcaagcgattctcctgcctcagcctcctgagtagctgggattacaggcgcgcgccaccacgcccggctaatttttgtatttttagtagagacggggtttcgccatgttggccacgctggtctcgaactcctgacctcaggtgatccacccgcctcggcctcccaaagtgctgggattacaggcgtgagccacagcgcccggctcctgaaaattttaaaagaaagtctcagacatcatgtaatttcctttgtaaatactttagtaaacacctctaatttttttttttttttttagacagatgtctccctctgtcgcccaggctagagtgcaatggcaccatcacagctcatacagccttgatctccctggcttaaacgaccttctgcctcagcttcccaagtagctgggaccacagacacgtgccgccacacccagctaattttttttttttaatattcttgtaaagatggggtctccttgtgttgcacaggctcatctgtcacttttttatgcagaaatttgttatagaaactggctctgctgggcacggtggctcacacctgtaatcccagcactttgggaggctgaggcggaagaatcactagaggtcaggagttcgagaccagcctggccaacatagccaaactctgtctctactaagaatgcaaaagtagctgggtgtggtggtgcgtgactgtagtcccagctactcaggaggctgaggcaggagaattgcttaagcccaggaggcaggagttgtagccagctaagatggcaccactgcactccagcctgagtgacagagtgagaccctgcctcaaaaaagaaaggaaaagaaaagaagaaagaaagagagaaagggagaaagaaagggagaaagagagagagagagagagagaaagagagggaggaagggaagaaggaagggagggagggagggagggagggagggagggagggagggagggagggaaaaagaaactggctcattttttcctgtaagatgttttattttgcatagggcagactgtctccttgtggttatttcacttgttcctctatcctccataagcggtggttaaatctagacattgattagattagatttgattcattcatttttttttttttaaccatcgtggccattttaggcctcaatttgctgtcatttaaaatgcttttggacttggcataattccctgctgtatatttttgttgttgttgtttttagttattatttaatatggtactttattctgttagtggccttttgtaaccgcccgatgggttcaccttgtcctctgcctagacagagctgatttatcaagacaggggaattgcaatagagaaagagtaatttggccggtggggtggctcatgcctgtaatcccagcactttgggaggccaacgagggcgtatcacctgaggtcaggagtttgagaccagtctggccaacatggtgaaaccccatctttactaaaaatacaaaaaaaaaaaaaaaacaaaatagatgggcatggtgacatgtgcagttgtagctattcaggagactgaggcaggagaatctcttgaacctgggaggtggaggttacagtaagccaagatagccccactgcactccagcctggggggacagagcgagactctgtctcaataaataaataaataaataaataaataaataaataaataaataaagtaattcacgcagagctggctgtgcaggagaccagagttttattattatgcaagtcaatctccccgaaaacttggagatcagagtttttaaggataatttggtggggggcagggggcagtgaatcaggagtgttgattggttggctcagggatgaaatcatagggagttgaagtttttttcttatgctgactcagcttctgaggggaggccacagaactggttggcaggtccaggtgggaccatccagttgttagaaatgcaaaaacctgaaaagacatctcaaaaggcagatctgaggttcacaatagtgatgttacctttaagagaagttggggaagttgtgaatcttatgacctccggaataatggctggtaatatttaggattccagcccttctcattctaacttgggtggctggtggcctttcattcattttacaagaacagtctagcttttgggaagggctcttgttatttaaactgtaaactaaattccttcccaaggctagtttggcctatacccagaaatgaacaaggacagtttagaggttagaagcaagatggagttggttagctcaggtatctttcagtgtcataatttccttagttatagttttggaaaggcggtttcactcttattccgtgaatggacactcagcctcttatcagcagagctgggaagagaacctaaatctttccaagtcttatgctgtgccctatctatcacagaatgcttctggaaggagaagaagagctccctttttgtatttctcacatccaccataatcttttgaaattagaaccctgcagcagtcttggaaaaagtaccattccactcttcccagtcaaggactcataaaacccaccgtaaggacaatgttaatattactgttgcagttgaaaattttctttaccatcagcaattacttttacagtattttgaacaaaattgaatgctgggtcagagaaaacaaattcctagggattgacgatcatcaatgataattctttccatttcctagtgtctaattttttcagatcagcttgtcatatattcattgtgactatcttaattattgtaagcctcactagtattaaaattcttttttcccaagactggcaaatagaatctaaatctttccaagtcttatccggggccctttccatcacagaatgcttccggaaggagaagagctccattttcctatttcttatatcaattactgatcattgatgatgattattgaaaattgttaacgttagataatgtaaaccagaaagtatctgaaacaggactcaatcagtatagaaagttattttgtcaaggttaaggacacatctgtgacacagcctcacaaggtcatgaggacacacatctgaggtggttgaggtacagcttgctgttatacattttaaagagacatgagacatcaatcaatatacgtaagatgtacattggttccatccagtaaggcgggacaacttagtggggtggtgcttccagatcataagtaggtaaaagacaaaaggttgcattcttttgagtccttgatcagccttccactgaatgcacaatttagtctgcctcggtgaatctgcatttttacaaaatagggcagagaaagcaatcagataagcctttgtctcaggtgagccttagaaggatgactttgagttctgcctgttttgtccacaaggaatttccttgtgggcaaattgtgcgggaggtatgtagctttttatcgtggtagctatcttatttaggaataaaatgggaagcaggtttgcctgacatagttcgcagcctgacttttcctttggcctagtgattttggggtcctgaaatttattttcctttcacaataataagtaatagggtttgctataataatccctcttttaaaatgaaataagataggctggtcgcggtggctcatgcctgtaatcccagcactttgggaggccaaggagggtggatcacaaggtcaggagatcgagaccatcctggctaacacgatgaaaccccgtctctactaaaaatacaaaaaattagctgggtgtggtggcaggcgcctgtggtcccagctgcttaggaggctgaggcaggagaatcatttgaacccgggaggcggaggttccagtgagctgagatcaggccactgcactccagcctgggcgacagagtgagactccgtctcaaaaaaataaataaaataaaataaaataaaataaaataaaataaaataataaaattgaaaattattattttcttctctcatcatgcctaaaatcaggtgtccaaaagataacaaaatcttaagtcaggttgtcatattgacacagagggtttggaagctgtcttttgactcaaacaagcttaggcctcttctgttgcagaaacaccactgtattcattgctatttattacaactgaactctgttactgtgattttagccttgtctccacgggaacccatttatttatttattttgtaaatatctgtattctgttgaaggaagcccatttattagcaaaagctgttacacactttattttcaaaaatacccagtgttttgaaaagactcccaagttgtgttttcctctactctcataccaccaccacaacaatcatcaacacagaagacttcggtgaccaaacgtggggatttttccccacatgccaagcagtgaacaccagctgggtgtcctccaattaaattccacactgtcgccgggcgtggtggctcatgcctgtaatcccagcactttgggaggccgaggttggcggatcacctgaggtcaggagttcgagaccagcctgaccaacatggagaaaccccgtctctactaaaaatacaaaaaaaaattagccaggcatgatggcgcatgcctgtaatcacagccactcgggaggctgaagcaggagaattgcttgaacctgggacgcggaggttgtggtgagccgagatcgtgccattgcactccagcctgggcaacaagagcagaactccatctcaaaataaataaataaataaataaataaattccacagtctacccagagacagtgtcagatcccataaggtgaggttttagtccccaaaactgcccctaaccccaaacaccagtcgttaagtcagggcctctggaacttctgacccattggcttcaaattgggattcccaaaaccccctcctcgggtttgattaatttgcgggggcagctcacaaaactcagggaaattaattattctattatgtttactggtttattataaaggatattaccaaggatacagataaggagatgcataaggcaagatatggggaaagaggcttccatgccctccctgggcgcaggacactccaggaagctccatgagttcacctatctggaagctcccgaacccagtcctcttgggtttttatggaagtctaatgatgtcagcatttcttcccccagtgtataaggcgggacggctctagtgggggtcttaagactcacaatcagaaaggcgggaaagatgagagtcctgccttggggcaggtgaaaggagagcaggaggtcagaggccttcccctaaggcctaacatgcccaacatgataacaaaatactctaacaggggctatgggagttatgagccaggagcggtggacaaaaaacattatataatacctatttatgtgtatataccattatatattatatatatgcatatataacattgcatatcatattattatataattatacacaataccaattaatttatatttttagtattactaattaataatatttattattgatttatattattatctattaatattattatataattatatactattaatatattatatatatataaaatctcctggccccaagcgatcctcccatgtcagtatttcaagtagctggcactacaggcttgaaccaccacaccaggctaattttgtttatttttttatagagacaaggtcacactgtcttgcccaggctggtctcaatacatgtaatataatatataatatacatattatatccatatatatgcacacataaaataacaccacagccagtagtgaatatgaagtcaatattgttctagatcagggagattattgcatcccccaattgctgagggaagattacaaggcacttgtctgagacttgcatggttctactgaagtgaagcagtagaactcatcaggcacattttttcaaatgaaaagaaatgtggcattatgcatgcaattatggacctttaaagataaataagccttagagaagcatcagagcttctcaactgaaattaaagatccttaagatagatatggaaagaaattctccaatgccatccccttaagcgtagctgaatttcagtgaagagtaattcaagaagtaaaaaactaagtatgggttatcaaatgtttcttatccaaagacttttcttggattttgggattttcttctacttctttttttgtttttgtttttaactcttattttatatggtattttattctcttcaaaagtgatctcttcaaaatcatgtagctttatcctgggtgggtttggggcaaatctcagcttctcttgaatctcctcaggccttttaaatcaggttcagcatctgtatttttaatattaaattgcatacattaaattccattataactagtatattggcattttttacttgttttatttcaatactattatgctatagtgaatgttgagctagaagtcagtctcattttaaaaggagtaaataaaacattgataacttagatgtaagcttcttactgtgtttgagttttgaagtgaagaaaaagtgagcaagttaaaggaaaatggctacttgcatattagatgaaaaattacaaagtgctaaaacagctcatctctcctctctgtcttctcccatacagtattaatggcatctgatcacgaacttgtgctagtaaaaagtctgtctttcctgagtagagaccatagtaaataagcattgtctaggattagtgattctgaccagtgcagcaaacacttggatctgttgaaagatggaaattgtttgaaagattctccccagggcctgaaagcttgaaggcatgagtaactcctcccttcttaggcccagttccaaggcgcaaggctatttgtgccagcagcctgcgccagcaagatagcagaagcaggaagagagccggttagaagacatgtaccctgctgcaagacacctatccctgaagatcgagagagtccatcccggtaccacaaggcagttacgacagactgggacacttcctgtttacaggaagctataaaacccctcccccgtcctcatttggggctgacgccattttaggcctcagcctacctgcacccaggcgctcattaaaacagcatgttgcttcactctgcctggtgttgtctgtcggtgcactttcggggttcgaaccgatataagaaccttacaaatagaactttttttttttgagacagggtctcaactctgtcacccagcctggagtgcagtggcaagaccatagcttattgcaacttcaaccggctggtctgaagcagtcctcccatctcagtctctcaagtagctggcactacaggtgcataccaccaggccaggctaattttacttatttattgtagacatgaagtctcactgacttgcacaggctggtctcgaatacctggactcaaatgatcctcctacctcagcctcccaaaacgctgggattacaggggtgagccacagcgcctggcctaaattcttcctgtatttgcttggtgaaagaactaaactttcccagcatttttacttaaatgaacagaagtttgctagaattggatgttcaggaatttgttttgtatttagacaagagtttatgacactggcttacctcaaaaatatattttatggtattaaaacatattaagatttagaagcattttaacaaattcttacaactactgatcagaaattatcatgacagttaatatttatgcttccctctgttttcagtttcatccaatgcttctaatttaactactgcatggcatgtttcagaaaaaattgaacaaataaaaaatttgtattccattggcttagatttaaattttatatctattttatcttcatacatgttatgattttcaatacacagtagcagaaaactcaggttgatttttcctgcgcaaaacgaaaaattgaagattgcacaaatcagttttcctgaagtgtaagtaactgcaatcttaaagcagttgaatgctctgctatagaaaactagcatgtgtatgtgtatacacacatatatatgtatataaatctatatattgaaatatttgccttagtaaaatcattgggatctctaagaatggtatcgaatggaaagtctgggaattcttatcaggaatcctcataaactcaagccctggtgaataaaaataatagaatgaaggccaggagtggtgccttacacctgaaatcccagcactttgggcggccaaggcgggcagatcgattgagcccaggagttcaagaccagcctgggcaacattgcaaaatcctgtctctacaaaaaatacaaaaactagctgggtctggtggtgtgggccttttgtcccagttacttgggaggctgaggtgggaagactgcttgagccggggaagtcaaggctacagtgagccgtgttcgtgccactgcattatagcctggatgaaagagcaagactttgtctccaaaatttaaaaaagaaaccaaaaaaataataaaaaagtatagagaattgtttcctaatatcatcaaagaacagaggctaggaagggaaaatagcaaggcaattttatatatatattatatatgtatttcaagaagcaatagatattttaaggattaactaaaatctttatagtcttcgcaaggtatattttattatttctttattttgcactaaaactcttaaaagtatagaagacgaattgcagaaaaggaatccagcaaaatggaaatatttatgtcctaccctaaaggaggaactataagtggtagagcaggtggtaacagctgtagaaaagaggccctctagacaaatcctaaggggttttggaaggaagaaagagatgttggcctgagacctgagatgaaaaaactaatgaagctggtatggagctttaactagcctgaggcctaattgcttcctcaataggtgatggatttagggcagcagtcctcagcactggctgcacatcacaataacctatgaagcttttgcaaagtttccatgctagggcgaaactctcttgagagtaaggtataaccggatcgaggtgggatgagggcctgggcctgagcattttaaaacattgccaggaatttctgtgctttcaggatttagaaccactgaggtaaggtttttctcacttgatatgtttatttttgcaagttcagcatctgaagatgtttcttttgaatttattatgtgcaattactatatcctgctgttaggtgagtaatgatcccattagttctttgggccacggtctagccaggcttaaagtatgagaaacagagaaaaacagtagcacactcaaattttttaagaaaaaagtaaaataaaatatactttattaaaacagttcaatacatgtaggattacaaccctccaaactaatgtttaaactgagcttgaaaatcagtctgataccttcctcactaatctgtagttgttagcaatcaatgtttattctcaacttggttattcataaccattcttctttaaaatgtttccttcattctctaaatccttatcttggagataggcctcttatattgaacactagtatagtcttacatgactgtttctgtccaaaagacatttctatgttctggaaagaaagtgaaatgcttgttcattgtattgtatctctttaatttcattttttatgtcttgtgtgggccaaaatgtaacatgctttttccacattagtagtcataaaacaggcaggacacggtggctcacacctgtaatcccaacactttgggaggctgaggcaggtggatcacttgagctcaggagttgagaccagcctgggcaacatggtgaaaccccatctctactaaaaatacaaaaactagccaggcatggttgtggatgtctgtggtcccagctacttggggagctgaggcagcaggattgcttaagcctggtaatttgaggctgcagtgagccatgttcttgccactgttccagcctgggtgacaaagcaagaccctgtctcaaaaattttttaaaaagacataaaacaaacttatttctgatatatgtgtcatgcaaaagaatgtatttattttctataaaaacattacactttagaataatatttaataaaagaaataatagaaaattaccattttgcaatcatcatacaaataattaattcaagcagcagtcatcaatggatgctaagatgcttgagttcaagtttcacagcatatttatctagtcttaaagtacttcccacaaactagaataacaaagatgaaagtggtaactttatagtggagaaacctggcagacactacttcaaccaagaaaggacattccaagggcacatgtcgtcaggacctcctgaagctgtgtcatcggcaaaaaataattcaaaaaaagaaaagaaaaaaataaggacataccggtaattatgtgcctcctgatgtgaagcaccgagaaggatacattatcacctaatatggtgttcccaccaaaaatgcctagcctgaaactgatcgtaaaaaaataatccaaccagcctggacacagtggcttatgcctgtaatcccagcactttgggaggcctaggtgggagaatcacttgaggccagcctgggcaatatgttgaaaccctgtctcttcaaaaataggaaaaaattaactgagtgtggtggcacacacctgtagtcccagctactcaggagggtgaagtgggaggattacttgatcccagaaaattgaggctgcagtgagctgcggtggtaccactgcattctagcctgggctgcagagtgagaccaggtgtcttaaaaaaaaaaaaaaaagtccggtcacagtggctctcgcctgtaatcccagcactttgggaagccgaggcgggcagattacttgaaactaggagtttgagaccagcctggccaacagagaaaccccgtctctactaaaaatacaaaaataagctgggtatggtggcatgcgcctgcagtcccagccaatcaggaggctgaggcaggagaatcatttgaacctgggaagtggcggttgcagtgagccgagcttgcgccactgcactccagcctgggagacagagccgagactccccctcaggaaaaaaaaaaaaaattgaagaactgtgccatatcaaagtagattaaaaagcatgacaattagatgcgatgcatgatcctgaatcagattctggatggaaaaggtaattattttttcacaaacgatattaaaggaacaactggagaaatttgtatatgcattgtccagtaccacatcattgttaaattttcagaatatgatcattgtgagaggtgaagccggctgggcttctgggtccggtggggacttggagaacttttctgtctagctaaaggattgtaaatgcaccaatcagcactctgtgtctagctaaaggtttgtaaatgcaccagtgagcactctgtaaaaacagaccaatcagcgctctgtaaaacagaccaatcagcaccctgtaaaacggaccaatcagtgttctataaaatggaccaatcagcaggatgtgggtggggccaaataagggaataaaagctggccgcctgacccagcaccagcaacctgctgcggtccctttgtgtgctttgttatttcactcctggcagtaagtcttgctgctgtttactctttgggtctgcaccatctttatgagctgtgacgcgcagtgggaaggtctgcagcttccctcctgaagtcagcgagaccaccaatgcacggggagggatgaacaactctggacctgccacttttgagagctgtaacactcacagcaaaggtttttggcttcacttctgaagtcagtgagaccatgaacccaccagaaggaagaaactcagaacacatctgaacatctgaaggaacaaactctggacgcacaatttttaagaactgtaacactcagcgcgagggtccgcggcttcattcttgaagtcagtgagacccagaacccacgggcaggaaccaattccagacacaactgtgctctagatatgtaatgcaaagtcatggtttttgtgagacacatgctaaaattatttaggggtaaagaaccgtgatgtctgcaggttactttctaatcattaatatttcatcaaagtaataaaataattatatacagaaagaaaaaaatgacaatttgttaacaactgatgaacctagatgacagatataagggaactcattgtactatatctgtaagtcttcgatttttttaaaagtaaaaatttgaaaaattcacatatataggctgggtgtggtgactcacacgtgtaattccagagctttgggagaccgaggtgggtggattacttaaactgaagcatttgaggccagtctgggcaacatagtgggaccccgtctccacaaaaaatacgaaaattagccaggcatggtggtgtccgcctgtagtcccaggtactcggagactgaggtaggaggatcacttgagcctgggaggtccaggatggtccggccatgaccaccccactgcactccaacctatgtgacagagtaacactctgtctgaaaaacaagcaaacaaaaaaaacgaaatccaacaaactcagagtactcaatagcattgttaagagacaaacattgtttgcgaatgtccctagtatgttttctttttttattccacttctccttttacccactcttgaacacttcaacaaaaaaatttttttcttgagacggagtttaactcttgttgcccaggctggagtgcaatggcacgatctcagctcaccataacctctgcctcccagattcaagagattctgctgcctcagcctctcaagtagctgggattacaggtatgcgccaccaggcccagcttattttgtatttttagtagaaatggggtttctctgtgttggtcaggctggtcacgaactcccaacctcaggtgatccgcccacctcggcctcccaaagtgctgggattacaggtgtgagtcaccatgcctgaccacttcaacaatgatttgtgaagagacagacagtaaagctctaggaaagaatcctacttaaattaaatcattttaaaattgacaaaatcctttcatagttcaataaccatttcctaatttataggtttaataaattcaggctttttgatagttgggttttcctgaggtttttttgtttgtttgttttttgagacagagtcttgctctgtcacccaggctggagtgcagtggcatgatcttggctcactgcaacctccgcctccaggttaaagcgatattcctgcctcagcctcctgaatagctaggactacaggtgtatgccaccacacctggctattttttttttttttttgtatttatagtagacacagtgttttaccatgttggccaggctggtcttgatctcctgacctcaagcaatctgcccgccttggcctcccaaagtgctgggcttacaggcatgcgccaccacacacagcctgagggctttttttttttttttggtgatagagtctcactctgtcgcccaggctggagtgcagtagcacaatctcagctccctgcactgcagcctctgcctccctggttcaagtgattctcctgcctcagcctcccaagtagctgggactacaggcatgtggcaccacacctggctaattttttacttttagtagagatggggtttcaccatgttggccaggctggtctcaaactcctgatcctcctgcctcggcctccctaagtgttgagattacaggcgtgagccactgcacccggctgagtttgttttatcatagtaaaatatatatagcataaaagttaccattttaactatttttaatggcattgagtatattcgcattgttgtgcaaccctcaccattgtccatctccagaattttgcatcatccattactgaaactgtactcactaaacaatacttccctattcctactgtatatctttatatattttgcatattaatcccttgtcagatatgcgattcacaaatatttcctctccattttattgtttgcctttttactttgatgcacaaagtctttaattttgatgaaatctgctttgtcttgtgttctgtgcttttggtgtcatagccaagaaatcatttctgttttgattttcaaagtggtgaatagccataggttttttttttccccctcacatttagaaaagaaatgagaattccagttatttatcatctgtggcatgtgcaactgacacattttggtggcagcagtgtgtaacttcaaaatgaaagtacataaattttttgtaagtaaattatcactgacccatttgctgaaatgtagttccttttttttttttttttgagatggagtcttgccctgttgcccaggctggagtgcagtggcgcgataccggctcactgcaacctccatctcccaggttccagcgattcttctgcttcagcctcccgagtagctgggattacaggcgcgtgtcaccatgcctggctaatttttttttttttgtatttttagtagagacggggattctccatgttggccaggctggtctggaactcctgacctcatgatctgccctcctcggcctcccaaagttctgggattacagacatgagccactgcacctggcaaatatagttcattttaagtcatccttttctcaggggatttcctcatatgctccaaaacaaatgcctcagtttgttctgttttgttttgtttctgttcaggcctcttcattttgcctgagtgtcttttgtgagatatccacactgctaggcacagatgtcctctacctgtgcctgtctctgaagactgtaacttgccctctggccagagggagaaggaggaaaccttgcctcttccccagccccgatccaggtgccttgagcttcctggcatagatgtctgtttcaacttcctgccccagggtggacatggtgctcggtccagcaggtggcaggaggaagaaccattgtgaaaggtgtcaagactaccacgataggagaaagagattagagttcaattccaaatacagcaaggacagtggaaatttattaatataaccaagaaacagaatgtgaggtgtgtgcgaggtcattggatgaaaaattacttgagaagaaacatcaaggatagaggaagtcttgttacactgacttaataggattcttgctaaaggtagaccaagtaatcagacatcaaaggtaggtgcttccctctaaactgatgtagtagcattcttgctatttattactgggccatgcaagcccagcaagcatgcggaccaaggtcaagggctggtgaagaagagggctcaaactaactagagtttaatcaaggagcaaattgtcgtcagtctctctctctctttttttttttttttctgttcaaagagagaagagtcaatacaatacagtggacagtacagcttttttttttttttttttttttttttttttgtcatccaggctggagtagagtggtacgatcatgtcttattgcagcctccatctcctgggcccaagtggtcctcctaccccagcctcctgggtagctgggagcacaggtgtgtactgctatgccctgactaacttttttattttttgtagagctcaaccaatcctccccctaggcctcccaaagtgctgggattactggcatgaaccactgtgccaggcccaatttgatacttttcttgcagttcaacgtatcaaataaacataattaaaaaaaaactctctctctttacaaggtgaaagaataaattctttgagattttccagaggccctttaggaaaactcaaattccattcaaaatcaagatttcatttagaatttgatttggggaagacaaaattgtcagaaatatcaaaaggtttgagcatttgaatagatgaaatctatgtgtgacactgtgaaacaatagccacctatttgaccagagtgacagcaaaagaattcaaaagtaggccaggcgtagtggctcacacctgtgatcccagcacttcaggaggccaaggtgggaggatacacgaggtcaggagttcaagagcagcctggccaatatggtgaaaacccatctctactaaaaatacaaaagttagcagggcatggtggcgcatgcctgtagtctcagctactcagaagcctgaggcaggagaatcacttgaggcaggagaatcacttgaacctgggaggcagaggttgcagtgagccgagattgcaccatagcactccagcctgggctacagagtgagactctgtctcataaaaaaaagaattcaaaagtaagtatggaagataaaacagccgggcgtggtggcttacacctgtaatcccagcactttgggaggcagaggcgggcagatcatgaggtcaggagatcaacaccatcctggctcacacggtgaaaccccgtcgctactaaaaatacaaaaaaattagctgggcctggtggtgggcgcctgtagtcccagctacttgggaggctgaggcaggagaatggcgtgaacccgggagccggagcttgcagtgagccgagatcgcaccactgcactccagcctgggcgacagagcaagactccatctcaaagaaaaaaaaaaaaaaaaaaaaggaagataaaacaactgtaaaggaaacatagcttttttttttttgatacggggtcttactctgttgcccaggctggagtgcagtggcatgatctcggctcactgcaacctctgcctcctgggttcaggagattcttttgcctgaatagctgggattacaggtgcccgccaccatgcccagctaattttttgtatttttagtagagatggggtttcattatgttggccaggctggtctcaaactcctggcctcaggtgatctgcccacctcggcctcccaaagtgcagggattacaggtgtgagccacggcacccgtctcatagctcttttaaaaagtgaaaagtgttgtcttcaataatgaaggacataatcaaggttaacacaaagcatagaaaattactctgataagacacaaaatcttggtttcctgggcagatcactcaaaagagaaggataacctctttctcttacaacctcttattaagagcagaccaataatccaaggaaactttgtcatttttaatatagagaaagctaaattgtagtttcacaccagtgtacttttggtgtacaattttactctttctagtgtactttttttattttttaaagcccttataaataaacctatccaatcttagtcagctttgaccacgagataaaattccttttccaagattccttttccacaagcactctacaactttttatatccattcagtttttgtcttctactttttatctttctcattctggaacaaccagtcattttaatctaggataaaattactctctttttctcttaacagaaacacatcctacattgcttgcatactttttatgcaaagttgcttctcctcacccttacaatttctagtagttttatttacatatattgattattatttttaaccattagtaacctttttttttttaacagagaatactaggaagtagacaattgtggattgtctgtcacataccagccgtctgtggcagactagcgtattttatgaatatatatcatccgacaacttttataggtatatgcttcttcatagtacaattttccaatgtggcaaaaagaacatgtttattaatagatccaaatatatttagcttggctgtaccatataaaaatgagaaaccagaagtatataaaattaaacttatgcttaataatgaatgtttcagtagtttatcttacttagaaatgatctacatatttaatggatatctattatttaacttagcataactgtaaggttccaagttaccaaaaagattttggaaactattttcaggcagacataccattaaacatagctagccatcatctcacgttatttctctgttaagtacttttatagtctacgcctgttaggcaagtatcgcataagcaaaaacctaaaaagtttcaatacattggtttttttgttttactactgtgcttgatatgcataaagtaatgaatatcaagtgactcatttttactacatcattacttgtacatttgttcttagagtgaatttataatttttataatctttgtgttgttgttgttttgagctagggtctcactccattgcctggctggagtgaatggcgtgatctcctctcactgcagcctcgacctcccaggctcaggtgatcctcccaccttggcctctggggtagctgggacgacagccacaagccaccatgcctggctaattttttgtattttttgtagagacagggtcttactatattgcccaggctggtgttgagctcctgggctcaggtaatctgcccaccttggcccccaaagtcctgggatttacaggcatgaaccaccgcacctggccaatttttataatcttaaatatctagtaaatataatattacctcacttgactagtaaccccaagtagaataaaaatgagcatatcatacttaatgatgaaaattataagacatactcatttttattaagccaataataccaaattagtcttatttatcaaagatttactcaatacatgtgaacttgaaaaacatttgggttagttcttatatttctaagagttttaggaatattaactttacttaagcacgtatttatctctaagtgaatttaaacagcattcttttataggattttagaaattaatttgatggggccaggcgtggtggctcatgtctgtaatcccaacactttgggaggccaaggcaagtggatcacttgaggcctggagtttgagaccagcctggccagcatggtgaaaccctgtctctactaaaaaataagagaggccaggtgtggtggctcatgccggtaatcccagcactctgggaggctgaggtgggaggatcacctgaggtcaggagttcaaggctagcctggccaacatggtaaaaccctatctctactaaaaatacaaaaattagccgagtgttgtggtgcacacctgtaatcccagctactcaggaggctgaggcaggagaattgctccaacccaggaggcagaagttgcagttagccaagattgcgccactgtactccagcctaggcaacagagtgagactacgtctcaaaaaaaaaaaaaaaagagagacagacaataaaaatctgtccgttcggtttttaatttttaatttaatttaattttattttatttttacagagttttgctgttttgcccaggctgaagtggcacaatctcagttcactgcaacctccaccccctgggttcaagtgattcttctgcctcagcctcccgagtagctgggcgcccaccaccatgcccagctaatttttgtattttcagtagagatgaggttttgccatgctggccaggccagtctcaaactcctggcctcatatgattcacccacctctgccccccaaagtgttaggattacaggcgtgagccaccaagcccagcctgtccttacatcttaagaatcaaaatcaaaagtgcttcaacagactgtcatttgctgcccttcttcaggagccagactcatcaacgtgatccctaaccagtcaggagtgaaggcaaagtcttcaaaggtgaacacttgaggtcctgggagagcagttttgggagtccattgatgaatctgatcctatgtgagtcacaacaccataacagttcaggaaaaaattattctgacacttgttacaatgataaggaagactttattcaggacaattacaataggtatcaagactcaatagagtagagagacagggctcaattccaaatacagcaaggacaaatggggatttataaccaactttcagagttgtggagtctatggatggaaattatgaagatgagacatcaacggtagggaaattctttttttttttttttttttcctttttgagacaaggtcttgctctgttactgtcactcaggctggagtgcagtggcacaatcatggctcactgcagccttgacctcctgggctcaagcaatccttttacctcagcctcctgagtagctgggaccacaggtgtgtaccaccatgcctagctaattttttaattttgttgtttttttagagatgaggtcttgttatgttacccacactggtcttgaactcttggcctcaaatgatcttcctgcctggcactcccaaagtgttgagattacagacgtgagccaccatgcccagcctacagtagggagattattgttaaaccaacttaaacagggctcttgttaaagcaggccagggtgatcaggtattaaggatgagggattctctctatactgacttaatagaattcctgatacaactgaactatgcaggcctggcaaggatgggagccaacattgaggctaattgaaaggagaggagaattcagaggatttttgtttttttttttttgagatggggtctcactatgtcacccaggctggaatacagtgggtgagatctcagttcactgcaaccttcgcctcctgggtttaagtgattctcctacctcagccacccttgtagctgggattacaggtgtgtgccaccacagccggctaattttttttttatttttttgtatttttagtagagacaggttttcaccacgttgggcacactggtctctaactcctggcctcaagtgatctgcccacctcagcctcccaaagtgctgggtttacaggcatgagccaccatgcctggcccattcagaggatcttgactaaaatttgatcaaggagagtctttgccagtccctacaagggggatccgtattttcattttgcactaggccccacaaattgtgtagctagccagtcctgtacatagcccaggtagcatgaatacgtacgctatttgtttccttgggattctatttcctcaggcattagctggcgaaaagtttagcctgaacattctttttgccacaatctggtctccagatctcctagtgaacacatgcttggacaaagccaagcacttatctcccaagaatgaaataatttttagctatggattagttgcaattcagtttatgcaggaaaatattttctatctctagagtggcacggttcagttgataaggtgctaatttaaatgactaagcagaatgttaacatctcagttcaaaggatctgagtttgtgtaacttgctgattcatggcttcttttgaagaattgggaattaactggccttaggtttatattactaaaaagttcaccaaagtgtggctgggcatggtggctcacacctgtaatcccagctactcaggaggctgaggcaggagaatcacttgatcccgggaagcagaggttgcagtgagctgagactgtgccactgcactccagcctgggtgccagagcaaaactctgtctcaaaaaaaaaaaaaagtttaccaaagtgaacagaaatgaggagttgacctaaggacaaatttcagttctttacccccacccagaatgcagaagcaatcccccaaattgcagttttccagcttcaaatactcgaagatccagcctccatcagcccttgatagcaaagcttttgctgctgtaattgttatactaagattctttgattttattttcgccaagctttatagtatgcacttttcctttgagtcgcacttttcctttgggtcacacttttcggcctttggaacttgccctatgctatggtttgaatgtgtcccccaaagttcatgtgtcgggaaattaatccccagtgcaacagtgttgggaggtggggcctaataagtggtgattatgatatgagggctctgtccacatgaagggggttggttagttattgtgagaatgggcttcttataaagtgagtttggcccctcctgctctctcacacatgctctcttgcccttccgccatgggataacatagtaagagggtccttgccagatggaggcccttgacctaggacttcttggccctcagaactgtaagaaataacttaaaaatagtaataacaaattgcccagtctgtggtattctgttatagcagtggctcatacctgtaatcccagcactctgggaggccaaggcgggtgggtcacttaaggtcaagaattcgagaccagcctggccaacatggtgaaaccccatctctactaaaaatacgaaaattagccaggcatggtggcacacacctgtaaccccagctactcgagaggctgaggcaggagaattgcttgaacccaggaacccaggaggcagagattgcagtgggctgagatcacaccattgcactccaacctgggcaatagagcgagactccatctccaaaaaaaaaaaaaaaaaaaaaaaggcagggtgcggtggctcatgtctgtaatcccagcactttgggaggccgaggtgggcggatcacaaggtcaggagttcaagaccagcctgaccaacatggtgaaaccttgtctctactaaaaatacaaaaattagctgggcgtggtggtgtgcacctgtagtcccagctactcacgaggctgaggcagaagaatcacttgaatcttgcggggcagaagttgcagtgagtcgagattgcaccactgcactccagcctgggagacagagcaaaactctgtttaaaaaaaaaaaaaaaaaaaaaaatggaataaaggacaggtctagttttgtttaaacaggccccaggaataaagacctgtttttaactgtaggctgcttttaaattaagttcagttttgagaattgaattcattcagattaaccgtagagacctcaaggttactagattcctaaaagctactcacctccagaagacccaaatcgggtaagcctggaagttgacaaagcaacaaaagtggatcctgactctagaaatccaaagcagctcttgaccctctagacaacttcagtttcctccaggactcacatggaagcaagccaagtagttattacatatctaattcagtgtttgagtgaaatatgagagtgttgtattgggttaaagggcataggaaatccttttcgtcacatcacgatggctcttcattttatattctttgaataaggaagattccagaagttaccttctcaacacaaatcacaatggcttccacgatgggcagtgatgcttgagaaatgtcatgttgcttaacactcagactttttgaactatgcatcaatgtatttgtgtaaaatacgactgtaagggcccttcatgcaaagatgtctgcaaacattttcattttcttgtaaataattactggaaagggaaaaaagcaattagaaagaaggacttcagcatcctaagttcttgtgccccgtccaaatctgctttctaaagtctctatgggaaaaccagaaatatcattttaatggcctgggggggttcttgcattataagtatacagagcagtatgttgagaaagctgagtgctctgaatcacccaatgtactttatacatttatttagagaagaatagtttagttttaattatttatgataatagctctcagtgcactagtaaatgtcctttggtgcatattttgtaaaagtaatgaagtctttgtaatgtgagctttctcttcagctataagctgccctctttttttgctgaagaaccagggcagcagaatgtgtttgtgtttgtgtataagtgtgtgtataaattaccaggcttgaggtttagcaaaatgctattgaacgtaattgaggatttctaagaattattcctggatgtactcactgtcccatctcccaatcatcctctcttacagccatagccttagcaacttggccagagaaggaatcaccatgagggagatgagcagcctgtctgaatatttgtttttgttttctttcagtgtttttcttattgttcttcctctgtggcaataatctatgatattgtaataaaacacatagctagaaagaatataaatctattgtatttccctctggcctaagttatatatactatagcttatggataagtcttattatgtcaaggaatcttctctttttttcttttcttttttttttttttttgagacagagtcttgctttgtccccaggctggcgtgcagtggtgtgatctcggctcacagcaacctctgcctcctgggttcaagctattctcctgtctcagcctcctgcatagctgggattacaggcacgcaccaccatgactggctaatttttgtatttttagtagagatggggtttcaccatgttggcaaggatggtctcgatctcttgacctcatgatccgcccacctcagcctcccaaactgctgggattacaggcgtgaagcaccgcgcccagcgtaattgccttattttcaaatgagatcctaaactaatcatagtcattcagacagaataatagttctggcaatgtcaaaattatccacctacagattagacatggcttctgtgtgagtgaaacatactgaccagctttgcttcttgtctctagaaaaaagaaataaagagcctttcagacattagatttgaagtaaatgggccacccatgaattaaaaccaatggaagaaatcagataatctggatggaaatctgggggctgattcttgtgggacaaatgcagtgcctggttcctgaagcaacaatgccagaagggacatgtggggaacatgtcagactgaaggcaccctgctccatgtggatgggcacaaaatcggcggcaacttctaaaatgcgtggcaatgccacctgcccatcaaggttagaatgtcagttcacagatgcaacagaaaagacaagattgatcatgaaaattgctttaacacttcttttctttttctttctttcttttctttttttgagacagagtctcactctgtcgcccaggcgggagtgcagcggcacaatctcggctcactgcaacctctgcctcccaggttcaagctaattctcctgcctcagcctcctgagtagctgggattacaggcacatcccaccatgcccagctaatttttgtatttttagtagagatgggatttcacgccgggcgcggtggcttacgcctgtgatcccagctctcagggaggcaagaggcaggaggatagcttgagcccaggagttcgagacctgcctgggcaatatagtgagaccccattctccagaaaaaggaaaaaaaaaaaaaaaaaaaagaaaaaaagagatgggatttcaccactttggccaggctggtctcgaactcctaacctcaggtgattctcatgccttggcctcccaaagtgctgggattataggtgtgagccattgcacccagctttaacatttctatctacaaagttttcttgttaaatggaagaggactattgcagtcatctattgccatgtaacagatatcccaaaacttaatggcttaaaccataccattttatttatttgcttacaattcatgttaagattcattagttcatcatgagatccctccaccaagaaaaaaacaaactgtattgatcacctttggaggatcctagggaaacaactggctaatttaaaatctgcttagatgcttttgtagttcataggcgtggtaattgggtgttcacgtgcatgtgtgagatgtgtcacgctccagccttgttacaacatcagcatgttatccatctaacatgaaaacaataaaataaaacaaaataaaattgggttaatagagagaattaagaatttatcttgtctttacatatactctacctgccagcattgaagaaacatttgtcgacaaaagtatttcagataaaaaagaagcaatttttaaaatcaccatttgtaacccctaattagctgctgaccctaggcaatgactatcaatgtctgataatgtcataagaagagacttttgaacattgtatgtgcctcctgataggtgtgtgcaacatcacccattaagttgtgttgccaacaataacaaccaagtgttgaatctgatcaggcctttagttctaactaccatttcacaggaaataacaaggaacactgtaacacattttcttaaaaaaacagtataaggatggaatcagcaaaatctagactatgggaaactcagtaggtcaaaaaaccaagtttcttcaataaaaaaatttaaaaataaaacagagagtgatggggtggatggtaaatgggtgcagatgtggggagaaagttaaaatacttagcaatcagttgcaatgcatgggccttatttggatccaaacaaaaactgtaaaagaagaagaaagccaggcacagtggatcacacctgtaatcccagaactttaaaaggccaagtggatcacttgagctcaggagttcaagaccagcctaggcaccatggtaaaaccctgtctgtacaaaaagtacaaaaattagccaggcatggtggtgcatacctgtagtcccggctactcagggagctgaagtgggagagtctcttcagcccgggaggtggaggatgcattgagccatgatcatgccactgcactctagcctgggtaacagagcaagaccctgtctcaagaaaggaaaaaaaaaagaagaaaaagaaaaatataataagaagtcatttggggaagtgtgaacaatgaccagatatttgatgatattaaggaattattgttaatttttttagatgtgatggtaacattataattttgcttaaaaaaaaaagagtttttgtttgggtgcagtggctcgcatctgtaattccagcactttgggaggctgaggcaggaggactgtttgagcccaggagttcaaggttatagtgagttatgatcctgccactgcactccagcctgggtgacacaggaaagccctgtctcaaaaaatagttcttatcttttagacataatactaaaatatatacaaggaaatgatgtattatctagaattttttctaaataatcaggggtgagattgtaggtgggtatataagtatataggtgaaacaaaagtggctatttattgttagctgaagttaggcaacagatacgttgggaagttcatactattatctctatttgagtgtgtttgagaagttccatagtatttttttaatcaatggaaatgactgaaagaaatgaaatatcatagcttccaaaccagaatgtggagaaaaggaaagagagggcagggagaaaaaacaagaaaactttattagtcctgtagaaggcaagaaagaagaaaaaaaaagttacccaaatagtcatctcctagtaaatgagaccccttttcccaaatcttacacagtcatgtttcaactgctcatatctggtctctgtagtgaaagtgcattgagctaggacaagaggttctaatcctggccctctctgggctaagttgtgccttgcatggctcctcaggctatattaagagcctggacatcctttgaccattggcagctttgtgacagctggctggggctcgagattcagtttgctgccacagaagaaagcaaagccaactgggtcacatgaggaagtaatctgagcccttagctccaacctgtaaactaagtttcatcttgcctgctgctgtgtggctgtcagggataacctgatgccacatgaccaaaagaaaaagccaacctctaagacccccttgccgagaacgttgtcttttacaaattcttgaaatatgatttggcgagtttctagtaagagtgactggcaactgacttgaatgaaaataaatgtcagagaagggggaaatgggattggaggaatgaataccacaaagatggctgcatcttagtgactgtatttttagaggggatgggaatcttgaagaggaagaaaatctttcttccctctctcaaacattgttatgaatacatgttacttatttttttcttccttccaggtgcaaccctttcagctgctttctagttatttccccatatgttctctatttttttttcttttttgccctttgatttcttttttcaaagcagaactctacttattgccatctactaagcactgcatttctccccatatctctccctggatgtgcagctttcttatctcattccccatctccactcctgttccccttgcctctttgtcaaatcttgtgctgcttttttgttgttgttgttaatcgctcctctgcctctgcttttcctctgaatttctataccttagtcactctgaaactcagtgccttgttctcttcttgctcttgtcccctctagtgcatataacgtccatgaaaggattatgcagccagaagctctcagagtaaggtcagagtgttctgatgtggaaaagcttctatagtgactgcactttattggtggaggttgttgtcactttttatcctcctagagcatttactaggtataatgttgggatctttctttgttttgctcataaaaatctcttagggctctgaaagtcaggttgctttttccttcctaacttctgtctcaattttattatcaccttaagtggcatctggttgacaatgagaagaaagaattcagagaaagaaatagaatggaggaaaaaatgacctgtgacacccaccaaaatccagcttgggcttagctaatgtttttcttgagaaattgtggtacaccaacacggtaatactcttttataacgatggagatctagaactgttctaaaaaggaaacaaacaaaaaaaactatatgaaagaaaatttttaaaaaattagtataccaagttggtagattcacaaattatttacttggataacaatacctaaacttactgtatcagcaccatccaaaatatcttctatatattcacccatagttttctcaacagatttatgggccaggtcctattataagcccaattctgcaggtgagaaaaatgaggcacagagaggttaactcttttgtccatggttacacagttagtaagtagtagtctcagatctgatcccaagccatctggctacagagttcacggaattggctgctgtagcattttgaatttttatagaaattcttatttgctttcattaataaagctctaaatcaagtttagccctccagtgtttcagtaagaagatgagtttcaggatttggaccacctaaaaattttgtataaacctcatcacattcgacagacttctacctgatattcttaggtaacaggcagtgggaggccagagggaagccagaggagaaggtgtccaataataagaaagtcttcaggctgggcgcagtggctcacgcctgtaatcccagcactttgggagtctgaggtgggcagatcacaaggtcaggagtttgagatcagcctgaccaacaggtgaaaccccgtctctactaaaaatacaaaaattagccaggcgtggtggcgcatgcctgtaatcccagctattcaggatcgcgccactgcactccagcctgggtgacagagcgagactctgtctgaaaaaaaaaaaaaaagaagaaagccttcagttcctttgtttgtttgtttttgagatggagtctcaaaatggtagcccaggctggagtgcagtggcatgatcttggctcactgcaacctctgcctcctggattcaagcgattctcctgcctcaccctcccaagtagctgaggttacaggcacctgccaccacaccgggctaactttttttgtattcttttagtaaagacagtgccatgttggctgggctggtctcgaactcctgacctcaaatgagctgcctgcctcagcctcccaaagtgctggggttacaggtgtgagccactgtgactagccaaaagccttcagttcttaaagtgcttttttttttgaggcagagtctcactctgtcgcccaggctggggtgcagtggcatgctcactgcaacctccgcctcccgggttcaagcgattttcctgcctcagcctcccgagtagttgggattacaggtgcgcaccatcatgcctgactaatttttgcattttttgtaaagacgggatttcaccatgttggccaagctggtctcaaactcctgacctcaagtgatcctcccccattggcctcccaaagtgctgggattacaggtgtgagccactgtgcctggcccagttcttaaagtactttaagtagttagttgttcctaattatccaccactagacataatgctaatatatccttatagcataatctttgtttatatccatgattctaaaaaagttataatgaagacagtttaaaaataagtcatataattttcaccagtatcaggaaggaatattataagatcattgttaaatgatagttttcagagaaaattattttatatgaaaaattctaagtagaaccattgcatagaatacaattcaaaaattttaaaaagaacaagaagagactcaataaggataaattttaatgtaaccagaaatcagactgtatatgctggaagtaatatgtgattttaaaattcaacatgcatggccgggcatggtggttctcgcctgtaatcccagcactttgggaggccgaggtgggcaaatcataaggtcaggggtttgagactagcctggccaacgtggtgaaaccccatctctcctaaaaatacaaaaaattagctgggcatggtggcatgtggccataatcccagccactcgggaggctgaggcaggagaaacacttgaaccctggaggcagaggttgcagtgagctgagactgtaccactgcactccagcccaggtaacagtgcgagactccatctgaaaacaaaaacaaatcaacatgcacaacttaatttaaaggaattttaatatacaatgatataggccgggtgcggtggctcaaacctgtaatcccagcactttgggaggccgaggcgggcagatcacaaggtcaggagagcgagaccatcctggctaacacgatgaaacaccgtctctactaaaaatacaaaaaaaaaaaaaaaaattagccgggcatggtggcgggcgcctgcagtcctagctacttggcaggctgaggcaggaaagtggcatgaacctgggaggtggagctggcagtgagccaagatcgcgccactgcactctagcctgggcaacagagcaagaaagactccatctcaaaaaaaaaatatatatatatatctatatatatatatatatatagagagagagagagagaacgatataaaaaaatagaaagatgtagttgtgacatgaatgtgctattcatgtattgcaggcgaattgtcaagatgatatggtaaatttacatatgctggtggtagcaagtataaaacccagatatataagtcaaggtaggaaatatctatcatttgagaaggaattatctacaaaatgtaagattttgaccaggagccaagaaaaaggctgttgagcctcactgttagctcttgctcctatgagactacagaaaagctatctctcttctgttgtttacagtgaattgtctataatcttttaatagttggcaatgaatttgctggaatagctgagtgattatcaattcttatactctacagatcaatactccatcattaaactttggacatagctttcagttggctgggaggaagaagccaaccaagttgcttttccaagatgtgtcatagcaggcagtgtgagagactaagctgagatttaccgtatggctaaatatcctttggactccaaagttttgaagattactgcaggacattgaaggtgactgagactcacaccttcagtaactagtttctggtctgccctattcatatcaatgtatcatatcaatgatatgtagcctggaggttttgataactgacttggaaattctgccatagtctcatccttttattccccttactaatagagggttgaattagtggcattgtggtaccaaattctctggatgcatttgtgcaagtgtgtacacatgcatactcattacctctttattttctttgtgtgtgtgtgtgtgtgtgtgtgtgagacgaagtcttgctctgtcaccgaggctggagtgcagtggtgtgatctcagctcactgcaacctccgcctcctgggttcaagcgattctcctgcctcagcctcccgagtagctaggactacaggcgcgtgccaccacaaccggctaattttttgtatttttagtagagatggggtttcaccatgttggccaggctggtctggaactcctgacttcaaccaccacgtccagcccatacccattatttctatttcatatcataaacattctgaaaatttatttttcttttatgtacccgtcaacttttaaagtttaattttttaatctttaaataatttacatgattcaaattttaaaaaatataaatgtatacactaagaagtctttttctcctctctgttcccattctaaccaatcagttcttatttctgcaaacaaccaatgttgttagattttctatatccttccagacatatttaaagtatatatatataagaaaaaatatatagctatgttattgtttttttttttccttttactcaggtggcagtctattttgcatactttagagcttacttttatcagataaaactaaattttattatgttcagatgctttatctatcctggttatctctcttgtcctactctcccatttctcactcccaatatgcatttactctgcacttttgtatgctagaaatacattagtccattccctgattagtttagtttaggtgtttttgtttgtttatttgtttgtttgtttttgacggagtcttgctctgttgcccaggctagagtgcagtggcacaatcttggctcaccacaacctctgcctcctgggttcaagccattctcctgcctcagcctcctgagtagctgggattacaggcatgtgccaccacaccctgctaatttttgtatttttagtagagacggggtttcaccatgttgaccaggctggtcatgaaatcctgacctcaagtggtcctcctgctcccacttcccaaagtgctgggattacaggcatgagccactgcgtctggcctagtttagtttttattgtgctgaaatcttgcatatgtttagccactcaatattgtctgtttaaatggaaacccccaaataatgtgatatacacatgtacatcttttttagtacagaatctagtataataccaagaataattatgagtttaataaatgcctttttatgacactgatttcttttcttttctttttttttcttttttttgagatggaatctcactctgtcacccaggctggagtgcagtggtgtgatctcggttcactgcaatctccgtctcccaggttcaagtgattcttgtgcctcagcctcctgagtagctgggattacaggcatgtaccaacacacccagctaatttttgtatttttagtagagatggggtttcaccacattggcaagcctggtctcaaacccctggcctgaagtgatctgcccacctcggcctcccagagtgctgggattacaggtgtgagccactgcacctggccatatgacactgattttttatttatttgccacccacttagtgttctgaaaccagttctatctactttggtgactattcaattaaattttagcttgttaatatacatggattggccagatactggtagaagagatataggaccatgcctttatttagtcagtatgttataaaaagagatacaaaataattataaatctctgaattctttagaattctatctacgaactttatacaatccaaatcaaaataccagttagatttttttaggacattaaaaatacagttaggccaagcatggtggcacatgcctgtaatctcagcactttgggaggctgaagtgggaggactgcttgagcccaagagttcaagaccagcctgggcaacatagtgaaacctcatctctaataataaacaaacaaaaaaagcataaataataaaaatatatataattgtataaaaaatgaaatatataatatgtcattatttgtgtaagttaataatatctgagcacaaaatcatatacattttgtacctacaaccaaaagaatacacattagaatggtttcctggggcttgtggggagggaaaaagaatcaaaatagagtattggggcaaaggaaaataagtaagtagaataaaagcagatacttacacaatccattgatggtcatggaccatgaactgagaaatataattaagtcatctttctatgcccaggcaaggggcagggatgggaggtagatagcagagactttatgtctttgggtgagcctaaattgatgggacccttccacataagatttgagacactagacccagatacctttaaaaaatatatctcttacagcctgaatctgaatactggagactgactgattacagattctttcttagaatagaaaggggtcacgaagagctcaaagaacaaatgaaaacagacaaaaaatctgccctcattgatgggaggatgtcagaggtacacaggagccagctgtagaacttccagtagccaatgggaaaacaatttaagcaactaaataacaaagtagtattggactatataactcaacatatcagaggtcgggcatggtggctcacgcctgtaatcccagcactttgggaggccgaggtgggtggatcacgaggtcaggagtttgagaccagcctggccaagatggtgaaatcccatctctactaaaaataaaaaaaaattagctggacatggtggcacgcacctgtaatcccagctacttgggaggctgaggtaggagaatcgcttgaacctgggaggcagaggttgcagtgagccagaggttgcagtgagccaagattgagccattgcactccagcctgggtgacagtgcgagtctctgtctcaaaaaaacaaaaaactcaacatatcagtattcatgagtccatactgatataaataaattattgaataaattaataaattgaggagaacaaacaaatctttcatgctctcctgcagaagaatgacaaataatgtatgtagatactccatccataatgaagggagcataactctgcactccttgagtgtgggctgcacaaggagtggggagctatgcttcccaaagagtagaatgcgcaaaatggggataaggagtagccgcccgctggggaaaccagacgctccctcagccaggtgatcaagggtcacatcagcagtaataaatcatgttaatagatgtgcctttgtgtgatgtgatgaaaatggcactgtatctcagtgatcttcccaacaccacagaaccccagggtggctcatgcctgtaatcccaacactctgagaggtcgagatgagaggatcccttgagcccaagagttcgatactagcctgggcaacatggcaaaaccccatctctacaaaaaagacaaaaactagccaggccatggtggcacgtgcctgtggtcccagcaactcaggaggctgagatgggtagatcacttcaacccagaaggtcgaggctgcagtgagccacgattgtgccactgcactccaggatgggcaacacactgagactctgtctcaaaaaaaaaaaaaaagaaagaaagaaagaaagaaaaaacagaaattccttttttttttttgagacagagttttgctcttgttgcccaggctggagtgcaaaggcgcaatctcggctcaccacaacctctgcctctaggttcaggcaattctcctgccccagcctcccgagtagctgggattacaggcatgtgccaccacgcctggctaattttgtatttttttagtagatatggggtttctccatgttggtcaggctggtctcgaactcccgacctcaggtgatctgcctttctaggcctcccaaagtgctgggattacaggcatgagccaccacacccggctgaaaaaacagaaattctgagactatcatatccaagaggtggctcaggagacacgaaaatataatgtactatcctgaaaccaaaaaaagacattaggttaaaaagtaaggatatctaaataagtatggattttagatattaatcatgttttaatatttgtcattaatggtaatatacaataataggtgaaactgagggaggtggtagaagtgatatgggaactttctctactgtcttaatttttctataaatctaaaactgttctcaaaaaaagggtcatcacaaaaaaaagggggggtcatgaagtcagtggtctatgaaaccctgtaaaaatgtgacccatccccctctatgtataacaaaaaagttttctttcttgtcttccagctgaggaagtatttgattggtttggttggtttttgctaaacacagaagaggtctttgctcagagacacagaaagtgtttctcttctcttcctttggtgttatgagtgagcttgccaaactcgaaggcagatgtcttagcaccttccagtgttaatataactatgtatctggttggaacctgccccgaggctcccaaggcagctaataaatggccagtaatgaacactgatggccagaggcttctaaccattaggacagtggacccattctttcccagtcctcaaagttcaaccacatgcaactagaaagatagttttaaccaatccaaagtaatgttggttacagaatctcttagcaccagtgttcagacaggattacacgttggggttttcatcttctgatcctagcatggtacctaacactcggtaggcacttaacacatgttcattaagtaaatggcaatgtgttcctagagttcagggcagaattttaatatttcgtatatgggtctaataaagcaaagagccgtatagcctggctggcaaaataattatcacctaaaaaatttattaggcattttctaattcacgaaatttatccgttattagttcaactactataagtttcaagcctctgaatagcagaacagttcctgttatgggaatgttgggtcatatgtcacttgaaaggtatctttccctaagtatctattaatgtgctagcgtggactcaaaactggcctatcaggaatatttaatgtttctctcatgaggaaccttgaagcagtcgaattttataatttttttgtgtatttttttattagttacagaaccttgccaattcactcaagctaatctgcaagtcctgtcattatcacaaaaaagtactctggcaaattaaccccatttctcaatgcaggcttaataggaaagagagctattttgaaagctcaggggattacaagcactctttacaaaacgtactgcaacacactagactgtgagatacagccttaaatagttaaacaagtccatcgacataaactgggtacatttccatccttgattcttccctattgacttcattacttaagatgtacctgactggaagccggaaaaggcctcttgggagtgagcagccctggtggaggggagcagagggagccccttatttatgagggagagaagacatcattggaaacgtataagatttgaacaacaagcttcactggaatattattgagagagcaatacttggttatatataatcaggggttttgtaatgaatctgtggaaaggtaaccagtaattgcttagtataatctaaaactctgaaaaccttgtgataaaatagctacaaagaaatcaaatcaaaacacagtctcagatgttttgatcattgaagttggaacaattgggatagccttgaaagcttatctctaaaataagttcttacagaactccgtgagcagagaccaaaagcagacttttagaagaactaacttcaaaaaagattccctatataataagagtcattttaaactgaaatgatcaagacctcctagggattctaggtcatgcctaaaccatcacggtcaagttggacatgtatagagacctggtactctcactcttccaccttcggccccacttatatcccaggctgggcattgaagttccccatcagtcagttggacgggggtacaggacaggcccctttaaacgcagaactccctcaatactgcagaacactggaagagctcttgttcaagtgggtaagtgcagcctgagtgtctggtgagatcaaacctgaagagagcgtgagataaggagagagttgagtcattagtcatctcttttaactaactctctgaagttggctggcttcacactagacctggtgattaatggtaaagagatagctcttgcaattcaacttctgtaagtagaaagaaatttaaagcttcccctgagcattcgcttcctcttcgaatgcttcaaaacaaatctcagcatcagtaggctgatgccagttctcatcatgccccacaggccttgatgagggagacggagagagccaggtgtgccctattgaacaggccccaatggttctctgccttttcatagcaatctcctaaagggagaaccagagtcatcaaatctcaggacaaaatggcagccctaagagggcaatccactgtcagaaagcatgcataagctattattctgaagagaagaagattatttccattcactatagggctagtctgaagtttgcaaagaagtccttttcattcaattatcccttgaaggaaagtatgtatgtaaaagttaagaaaattcaatatcaaaaatagtttttgttttggctttgaaatttttcttaatatgtaagcaaaattcttagttctggagttgcagttactcagttatcaaaaatgatacagataagataacaaaccccattaaccacccagttgctcaaacagaaatctaggattcatgttaattcctttcttctttcacccctcacacccaatccatttgtttcattagttctcccttcaaaataccttaattcatccactttctccattctcatggcaccattctaatataaatcatgtctcacctgaattgttatcataacctcttaaacagaactaactcttgcttccatagtctatttcatggcagccagagagagatttttaaaacacccataagatctgtccaggcatggtggctcatgcctgtaatcccagcactttgggaggctgaggcgggtggattgcctgaggttaggagttcgagaccagcctggccaacatagtaaaaccctgtctctactaaaaatacaaaaaattagctgggcgtggtgacaggtgcctgtaatcccagctactatggaggctgaggcaggagaattgcttgaacctgggaggcggaggttgcagtgagctgagatcgctccattgctctccagcctgggcaacaagagtgaaactctgtctgaaaaacaaaaaacaaaaaaattggccaggcgtggtgatgcatgcctgtaattccagctactagggaggctgaagcaggagaattgcttgaacccaggaggtggaggttgcagtgagccgagatggtgccactgcactccagcctgggtgacagagcaaggctctgtctcaaaaaaaaaaaaaaaaaataggatctactgtgtcagtaaatctttaatggcttcctcacaaggccttacatagtttggcccctaactacctttcgacttcatttcctactttttttttcctgctaacaccactggtcctgtttggggtttcatgactaagccaagctcttatttccccttgtgtcctctggctgtaatgctgatcttctcataactggttctttttcgttcttcaggtcttagcataaatcatctccacatttaagatcttcctactggacctggcgcagtggctctcacctgtaatcccaacactttgggaggctgaggcaggaggatcacttgagttcaggagttcgagaccaacctaggcaacatagtgagaccctgtgtctaccaaaaatagaaaaaattagttgggtgtggtgctttgcacctctagttccagcaacttgagaggctgaggtgggaggatcacttaatcctgggaagtcaaggctgcagtgagccatatttgcaccactgtattccagcctgggggatacagtgagaccctgtctcaaacaataataataataatcttcaggccaggtgcagtggctcacacctgtaatcccagcacttgggaggccaaggtggatggatcacctgaggttaggagttcgagaccaggctggccaacatggtgggaccccgtctctaccaaaaatacaaaaattagccgggagtgatggcaggtgcctgtaatccctgctaccatggaggctgaggaaggagaattgcttgaacccaggagcagaggttgcagtgagcggagatcatgccattgcaccccagcctgggcgacaagagtgaaactccatcttaaaaaaaaaataataataataatcttccttaccaatccatagcttctccttccctggctgtcttctctttgttagtatcatcccccgtttgttttatttacagcacttacaatctgaaattgccctgtttatttaacggatatgcctattgttggtcttttccactcacaacaaaatctaatctcctaaccacatctgtcttgtgacatcaccacatctccaatacttaaaacagcacctagaacaatgaagagtcattaaaggaatgaagaaaagaaaagaaggaagtatataaccaaaagcagattggcaaactctttttttttttttgagacagagtttcactcttgttgcccaggctggagtgcaatggtgtgatctcagctcactgcaacctccgcctcctggattcaagcaattctcctgcctcaccctcccaagtagctgggattacaggcatgcgccacaatgcccggctaattttgtatttttagtagagacggggtttctccttgttgtccaggctggtctcgaactcccgacttcaagtgatccacctgactcggcctcccaaagtgctgggattacaggtgtgagccaccgtgcctggcgggcaaactcttttggcaaaaggccagacattaaatattttaggctttgcaggtcacttaagacttttgtcgcctattcttcttcatttaaaataattcttggctcttacaaaaaaacgaaaaaacaaacaaacaaacaaacaaaaaagcagatcaagggctggatttgccccaagggccatagttgccaatcctgatctagattaaggaagaagtttatctataaccctagttaatgtctaaattctgcaaacctgccagagttctaggttgtagtataatagaaattggagtagaaggccgggcgcggtggctcacgcctgtaatcccagcattttgggagaccgagatgggaggatcacctgaggtcaggagttcaagaccagcctggccaacatggttaaacccatctccacaaaaataccaaaattagccggtcataatggcgggtgcctgtaatcccagctactcgggaggctgaggtgacagattcgcttgaacccaggaggcagaggttgcagtgagccgagatcgtgccattgcactccaatctgggcaacagagcgagactgtctcaaaaaaaaaaagagagagagaaagaaattggaatagaagtgccagtcatgacttccttgcccatgaccccttcttagtgaaactgatccatccacagtttggaaaggcagatctatatacctcccgattcctcaacacgtcttacttcctattcatgactgattgtaccagatcaccccatcagatgacctctctatggaatttgaaattggaccactgaaatagaactaactagatgctgatggactcttgaagtaaaatatgtagttgggtaggtccatgacaaaccaaagccaaaggtaaactcatattttcagagaatggagatagcacaataaaaaagaagtcagtttgttcaaggaagcttgagaaagaaggagacacacagatagaagcacagacctgctgccacagggccccaagaagggtgaaaggactagccttgggtcctgaatgtccagctccatgtcccatacggtctaggtgtgcttcactaatgtccttgtatatctgggaagtgttctgttgtatctcttcttttatttttgagacaaggtctcgctctgtcacccaggctgcagggcaatggtgcaatcccggcttgctgcagcctggacctcttgggctcaagtgatcctctcacctcagcctcccaagtagcagggactacaggcatgtgccaccacacccagccaattttttaaattttttgtagagatgggctctcactgtgctgcccaggttggtctaaaactcctgggctccagcaatcttcccgttcaacctcccaaagtgcaggcgtgaaccactgtgcccagcttctcttcttaacttacctaatttgagacagtttctattcctgaccagaggaatgggtgtttcaagttaccgtcaaacctatcaatgaacacacacgtgtttggtgggtgtctgttatgtttaagacactgagagacatggtggggcaaacaaatacatgcaaaaaataacaattgtttccaggaaaagtaaatctggtagaggaatgagacataaataacataaaatgataattaacagtgtgaggcagtgtatggtaagtaccgcatatcagggttttatgtgtctaagatgttttaaaagttaattttaatggtatttagaacaaaatgaaaatagatgctgaggaaataatgactactatttcaaaagaaccacaacagtgaattttgacaaataaaattgttttgatcagaattattaacagaaaattgttttgatcagacttaataacattttaacaatttcaaaactgctaaccatgtgtcaaatctattaagatgaactgagaataagccattctggtgttctttctgaaagagataatgactatcctcagagtatctaaaaagtgtttggtcttaacaacaaaggaccagatgaagtccctgttgtgtcaaagtaaagtccccagtatttcatcaatacagacatcatgctaccagttgcttaaaaatgcactgcctgatatagtctttgtgctgacaaaacattcactaggaagagcgatctctagagatctatgtctgatgtgagttcgcataggaattaatttttcctgaaccaagatttgtagagatcttctagagatgctttctgcaaaatttgctcaacctgaagtggaaataaacttcatggtaaaggcagtaaatttactaggattttttatttttttaaagtaagtttgtaagggcaatacatttatcaggatttattattttttaaagtaagtttatagcaaagtattattttaaaaggaagtaaagatgggagggaagagtaagaaaatgggttgcctgctctagcaatgcacagaaattcagtatatgtaaaataatctgctatttagcccctaaacagtgtttttattcatccactgggcatttacacttgacgcaaaacaaggtatgagtcagtaattaatttatgtctatgtgccaatattgatagtactataccattaactaatcagtggctctcaagcttaagtgtagatcagaatcacctagaggcttgttgaaacacagattactaggccccactctgagtttctgattcactaggtctggagtggggcctaagaatttgcatttcttttttctttttctttttgggactgggtcttgctctgtcacctaggctggagtgcagtggtgcaattacagttcactgcaaccttgacctcctggcctcaagtgatcctcccacctcagcctcccaagtagcttatgaccacaagtgcctggctaattgttttaacttttaaacgttttgctagagacaggggtctcactatgttgctcaggctggtctcaaggattgctgggctcaagcaatccttccccttgggcctcccaaagtgctgggattacagtcatgagccaccaccccccagctgagaatttgcatttgtaacaagttccccaggtaatactgatgctgttggtctgaggaccatggagagaaccaattaactaaaaactattatactgacatcagccctgtcaccagtctggtctttcctgctgcatatacctagggagacaactagaactatatgaagaaagagtctaaggtggttttcttatgaattctattgatgaaaaatcatacagtggtgtgggggattctatctctaattctaattaatttttaattttttttcttcatataaggtcaaaggccagctgccagtgtttgcttaagtaaagaagcacatatagcaggcacaagcaaggaatgaattcaagtgaaaatctcaccaaagtgaaaccgattggttcacgctgattgtccagtgacagtgctgggacagtccagttttggtggttgggaaggattatccaaaggaataaaatactggcacatgctacaacacagatgaaccttgcaaaagttgtgctaagtgaaagaagctagtcctcaagaccacatgttacatgattctgtttatctgaaagtccagagcaggaaaatgcatagagacaaaaagtagattgattagtagttgctggaggcaaggggtggttcactaaaggggaagagtattctttctgaagtgatgaaaatgttctaattgtggcaatggttgcacatatctgtgaatatactaaaaaccattgaattgtgtattttaactgggtaactgtatggtatgtgatttatacctcaacaaagctgtcttttgaaaaaggattgagcccaggagttcatgaccagcctggacaatatagtgagacctcgtctctacaaaaaactataaaaattagctgggtgtggtggcgcacacctgtagtactagctactcaggctgaggtgggagaatcccttgagcccaggagtacgaggttgcagtgatggtgtcactgcaaaagagcctgagcaaaacagcaagatcttgtctctaaaaaaaaagaaaggattgtccatgtgcatactttgttcattctcatacttcataccgtgctgtcttctttccttagtacttgtacaggaaccactatgataaaagacacattggaagcacagaagaggggcaggtaaattacaatgagggctcagaggcagcttcctgtagagagtggctctcaagttgaattttaaagaacaagcatgagtagctagctagagaatgaggggatagggtgtgtcaagtgggagttaagagccggaggggaacttcagctctggaaggcaccattggcagtggcctgccccattcttggtcccagcacctgcagaatagaaccattctggttctagattttcctgggtaaccttgacccttggggtctggtgacttcatctccttctattccttcagccttaggactggctattggtagtggcttgctgttgttgttaacttctggattatctaagcatccttattggtttctcagctctttcatctctgctctgaagaccgaaaaaaaaaaaaaaaaaaaaaaagagagagagcaggctgtgggaggcatggaataatcaacaccatttctgatgggaaacttcgatgaactgtgaatggctggggtgaaggatgtgtgtaagaggagaggaacaaataaaattagagaagtagagtgttaggtattaagctaaaagccgcagggagccattgaaggattaagtaggggatctgattagcatttagaaagatcattctgatagcaatgtaaagaatgggcttattgcagttggccatgaacagactagcaataagaaaacaaacatgtgggaaactgtttcagtgagggagggtggactagtcagcaattctcaaacattttggccttaggtgctcttcatactcttgaaaattattaaaggctccaaggctgggctcagtggctcacgcctgcaatcccagcactttcggaggctggggcagatggatcacttgaggccaggagtttgagaccagcctggacaacatggtgaaaccctgtctctactaaaaatacaaacattagctgggcgtggtggcttatgtctgtaatcccagttacttgggagactgaggcaggagaatcgcttgaacccaggaggcagaggttgcagtgagccgagatcgcgccactgcactccagcctgggcaacacagcgagactccgtctcaaaaaacaaacaaacaaacaaacaaaggcaccaagatagctgccttagttccagacatcacgtacagacacaacaatgtgatagaggagagatttttccattaatgaatatttctgtttaagagccaggataacctttttcaaaaattcctcagctcactctcccagtgcttaaatcacagaaaaaggaaaaggagctgtgtttggtttaaaccaaccatgattcactccctggagccagggttgggcatggggccagcctcttctgaagcttatagaggctcctactagcaaggacgaatgtgaagagggtaagtgctcttgggtaagcagctgtcagcagctgctacaggattcatcaatgcagaagttgtcagtggaagtctgatgtctactgatgattaaccaaagagtactgaagtcagaagagctgagacagaggacaggactctaaagaatgctgacacttaggaaaatgagcaaagtaaaatgaagctctgaaagaaactgacctgggacataagagtgcagtgattaagagcatgcgctccgaagtgagactgagttaggtgctactaacgttagctgtcggatcatgggaaaatcacttcgttttctcatctataaaatggggaggaattatacctatttcattagtgctgttaagaggttggattaaataatagtaatatgtgtacttaacacagaacccttaataaatgaaggctactctattattagttttaatattcatgaggatctgcttcagagatggaaagataatgagatggaacagaagacaagagaagataatttttaaagtgtctctagtgataaatactggaaagaagtcaaataaggtaaggaccatcatgaaatgattataagtggtcctattcacgtttttagcatctactattggcttatattaaactaacagctagccaaatccacaaaattgcttttacacaaaatccagccaaactagttgcctttctttctgtacctttgtagctaactgcaggatttccattttatacactatgctgtatctaactttttagtctaatgttctagcctggcaagatcagtttgaatctttgatctatctttagtacactaaatggcttttccattgataatgtcatctgtatacttgatgtacgtgtcttgtatatatatattttttttcttttttttttttttgagacagagtctcactctgttgcccaggctggagtgcagtggcatgatctcggctcactgcaacctctgcgtcctgggttcatgccattctcctgccccagacttccgagtagctgggactacaggcgcctgccaccacgcccggctaattttttttttttttgtatttttagtagagacggggtttcaccctgttagccaggatggtctcgatctcctgaccttgtgacccacctgcctcagcctcccaaagtgctgggactacaggcgtgagccaccacgccaggcctgtgtcttgtatatttttatgtaatctttttataacaagtaagtggtaagcatacttaaaaggaaagtaacttttctccaagccgcattcagttttctcatctgtaagttgagtataattaacaggccaggcacggtggctcacgcctgtaatcccagcactttgggaggccgaggcaggcggatcacaaggtcaggagatcgaaactatcctggctaacacggtgaaaccccgtctctactaaaaaatacaaaaaattagccgggcgcggtggcgggtgcctgtggtcccagccagtcgtggggctgaggcaggagaatggcgtgaacccgggagcagagcttgcagtgagctgagatcgtgccactgcactccagcctgggcgacagagcgagactccatctcaaaaaaaaaaaaaaaaaaaaaaagccaggcacggtggctcacgtctgcaatcccagcactttgggaggccgaggcgggcggatcacgaggtcaggagatcaacaccatcttggctgacacagtgaaatcccgtctctactaaaaatacaaaaaattagccgggcgtggtggcgggcgcctgtagtcccagctactcgggaggctgaggcaggagaatggcgtgaacctgggaggcggagctcgcagtgaacgagatcgcgccactgcactccagcctgggcgacacagtaagactctgcctcaaaaaaaaaaaaaaaatgagtataattatattgatttcagataaagtatcataaataagtaaatgcctaaacattcaatcctcaattgaagcctgtatctggcacatagaagatgctcatgaattcttccttgtcacctttttctcctcttccctgtgtcactccttcccttcctttctctttaaatttctttaaacattgctttaatatactgtcttgcctaacaaaagaaactgcatatagaagggtgcattgagatccaactggacagaagagattaaactgaatttcatgctttgagttggtggtggctccctaacgtgaggatagagacacaaataacaaaagatacttctgtctcttttaagggaaaatttttaattcccactcatatactgttgtcttctccaggtctagccctatacctaacatctcctctgggtctcacatcccttctagcccctcaaagcacaccatagttatttcacgactaatagaaaaatatgaatttagtatcaacaataggcacagcatcaaattaggaccaaatatatgattctagaggcagaaaacaacctctctgccacttagaacctaatgaactctagtacctgggtttaattcttttagactagagtctccattttcctgaaaatctactacctcatcctaacaccctgggaaaagaaagaaaatttgaggaaccttcgggattcctgccccctctcctgggtaatatggtcatgccattgatgtattctgtcacgctgtcaacaaacatttattaagcccttattatgtttcaggcacatttataaatactagggatgctgggatgagcaatacagacaaggttctcatgggttttacattctagagggggagacaatcacgcagaaaaatataccaacaaggcaatagtagaaataagtaagctgggtgcagtggctcatgcctgtaatctcaatgacttgggaggctgaggtgggaagattgaggccagcctgggcaacatgacaaaattccatcattacaaagagattaaaaaaaaaaaattagctggatatggtgacacgcacctgtagtcccagctactcaggaggctggggagggtggattacttaagcccaggagttctaggttgtagtgagctatgattgtaatcatgccactgcacaccagccttggtgacagagtgagaccctgactctgaaagaaaagaagagaagaggagaaaagaaaagagaaaagcaaaacaaaaacaaatgtgatatggggcatttgaacagatgacatgctgtggggatcgtacggctcctttagagtaggtgagcaggaaaaccgtctgaacaggtgacatttcagctgagacctgaattacaagaaagaacaagtcacagtaaaatgtagagaatattccaggcagaagaaacaccagcacaaaatccctgagatggggataaaactgctgtgttcagagggttgagaggaagaggagagtggtgtgtgataaagttgaagggccagggtcaggtcacactgtcaggacctcacaaacctgagagctgtttagaatttcctggggagctttaagaaacatgtggggccttcctccagagattctgattcacttgatccaaggtggggcccaggcatcaaaagatcccaggggattcctgtgtgcaacctagttaagactcactgatgtctggggttcacatgccatggtaggcagcctgcattttctcctaagtgggatgggaagtcactaaagggtatggaagcagagaagtgatgggatttgagtgatttatttaaaagatctccctagctgctgtaaggagaatggattgtaatgaatcaagaaagaaagcaggccattattgttcaagtctttttggagacatatgctttaattcctcttgggtaaatatttacgaatgaaattgctggaaataccccaatgtccatcaaaaggtgactagataaacaaattgtgatatgttcatacaataaaatactactcagcaataaaaataaagaactactgatacacaaaataacatagatgcatctcaaaaccattatgctgagtaagaccagccagacacaaaacagtatatgctgtactatttcttttatgaggtttaagaagaggtaaaactaacctatggtgatagcaatagaagtggctgcttctaggggcacaaggattgactgaaagagggttactagggaatttatgagggtaataaaaatgttctacatcttgattatatgggtatacacgtttataaaaactctttggatggtacacttaggattggtacatttcactgtatgcaaatttaaaaaaaaaaagaactactacaactacacacataataaaatggcttaaaaaagaaaaaaaacaataccaagtgctggagaggatgtggaaatcccatgttactgatgggaatacgaaatggtatatctgctttaaaaaatagtttggcatggtggctcatgcctgtaatcccagcactttgagaggctgaggagggctgatggcttgagcccaggagttcgagactagcctgggaaatatggcaaaactccatctttatgaaaaatacagaaaattagccaggcattgtggtgcgcatctgagtcccagctacttgggaggctgaggtgggagaatcacctgggccggggaagtcgaggctgcagtttagctgtgattacgccactgcactccagcctgggcaatgggagtgagaccctgtctccttaccaaaaaaaaaaaaaaaaaagtctggcactctttctctttttttttgagatggagtcttgttctgtcacccaggctggagtgcagtggcgagatcttggctcactgcaacctccgcctcccaggttcaagcaattctcctgcctcagcctcgtgagtagctgggactacaggcaaacaccaccacgtccagctaatttttgtatttttagtagagacggggtttcgccatgttggccaggatggtctcaatctcttgacctcgtggtccacccacctctgcctcccaaagtgctgggataacatgcatgagccaccgtgcccaacttctggcactttcttataaaattaaacaggtacttaccatatgacacagcaatcttacttcttggtatttactcaagagaataaaatatgtcacagaaagacccttatgtgacggtttacagctgttttattcacaacagttgatttttgaaaaccagagaaaagcatcagggattacagttgggagactatggcagtagtcctggtgaaagacagtaactaggtctaggctgctaggaatgaagatgaagagaagttaacaaatccaggatgtatctggagagagagtctaaaggcattgccaatggtgtgagaagaagaaaggaatccagaatgactctaaggtatttggtatgagcaactggatggatgatgatgccatttatggggctgtgaaagaatggggaaagtaggcgaggatagacaaaaatccagggttctcttttagccatgttaagatggcttattagacttcacaaacagtggagcagtagatttgggaaaaagatgcctccatcttttattgttagaacataaactgtcaatctggtgactaggaggaggctgtgatgataggtggcagcagaacgccacgctttggagttgtgatagtgtgtcaggaataggctgacaagccacagaattaggtatgatctagaatctctgtagaattgtggacctaacagatagaaggaatagaaaaagaattcaggatgagatgaaacaatcaatagcttaatccaaacaaatggtgtaatcactgaatggaggtttataggagctaatcaggcttggaaattagataatgatatgatttaggttcaaagatgtgggctaatgtgagcatttcttattagttatgtattgctatgaaacaaattactccaaactttagaggcttaaaacaataataaatgtttataattttacagggattctgtggattaggaatttaggagctggccgggagcggtggctcaagcctgtagtcccagcactttgggaggccgaggtgggtggatcacgaggtcaggagtcaagaccagcctggccaacttggtgaaaccccgtctctactaaaaatacaaaaacaaaaattagacaggcgtagcggcaggcgcctgtaatcccagctactcaggaggctgaggcagagaattgcttgaacctggcaggcagaggttgcagtgagccaagattgcaccactgcactccggcctgggtgaaagagcgagacaacgtctcaaaaaaaaaaaaaaaaaaaaaaaaagaaggaatttaggagctgcttgatgtttctggtgtttccttgttgttgttgctttgggggaggaagagggcagaatggagtggctcatttttaattcaggatccctcatgaggttgcagtcaaaatgttggtgtgagctgcagttatctgaaagcttggctggggctagaggatctacttcccagatgggtgattcatactcatggcaagctaatgctggccattggtaggaggactcagttcctcactacatgactgctccacaggagtgcatgagtagctggcttcgtccagagcaaatgatccaagagcatgcaaggtagaagtagaaatgtttttgatgacctagcttcagaagtcactctacatcatttccacactgtcttattgattttccaggtcagccctgttcagagtggaagtatccacccaagggagtgactatgaggtgtgagagaatctctgggggttattttggaggctggctacaactcctttttaagttctaaagttcatgtcatattaagagtaaaaggaactcatctcctggtagtggtgttatgaacagaattccctaggtatttgtttatgtttgtttgttttgagacgaggtcttcctctatggtccaagctaaggtgctgtgctcactgcaggtttaacctcctgggctcaagtgatcctccaaccttagtctcccacatagctgggatctcaggcgagcactaccacatccagctaatttttaatttttgtagagatggggtctccctatgttgtccagggtggtctcaaactcctggactcaagtgatcctcccaccttggcctcccaaagtgctgggattacacgtgtcagttaccgcatttggcccccgtagaaatatgtggctctagacttcgtgcaataccagctttggaaggtatattcaaaagaatttgagaaaaatcttttgttttttaaagcaataagtgttttattttattttattttatttgtttgttttttgagacagatctcactctgtcacccaggttggagtgccctggtgcgatctgagctcactgcaacctccgccttccaggttcaagggattctcctgcctcagcctcctgagtagctgggattacaggcacgcaccaccatgcctggctaatttttgtatttttagtagagatggggtttcaccatgttggccaagctggtctcgaactcctgacctcaggtgatccgcccaccttggcctctcaaagtgctgggatgacaggtgtgagccaccacacccggcttaaagcaatatgtattttaaacctaggtaggttgacaattaaatatagaaatgattaagaaaatcaaacatgctgggcacggtggctcacgcctgtaatcccagcacttcggcaggcagaggcgggcggatcaccaggtcaggggatggagaacatcctggctaacacggtgaaaccccgtctctactaaaaatacaaacaaaacaaaacaaaaaacaaaaaaacattagccgggagtggtggcgggcgcctggagtcccagctactctggaggctgaggcaggagaatggcgtgaacccgggaggcggaatggcgtgaacccgggaggcggagcttgcagtgagccgagatcgcgccactgcactcccgcctgcgcgaaagagcgagactccttctcaaaaaaaaaaaaaaaaaaaaaaaaaaagaaaagaaaaaagaaaaatatattagtcgtgtagtacttatttaaaacatatgatctaagtaattgacttacatttgtgattttaagtggaaatatttcaaaatgtaaatgtaatattagacatttaaaagaacctaaaattaacatatttttaagattaatcgattgcatatatatgaatcacataaatacttgaaaaggaatttttgtcagtcatacaactgaagtacttgacaaaataaattaattactttaagtttacaaatgcagataaaatacttaaagtaggttaagtaaatttatttatttatttatttatttaaaaaaatttttttgagacagaatttcagtgtcattgcacaggctggagtgcagtggcgcgatctcggctcaccacaaactccgcctccagagctcaagtgattcttctgcctcagcctcccgaatagctgggataacaggcatgtaccaccacgccaggctaattttgtatttttttggtagaggcaaggtttctccatgttggtcaggctggtctcgaactatccacttcaggtgatccgcctgcctcagcctcccaaagtgttgggattacaggcttgagccaccgcacccagcctattctgtatgtttttattttatttatttatttttttgagacaaaatttcactcctgttgcccaggctggatggagtgcaatggcgtgatctcggctcaccacaacctccgcctcccgggttcaaacgattctcctgcctcagcctctccagtagctgggattacaggcatgtgccaggatgcccagctaatttctatttttagtagagacgcagtttctccttgttggtcagctgctctcgaactcccaacctcgggtgatctgcccacctcagcctcccaaagtgctaggattacagatgtgagccaccgcacccagctgtttttattttttttttagatagagtcttgctgtgttgcccaggctggagtgcagtggcgtaatctcggctcactgcaacctctgcctccccggttcaagcaattctcctgcctcagtctcccaagtagctgggattacaggcatgtgccaccacgcctggctaatttttgtatttttagtagagacagagttttgccatgttggccaggctggtctcgaactcctggcttcaattgatccacctgcctcggcctcccaaactgctaggattacaggcgtgagccaccacgccccaccaattaagtaaatgtataaatttgaccaaacattaatcaaaaccctcctcaaaagtgattaaatttagctatatctgtacaatttataagttgaatttataagcttacagaaaaatcctcgaaggttttgattttgtaaagtcaaatattaattttcaaagccaggcaacttctgaataatttctttctttttttcttttctgagacagagtctcactctgttgcccaggctggagtgtagtggcatgctctcggctccactgcagcctccatctcttaggctcaagcaatcctcccacttcagcctccagagtaactgggactacaggtgcacgccaccacgctgacctgaatattaataattttttctatttgcaaaagccgcctttgagggaatatattgaattggatggcagataaggaaggggaggttggggagagattttggctgatgggtcaggccctgactgaataagcttgggcctgtctctagctgccttgcgaggctagctgctccagtgctatgagcccctcagtgctgaagccgcaggatgggggaagggaagcagaagccatgcccctgtctgggtttgtctgtccccaggaaccccttgtcctcactgtgctctgtgcatgtaataaatgatgcactggccttaataccaattcacagcatgattcttgtctctccgaaggagctgagcccgtggcgtaatggtctttctttattaacttgctctttgatcgtccaagggactcctaactgacctgcagaactaattgtggctgtattaagcaaagagtacagtaaaaacccaaagaggatcctgagcataagagctgcaaattcaccacattgtagtgacatgactgatcaatgtacaatgaagacatagccaaacactgattaatagtgagtggcagagcctcacatttcatttttggttgtaatatattactgttttaaaatttgctataactgggccgggtgcagtggctcacacttgtaatcccagcattttgggaggctgaggcctgtggatcacttgaggccaggagttcaaaaccagcctggccaacgtggtgtaacccgtttctactaaaaatacaaaaaaaattagccagttgtggtggcacacacccgtaatctcagctactcaggaggctgaggcaggagaagcgcttgaacccaggaggtggaggttgcagtgaaccgacattgtgccattacacttcagcctgggcaacaagagtgaaactccaactcaaaaaaaaaaaataaaaataaaaataaataaataaataaaacttgctgtaactggtcttattcctaaaccccctgcccagcttggatgtggggcaagagtgttcttaaatttcctgttaactgtatttttctgtcttctatcaaagtccaactctcagttggtgctcttggcttgggatggtgtccagatgcaggaaggaagtctcaaaagcctggagtgctggagtgaggtggcctgctctccacactggcacgtgcgaggttcccgactttgctgcccttcacgcagttttagcaaccaaagatgagctgccctgacctctgggttgcaacttttctctgcaggcctcctcttccccacccaggccctgccagaccagcagtccggggcacagcttcaaagcacagctccgacattcagggccccgatacagtactgcggtctccagccacagccgttcctggctggcccagtagataaggcttattctcaaatcccacccagggtagccagcaggctcaggtcacaagtccaggaatcgctagccgatcaaggctagaggtaccgcttgtctgataagtgacccagaccacgggtggaatcttggcttgacaagacccactgcctttctcctcccccaacttcatcttcgcagtctaactatactggattgggtttcccatttggcagtaaaacttgtgcactcagccctgaatcactggtctctcagcatttttctccgtaacgcaggcaaaagccccgcagctcttgtcatcccagtgggtgatcgcccctcctgatccttggcattgtgccaaggctcctttttccctacttctgtctcccactccttcctgcagtactcagggcctaaatggatgaacttctggcaggatgtcttcactctcgtcactaacgtccaaggcccagccacgatggtagaggggtcttcactacattatgcgagaaggtgtaatacaaaaaattagccaggtgtgatggcgggtgcttgtggtctcagctactcaggaggctgaggtaggaggattgattgagccaaggagacagaggtttcaatgagccgtgatcgccactgcactccagcctggatgacagaacaagaccctgtctcaaaaaaataatgaaataaaataaaataagaggtgcagtttccagcctggccagtatggtgaaaccctgtctccactaaagatacaaaaaattagccgggcatggtgacgtgcacctgtaatcccagctactcgagaggctgaggcaggagaatcgtttgaacacaggtggcagaagttgaggtgagctgaggtcgcgccattgcactccagcctgggcgacagggcacgactctgtcccagaaaagaaggtgtggtttgagcccatcatgtgagttgagaatagtagaaactgggacctatactgggactcaaaatacattagcattatatgtgcaattatatttccattgaaactaactttacatattaattggacttttgagggggtggggagggggaattatatttgacaaagagttactgcctgactgtcatgtgcaaagtactggaccctgtctacaatgacctgacaccttggagaggaggggaaacatgtttataagtatcttcaaagaaaagacagggctgggcgcagtggctcacgcctgtaatcccagcactttgggaggccgaggcaggtggatcacctgaggccaggagttcaagaccagcctggccaacatggtgaaaccctgtctctactaaaaatacaaaaattaggtgggcagggtggcatgcgcctgtagtcccagctactcaggaagctgaggtagaagaatcgcttgaatccaggaggcagaggttgcagtgagccgagattgagctactgcagcactccagcctgggcgataaagcaagactccatctcaaaaaaaaaaaaagaaagaaagacagaagatggcaagtgctgtaaaagaaattcaaagtatcatagaagcctggagatgggtgggatgaattctgaatcggtggacccaggaaggcttcaaggagcatccataaacatctgaggcttgcttagggaaagagaatataggaaggaataagatatactgtatctgcttttgagaattcatgttctagtggcaaagactgacatgttttgtgggaaaggtgatgtttaagccagaccttggaaggcatgtacaatttcaacaagcagagataaagaataagagaaagagggatttccagaaaaaggaaagcatgaatatcacagacctatggtttctttcccttcccaccccagcaccacttcatccacagggatgaatcatcttctccataccatgagatcccacctcctgaccacatagtattggctattgaatattggcagaattcttacccagcaaaccaatcagttcttccctgagacttttggaactgaaactgagaaaaagtagtcaatttccctttgggtatgaaagataaacctggaatctactgataactatgactttgagaatgcatggagagagaccgagagagaaacgagagagagagagagagagagaggagtgagagagaggaaaagagagaaaaaattgaggcagatacaaaggagagaaatgtcatagagagagaacactggtggcctgtgtgtctctgattctggacattcatgagtcttagctgcatttctgaccttggattccctggaatacagtaatatctttatgatacatttttatttttccttaagctaaattgaggtttttgctttttcttctttgccactaaaaaattcctattgtattattatttatttatttattttggtaaagggtctcactctgtcacccaggctggagtgcagtgagctagatcatggctcactgcagccttgacctcctgggctcaagcaatcctcccatctcaccctcctaagtagctgggactagaggatggttaatttttgattttgtgtagagacagggttttactatgttgccctggctggtctcaaactcctgggctcaagccatcctcctgcctcagcctcccaaagtgctgggattacaggtgtgagccaccgcacccagcctgtattagttttctacaactactataacaaattacctattgttataggcttgaaacaatagacgtttattctcttacagttctagaaggtggaagtccaaaatcaaggtgtccacagggccgtgctccctctaaaggttctaaggaggaatcctttctcgacaatttctagcttctggcagctgcctgtaatccttggcattccttcgcctatagctgcatcaccccatttctacccccatctttacatggctgtcttcactctgtgtgcctctctgtcttcaaatggcctttcttcttcttcttcttctttgttttttaaatttgagatggagtctctgttgcccaggctggagtgcagtggtgtgatctcagctcactgcaacctctgcctcctgggttcaagctattctcctgcctcagcctcccaagtagctgggattacaggtacgtgccaccacacctagttttgtttttgttttttgtttttgtttttgtttttttttcagtagagacagggtttcaccatgttggccaagctggtctcgaactcctgaccccaggtctcagaggtctcagcctcccaaagtgctgggattacaggtgtgagccactgcacccgaccatggcctttcttctaaggacaccagtcattgattttggggcccacactaatccaactagacctcatcttaactcacgacatctgcaaagacactatttcccaataaggtcccattctgaggttctgggcagacatacattttggaggaatgctgttcaactcaggacactgcttcaatgcacaaaggtgccggggctgcaagttcagatcctgtttagagccaggtactcagaaacctggagtgttgtgccggggagttggggtttgctctctacctagtgaggaggcatcaagtgtcctggacaggatagtatcatggtcctagtttcatggaggactgctggtcatagtgtgtaacctaacttggaacagggagggataaagaagcaggaaaaccggccgggcacggtggctcacacctgtaatcccagcactttgggaggccgaggcgcatggatcacctgaggtcaggagttcgagaccagcctggccaacgtggctaaaccccgtttctactaaaaatacaaaaattagccgggtatggcggtagcgcctatagtcccagctacttgggaggctgagataggagaatcgcttgaacctgggaggcagaggttgcagtgagctgagatcgcaccattgcactccagcctgggcaacaagagtaaaactccatctcaaaaaaaaaaaaaaaaaaaaaaaaaaagcaggaaaaccagttacactattcaatgtcaggtgaaaggtaatacagtgcccagtcaggatagcaggtgtaggaatgcgtagaaagggacaggcgggagacacaccacagatccagagttaaccagactcggccatttttaacataattgtatggtggggtgggaggaagagagtgaagaaacggaagaatttagatgcattgtgcaatatgggggtccataaacatcatcgaatggttaccagatgagagatgatatgacctgaagggctggtatgtaaagagaagggcaaggcttgaggatcacagggttgggcccccatagacattgtaagaggggtcagggagttcaaaaggcgttccctccattttgattatttacatgaaaattattctgtgctttcatatgaggagtctagagcatagtccttacctgcttttattttctttaggaaaaaaatttttgatactctttgcttacatcaggcttcttgtttgaatagtatatttttttatttgaatagatactgccagattacttttctaaaaggctataacaatttacttttccactggtaccacatgagtttcctttcttccttttccctaccattagtaggtatttgcactctttaatttttactatttgaaaatgtgacttggagacaaagtcttgctctgttgtccaggttggagtgcagtggcgcaatctcggctcactgcaacctctacctcccgggttcaagcaatcctcctgcctcagcctcctgagtagctgggattacaggtgcctgccaccacgcctagctaattttttgtatttttagtagagagggggtttcaccaagttggccaggctggtctcaaactcctgacctcaagtgatccactcgcctcagcctcccgaagtgctgggattacaggcgtgagccactgcgcccagccaaaatgagaatttttatatataaatctttgtccatccaatgatgcttacaatgatgtttataattagaaagatgacataggtgaagttttctcagattctttactttgttgtttgtcttcctgtgtgactttctcccacttctttgctaatattttaggtggatagggagagatatgagaaagggaaagggttaaatcaaataaatgttttattatctttgaattatatttatatatgcctttcctgtccttcattacaaagtgatctagaactgctgttaagtcattattagttctctaattttaccttatgcataaaaaaatttttcattttattgagggaagaacaaatgcaaaagaatcctaacattatctgtaacctacaaaagcagcttcttgactcttcttgactctttcttttctttctttctttttttttttttttgagatggagttttgctcttgttgcctaggctggagtgcagtggtgtgatcttggcccactgcaacttccgcctcccgggttctagtgatcctcctgcctcagcctcctgagtagctgggattacaggtatgtgccactatgcccggctaattttgtattttttgtagagatggggtttctccatgttggtcaggctggtcttgaactcccaacctcaggtagtccacctgccttggcctctgaagggttgggattacaggcatgagccaccacgcctagcctgactcttttccttagacatagaaattctgaaaagcatcaacctttttttaccacagtgaaaaaaaaagatgagatttatatctcaataccatgaatggtttatataataatatatgagtggataaataaacatccttttctacagtcttctcctttaaactttggctattagagtcagaatgcttcaattgcagaattctcacttgagcaaagtttttgtataacattattcatattcttggccttggatagcaattaagtctctcaagtctaaaattgctttgtttgctttttaaagaaatctgcccaccttacagacctacaagttaactaaccagcctgtttttcccccaagaggacttcgctctgttggtttcttgccagctcttactttcaaattgaaatagttcagtttcactgtttctagaacatagaattcattacccatggatttttgccaacaatgtccctctcatgttttttaaaactaagatgaatgttacagagtgacctagtggactggatccacgactagaaatcaggcagtgatatattagatgtgtgcgtggatgctccattctgggtagtgaggtggctagggggatgggattctgggagggtgaggagggcattcagggtgaagccttcaggactagagtggagaaatatgtgtgagagattaggtaagatttgacatatgtgaggcaagacttagattcttcccttgccctcaggtccctggcgggtcgctaccacagatagggcacagtcatttattccttttggtcatttgggtagaaaacagatagccaggtgacagagaatatttataaagggctctaagaagaaccattcctctgttgtttccattttctcttgctacgtctgcagctctgcttatccctctgtttctactagtcctgaaagggcatgccttcctgcaacagaacagaaatctcaggaatgtatacatcagcataacctatggccaacatgaatttttcattcatgtggctctgttgaatgaaataacgaaattcctttatcttttaggttactttctaagtatttttaggttactttctaggaatatgttagtgtttaaatatttttctcttctgatttactatatatatatatttaattaaacttttaattgtgagataattgtagattcatatgcagttataagaaataatgcaggccgggggtggtggctcacgcctgtaaccccagcactttgggaggccgaggtgggtggatcactttaggtcaggagttcgagacgagcctggacaatatggtgaaaccctgtctctactaaaaatacaaaaattagtcaggcatggtggtgcacacctgtagtcccagctactcgggaggctgaggtgggagaatcacttcagcccgggaggtagaggttgcagtgagccgagattgcgccattgcactccagcttgggcaactgagtgagattctgtctcaaaaaaaaaaaaaaaaaaaaaaaaagaaagaaagaaaagaaaagaaaagaaagaaggaatgcagctgaagccagaagctacctattgggtaaggagtgctctcagcacttaagaggtttttttaaaaaaaaataataaaataatgcagagaaatctcatgtaccatttaccctgtttcccccaatagtaacatcttccaaaactatagcacaatgtgacaacaaggatattgacattgacagaataaagatttataaaaatttcatcatcacaagaatccctcctgttgctcttttacagatgtgtacacttctctccttcccgagcccctcgttatccctggcaaccgctagtctattctctatttctataatgttgccatttcaagaatgttaattaaatgggaccatagagtgtgaaaccttttggtattggctttttttaactcagcataattcctggagattcatgtatatatcaatatttaattgttttttagttctgagtaatattttgtggtatgtactacagttcgtttattcactcattgaaggataagtgggtcatttccagttttttggctattatcattaaagctgctatgaatatttgttttgtgtgtgtgtgtaagatggagtctcgctctgttgcacaggctagagtgctgtagcatgatcatggttcactgcaatcttcgcctcccgggttcaagtgattcttgtgcctcagccccccgagtagctggaattaccggtgcccaccaccatgcctgggtaattttggtatttttagtagagacggggttttgccatgttggccaggttgttctccaactcctgacctcaggtgatccgcctgccttggcctcccaaattgctgaaattacaggcctgagccactgcgcctggcctgctatgaatatttgagcacaggcttttatatgaacatagattttgtgtctctggaatatatgtcaaagagtacaactgatgggtcatgtgggagttgcatgtttagttttatatgaaagtgccaaactgttttcaagaatggttggaccattttaagtttccatcagcaattatgagttatctagtttctctacatccttgtctgcatttaatgttgtcactatttttattttagccattctgatagtaactgtagtgatttctcatcgaagttgaaatctacattattttcctgatggctaatgatgtcggagaccttttcatgtgcttatttgccatctgcatgtcttctatgaaaatatctgttcacgttttttaaatcaattttctaactgaattattcgatttttttttaatttttttttttattttttaagacagagtcttgctctgttgcataggctggagtgctgtggcgtgatctctgctcagtacaacctccacctccggggttcaagtgattctgctggctcagtctcctgagtagctgggactacaggcacgtgccaccacacccagctaatctgttggatttttagtagagatggggtttcactgtgttagccaatggtctcaatctcctgacctcgtgatctgcccgcctcggcctcccaaagtgctgggattacaggcgtgagccaccgtgcctggcctatttgattttttaatttttgagttttgactgttctttatatattccagatagtagttttttgttggatttgtggtttgtgaatattttctgtagcttgtcttttcatcttcttaataggatcttttggagagcaaagttttaattttgagagatccaatatatcaatatttccttttatgggttgtgctatcgcaatcaagtaaaagaactctttgcctagctctagatcttaacatttttcccttatttttttctaagagttttatagcttacgttttacacttaagtccatggtcacatatttttaagtaggtgtttagatcctgcttgacatgtctcatgtctgaaataagccttagcatgtggaattctttctgtcctcattttttccctcaagcatctactgagtgccaactatggctcaagtcactgataccaaatcatgtgtacaattcctcattagataaatatttcagactttgcaatgagtcaattgagtgatgtacttcagggcgtggcctttggaacccaactagcttggtcaaacctggtgccacctctcagcagctttgtgatctttagcaagttacttaatacctctgaaactcaatgtttcacatcattcacatctcgatgaaaataataatacctacatcacaggattgttgtgagaagtaaatgaaacattatgtgtaaaatgcttagcacactgcctagcacatacatagaaaacattcaataatttttagtcctcctccttcccatccccccatgcaaagatttttctggataccttccccaactcatcatctgcttccccagagtctccaattctttctctctacttctggtcttaattattctacttcttttattaaacaacattctcaacagactttggcatttgataggatttcctatctccaatttgtttgtggtattcttatatgtgtcaaactatctttgtttcctgtatgtgttatgtatctcaccaacgacatatctcctcaagggcatgccatggccctagtcttccatagagtccagctctatgttgggcaagtggcccctaatacactgacagtggagaatctaaattaaaacattttgtagaaatgtttttgtagaaagcaatttttcaacttctgtggaaagcaattcagcaaaatgaatccaaaacattgaatactttgacctagtaatttacctttttcagaatccatcctaagaatggtcagatacttgaataaaaaaatttatatatggctgggtgcggtggctcacgcctgtaatctcagcactttgggaggccgaggcagtcggatcacctgaggtcagtagtttgagaccagcctgaccaatatggtgaaaccctgtctctactaaaaatacaaaaaaaaattagccgggtgtgctggtgggcgcctgtagttccagctactccgcaggctgaggcaggagaatggcgtgaacccgggaagtggggcttgcagtgagccgagattgtgccactgcactccagcctgggcaaaagagcgagactccatctcaaaaaaaaaataaaaaataaaaataaataaataaataaaaatttagaaaaatgtaaatgcatactaattttaaaaatcaggaatcagagtcccagcacggtggctcacgcctgtaatcccagcactttgggaggccaaggtgggcggatcacctgaggttaggagtttgaaaccagcctgaccaacatggagaaaccccgactctactaaaaatatgaaaattagccagatgtggttgtgcatgcctgtagtcccagctacttgggcggctgaggcaggaggaacgcttgaacccgagaggtggaggttgcagagagccgagatcacaccattgcactctagcctgggtgacagagcaaggctctgtctcaaaaaataaaaataaaaaaaataaaaaaataaaaaaaatcaggaatcagggtaaattccatttatagatggaatattataccatcagtacaattctgtagctataaatgctgggtaaggtgtcagagccccgacattgggaagtggcggactagcaggttggtaaaaagaatgtaccgacaacagtataggtttgaaaaaggaaagtttattagaaagaaaacactgcagaagagtgtagctgagtgcctcagcaagaggactgagtgcagtggtggatttttccttaggagcatttatgggtaatttggaccacattagccatgtaggtcatgatagatgattccatttgtagacattttggtgccttaatgtcagcaaggcttgcacaacgagttttggcatggcattctggagatgtatagaaattctagttacttataaatttttttgagggaaagaaatctgaaaccagatgcctgctttagataataaggaagtcgaattacttctaattttccccagagaaggagttttgcctctggatggcctgtttgatagtcaccaggtggtgtttgctcccttctaaattccccaggtaaggagtttttgtctcccgggcctgttcaatggccaccaggtgattttgctctcttcaataaggatatacactaaagcactctttatactagcaaacatgtagaaataatcccaaagcccaaccctatggataaattaaactgtcacaaaatagaattacagtataatcacatttgttttaaaaaacttaggtacatatggatgcacttacacaaacatacaaaaaccaggaaaaatatacaacaaaattttagtggtgatagtctgtgactaaaagatttttggtgattttcattttaagtatggcttctttaaaacataatatttggccgggtgtggtggctgacgcctgtaatcccagcactttggaaggccgaggcaggtggatcgcttgagaccaggagttcgagaccagcctgggcaacatggagaaagcctgtctctactaaaaatacaaaaattagctgggcgggatggtgcatgcatataatcccagctacttgggaggctgaggaatgagaactgcttgaacccgggaagcggaggttgcagtgagtcaagataacgccactgtactccagcctaggcaacagagcaagactgtctcaaaataataataataatatttattacttttgccataagaaaacaagaatgaaagttacaatctgtttttaaaatagtgttttagagactatttaattacatggatataatgatcattcatctcattcaaaacatttattaagtgcctaccaactgttaggcccaatgctagggacacacggagggcacaattaacaaaatctttgaatcacagatagtctaatgagggatacaaaaaatttacaaaacagtgagagaagtgacaatacaggtatagtgctgagtgtcatggaagcatagagaagggtgggagttagggaggtaggataaggttttttgttgaaacttgaatgagcccaaagaaacattgtaaatagggaagaaatacccaagcttaggtagggataagcattttcaaaatttctcaagggattccatgaagaaaagtaaacaggcatgggactggaggagagtttggaaggaaggctagcaaaagtgagtaggaatcagaaaatcagttccgtatagtctatgttgctgagtttggactttctatccttaagagtaaacaggaaaaaaaaaaaaaggaaaaaaaaggaattaaaggctttaaatgggaatagcatgatcatttatgattctgacaaatgacatggactttgctctaaaaagatcacactaactactgagtaggaaatgatttggaggaagataaggctggaggcaggaaagccagttagacagtggtttaggtcactgagaggatgaccctgtctgtagggatggggagatgaaacttgatgtagaagtgacttgatgatagtttgaattgctgacagtagtggaggaggtgtcagggaaaagcaagagtcaagaatgatgttttggctctcgggttggcaattgcggatggtggtaccactaactgagactggagacagatgaagaggcacaaagtgggagggaaaatgagttcagattgggaaacactgagtttgaaatgcatgtgggaagtctaagggaatgttcgggaggcttttagagatacaagtctgaaagtcaggtgtgaaactggctgtgtagacatgtgtttggggggtcatgggagtagatgagatcacacaagggatatatgtagaattagaggatggcttaggacagaactctaaagaaaaccaatgtttaagagactgaaagtgagaaagaaaatggactcaaacctggtctgggacagaaattttttgtgtgatgtaatttacaactccttctgggaagcaattagcattcctcataaagtgcgtgaacagttttctgacagactttaataagactgaaaactccttctgggaagctagggttacccacccagctgattgactagcctaataatctttaaccagatgttctttttttttgtacccattctaaacatggttagggaaccattcttttttttttttcttataaaatatctcaaccaaaattactccttcggttggatttttcaaaaagcctctttctcatgtgctcaaaaccaatttgtcagaaacactaccttaacaaaaaagaaaaagaaatctgcaagggaatgagcagaagccagagaggtaggagagaaatcatcagaatgttggtgttatggaagccaggtgaaaataagaaaacagggcatgaatggacaacagtgtgaaatgctggtgagagttcaaataaaacaaggatgagaaattgccatgagatttagcaataagaacatcaatggtgatcttggcaagagctgggtggggtgacagagagcataagtcagatttcagtatattcaagtgtgagcgtagaccattcttttaaaaagtgtggctgtaaaggggaagggggcttttttagtggggaacataagtatatttaaatgtgtttgagaaggagtgagtaggaaaagaagaagggacctgagagagaagggctaatcttgagtttgagaccagcatcttgagtttcggtgtctcagggacttgggaggggaatctgggcacaagtggagggaaggtcagcttcccacaggaaagaagagcaaggatgggcctgtaaggaagactgtctgcaagtttggtgccagaagctgaagctgaaggcattcttgttcattggcttgttacctccgtgatagtgacgtaggttagaagctccagtgaaagtgctgaggcaggtggcaggagaatgcagactgaactgactaggaaaacagagtgatttcagggcattgtggaggtgggggataatgagtgtattctggaaccaatcagcacagatctgtgactttctccagtagcttagaagtccaaattcagcaatgaagaaggctaatatgtttgaattattctaggactgtcttcaaggaaaccattgcagctttgcagcttcctttgcccattctttaaatgcttctttttagtttctagcctaggctctgttttcttctcactttatggaaacgtcctattgatctcatccactctggtggcctcagttaatctctctatgctgatggctcctaatccaatatttgcaacccagcctttctctccagtaccagatttcttctggttcccatctgccttctggggcatcttcaattgggtgtctcctgggcacctcaaattgaactcatcatattcccactgtctccgagaataaaagtaaacactagaaagacaggggtggatttgtgtctaccattatagatcctgaactcagtgctcaatgagcaactgttggttgagtaaaaaaagaaatccactcagttctctaagccacagactttggagtcatcttttactccaacttctccttcatctctgacatctaacccatcaagtcttatctacatttaaatatgtttcgtggcagaaacacacacactccctccgacatgcacacacacacaaaagtgaattttcaagcagttttaacacagaaacttagctgctttacctccttttttttgcttcattaacattagaactaaaccagtgggagagtacctccctccctgcttcctctcccgcctccccaccaagccagctctgccttagagaaaagtgaacctggttcttcatttgctaatgatttgggctcaggttataatgggccattaaggtgaattgtggaagaaagtggggaaaaatgaagctttcaggtggagggataaagaaactatggggtggtgaccccaggatgctagggagtcctgggatctgatccaggccttttggaagaagaggggttggagcaggacccctatgaggggcccgagtcctccccacgcaccgtcagggaggcctcctctgctcagccatgctgcttgagcctcagctctgggtgctgggagaggacttggatccccctgtaccaggacttccacctactcactgcccatcaggagctttgcttgtttcccctacatgttgctttctgccccaaacactgcctctgccttgtggacaccctcctgacatgccccagggactctgtaaaccccagagacatcccccaggtaccccttagagcagcagctccagaactgggggagctggaggcctctgaagagctgagacagtgttaacgatgccctcatcacagggtggtttgtttgcctatctgcactccacaatcaacaatgatagttcagcctgccttcaactgtcatctagcctcctaactaggcttactctctccagtctacaaacccgccgccctcccaacccatccagttccctaccctgaagccaaagggcttgtaaaaagtcaacatttggcccccatcctcctcctcctcacctggctgatgccttcgggtttcagctttagtgtcacttatttttagactgacgtcttctctgaccaccctcttcccaccaggcagatcaggtgtatgctatatgcctcccccaaaccctggagtttattgaaatcactttttaatattttctactggcccgtggacaaagaataggcctacttgcctgttttaccttgtctccagtgcctagccagccctgtgcctgggacatactaattgcttaacacatttgtctgaggaatgaagaaacattagacaagaaagttcagaaaacagttggttagaggtggtaggtgggagtgagacctacataagtgtttttctgattgagtgtggatcagaactaccaggaagggttgttaaaacacagattgccggatcccactttctgtttcagtaggtctggggtggggctggaaataatgcatttctgacaagttctcaggtgctgctgctgctgattagagaccttatgagttacatccgttctgttgttggtaagaaaaggctggaggggtagatcagaggactttcagataaaaagaagggtaaggtgggatgtatagactttggaaatctgaaaggtagtggtcaaaatgggagatacttgagtttgataataaagatggcagaaatttccagtagttgacaaggtccagggagagtagctatgagaatgaatagccaaagtaacctgtggaggaaggtataataacacagagggggtcaaagacctgaaatgcacaaacattgcataaaagtatttaatacccaaatggaaaaattgaaagatgtaagtgaaaaggaaggatgtaaaatggaatgtgtcgcatcattccaattttaggaaaaatgcatagaaaaaagaccaaaaaatggacaatgtttataatagttatccatatggttgagttttattacttcatttttctaaattttcaaaatttcattatcatgtattcctttcatgattagggaagagctttacttattttgaacctcctcagctttggtcatttccatctggtggaattatctcctgttatcccatttcatacttacttctctttgacatttttactttcactaaaagtatggaaatcaacaaaattaaaacaaccaaaatgaaaagcaagcaaaggaaaacaaaaagaaggggaagaaagaatctcaagaagaaagtaatttagttggtactgacaccaacaagaaacaaatattccatatatttggaggttgtaatgacctgcctggaggagctaaaatgttgttaaggactggtgacttcaccaacaggtcagacaaggaattctagtcctaatctcttacccttcatctcctgtgtcacggagttcagataggtgttgactgtggctctcaacttttcttgttcagaattatatgtaccatacattaggacaaggggtgttaaaaaacaaaaaagaattatatgtccttattcctctttgaactacatccctccctcatacaatattactcaacaaagttaataaaaagttattattattatttttttgagatggagtttcgctctcattgcccaggctgcagtgcaatggtgcaatctcggctcaccgcagcctccgcctcctgggtcaagcgattttcctgcctcagcttcccaagtagccgggattacaggcatgcgccaccacgcctgggtaatttcttttttttttttcttttttttttgagatggagtctcggtctgtcacccaggctggagtagagcggcaagatctcagctcactgcaaactccgcctcccgggttcaagcaattcttctgcctcagcttaccaagtagctgggatgacaggtatgcaccaccacgcccagctaatttttgtatttttagtagagacggggtttcaccatgttggccaggctggtcttgaacgcttgaccttgtgatccgcctgccttggcctcccaaagtgctgggattacaggcgtgagccaccgcgcccagcgaatttttatatttagtagagatgggttttcactatattgatcaggctggtctcaaactcctgacctcaagtgatccacccgcctcagcctcccaaagtgctgggaatacaggtgtgagccaccacgcctggttgaaaaataaaaagttattttttatcatttagttattagaattatttttaaaaacaacaatctaagccctctttagtaacaagacatttttggcacaaaattccaaaaaaattaaagtacatgcaaataaacttttaggatacaacccattttatccaagattgcccttttacagtaaaaaaaaaaaaaattcttctctctgggtgcaggcgcagtggctcacgcctattatcccagcactttgggagagcgaggagggcggatcgcttgagctcaggagtttgagaccagtctgggaaacacggtgaaatcctgtctctacaaaaaatatgaaaaattagtcaggtgtggtggttcatgcctgtgttcccagctactttggaggctgaggtgggggaattgcttgaggcctggaggtggaggctgcactgagccatgttgggaccactgaactccagcctgggtggcagagtgagaccctgatcttgaaaaaaaaaaaaattatctcgttggaatgtataccaactgacagtggtatttgccagtaagaatttcttgctcatttccctaaaggaatgagataatacaggactttagtgtatgcatcccttcatttcaaatatgaacaattctgaatctcttatcaaggccttataattctttacctacagagaagtagatgaaatgactaagtaaacattcagaggtttaatcaagtctggtttcaaaatcaggaatatgaatataaatatccaaatttctatttcataaaaacccattattatggaagaaaataattaaactgtttatgactacagcagaatgtacaggatatatagaattgtaattatcaccacgaacaggaaagacaagaatcttgatatttctattacactgagtaccttgtagctattttgttgaatgtcttttcatctctgataataaggtgtgaattaaaaagaactattccagagactaggaaatgatgatccggaatgatttggcaaggtaagacagtaagtgacagagtggaatcagaaactcgctttcctaattgccagcttagtacttcttattctaggctgtattatctgtgctgccgcaaggcaaaccatatcattgcctttcccattttagaaataggttgtataggagtttcctttgtggtctgatggcaagagacacctattatttaagaaatgccaactgctgatcattgatgacaaaatatttttacatgttccttatggattcaagttgtccgccatttcttcaaataatcatcacgtttctaagtttggtaagaaaatcagaaatgactgaatgttaaagagaaaggggccttaggcattatttttcctatcatctcagtggggaaactaaagcccaaagagtcatattgggagttggtgggagtctcctgacttcttgtccagggctatttatagcacatagcactgtttcagtggatgagtattctgaagccacggcataattgagactctgtacatggcaccttcactcatgttcaatgtgtcagtgtggggagtttgtgtgccattttatccctttatttttgtcatccattttattcaatactttcgttggtgcctgatgtttttgatagaaaaagcaaataaaagagtaagcagcaaatgtgagttaaaaaaattttttttttgagacagagtctcgctctgtcgcccaggctacagtgcagtggcgtgatctcggcacactgcaagctcctcctgccgggttcacgccattctcctgcctcagcctccccagcagctgggactacaggcgcccgccaccacacccggctaattttttgtatttttagtagagacggggtttcaccgtgttagccaggatggtctggatctcctgacctcgtgatccgcccgcctctgcctcccaaagtgctgggattacaggcatgagccaccgcgcccggtcgacaaaaattttcttaacatgaatgcgtgaagtaaggctgtttggaatttagaaaagttgcaatttttgatggagagaaaaccaagaaggagttgagtgatggccgagggagtggacaacctcctactgccagggcctctactcctgaactgttatgaggttgcctgattcctcttaacaacccttcaggttaggggccagctgttaacttaattttattaccagggaagaaactgaggctcagataaagttcttttatcccacaggcacacaaactgctaactgatagagccagatccagccatgtctggctacaaagcctgtgtactttaacttctacagagagtatgtgcgaggtgaaccagtaaaaataacaataacaagtgcaatactaagaatagtaataatgatagttaacacagtgctttacatgtgtgatcgctttgaacaggattaagtgaacacatgaataggactggcagggagtctttctactcttcattagcgaaacaggagaggacatatacagtacttaggatttccactggcttactttgttttctgaaaaataactgaaaggctcaattagttttgttttgtcgcatttatcagattataacgttctggatgtgggtctggatgtgggtagttgggctggtgtgggattacatgaaatcaaacctgatatattcagaaagattcttccggtggacacatatgccttttgggttcgatattcaattttgtaattagtgatcactgttcctatttatttatttatttatttgagacggagtttcgctcttattgcccaggctggaccacaatggcgcattatcggctcatcacaacctccacctcccgggttcaagcgattctcctgcctcagcctccccagtagctggggttacaggcatgtaccaccatgcccggctaattttgtattttttagtagagacagggtttatccatgttggtcaggctggtcttgaactcccgacctcaggtgatccgcccacctaggcctcccaaagtgctgggattacaggcgtgagccaccgcgcccggcctgaatgggagtttttaatccgtacttttttcttattgaagttgaatgtcatatacccctctatttccctagatgaatccatgaaagaagtatgttgccctctatatgaaaaagcaagcttgtcttctgcagaaaatcagtaaccactcctttttacacataaatacccccaaatgaatctccgatgactgatctgatactagtctgcaattctagttttagcattaggctcactcctcatatttgggagaagatgtccaattctgtagtaatgtgtaacataaagtggtgtcaatttataaataatatcttctaatgaattaatgctcatttgcaatgatcacttccatacaaatttaggtaaagatgttattcagaattggattctctctatttaaaaatgtcatcctaatgtgcaactccctaaaactgttactacaaacaactattttgccactcagcctaaaaataaaacctttcacccaaatgacacatcttaatagccatattttaatctacgtaattttaaactattctgaaagaatccatttctagatgtcagacaagagttgaaactgggacagcagtttgaaggggctaatttaaaaacccacttgcttggagacacctcaagaatttctaggctcacaaggtgggtgaagtaaggaaagagactaagagctgaacagtgccgttctttgcgagcccccactggcgcaggctgagccggctgcggctagggctgcgaagagttaacgagggaccgagccccagcgccgcgggctccccgcatgctccctccgccctcccgtccccaccctctcgttttggcaagggattaaagtgctcccccctgtggcagcagtgacccagaaatgagtttgattcacatagtccttcctccataacaagccaaacgccagaccgagagtgcctccgtgcgcgagtgcccggtgtgtgcgcgccggcgagagcaggggcccgcccggctccccgcccgccgcggcccgaactcatgcagctccgagcgagcgagcggcgcccagcccagcgcctcggccgaacccctccgcagcaggtacgcgcgcgggccgcggggggcgcgcggggtgggcgcgccgcgcgtgtgtccgcgcgtgtccgcgtgtgggtccgtgtgcgcgtcccggtcccgcggcggcgacggcggcggcggcggcggcggctgcaggacgagccgagaggctcagccatatttgatggttttgttgctttgctcgggagttctcgggagtaatttaatgccgaaggtcgctgcctagtggaaataatataatacgtcattaatatggcgccaaaagattgggttctcgatctgtagcgaggagggagggaggcagccgctgagcgcagcgttactatcccaccagtaacttgggcattgccggggcgggggccggaggaggaggagaggatgatttttggatcctgagaattgatctatgttggatcagtaagttttattatgattttttttttcaaatttggggggctgaagacttagagctatttcttcttttggatttgcgaagaacatgcggttttcaggtgaatcatcaattaaacgcgtttaggagcagaagcccagtttaagttggctttagtttataggttttttttttttttttttttttttagaaagccaaagtgcattaggctgcatgaaagtggaaagcatagtagcaacttggtagacagatggcaatggcagaacgcaggttcgcgtacatatatgaatccagagtgtgtgagaccgtgtgtgtggtgggactgtatttgtccaaacataggtgtgcgtaggtacatctgtgtgtggtggccgcagccctggctcttgtcaccgcgtcaccacatgtccaaaatattcattgcatcaattcaagggcagtgagaggggggtgggggtgggggtggagggacagtttggcaattagattcttccgaactgggcttccagtgatcagatcttttacttacagcgcgactgcttgtaaagtgtaaaaccccttaatcgatgaaatggggtaggagttggcgttggtagagcaaagtaccgattaatcgtgaacttaaaggggattgcaaattgcaacctttggcaccatctgcaaattgtgggggtggggtctcttggtctccttgcttccttaaatgaacgtgtagtgtgtaccccgggactgcaagttgcagagcccttcagtgcacgtgtcttgtgcctgtgagtctgtgtttgcgagttgggggctgttgttcggtagccagcaggctttccgggttgctcggcattggcttgcaaatgcgggagagggatggaatgtggaatgttgaccggggaaccgaatcctgtcggaacggtcccatttgctggagaaattcgatcccttccacctccttcccgctcccccccgcccgccttcgggcaggaggcggggctgaggacgcggctgctgctcaaagtggcggagcgcggcggcgggaggcaggtgcacggcacccgccagtgggggtgcctcaacttccgcgggcgtttaaatagcagcctctctcccctcccaccggtaataggtgacctggcggccgagggcggcgggggagggaaccgggggagactcgggagcgagcctccgcggcacgtgggcaggtgctgggtggccccggggccaacttttgtagcccgcctctggtgtttgaggagaggcggcccagtgtggaaatgggggcgggcggcggccgaggcgctgcttctccgctgcggccggagcgtcacctaacggtcccagctgcgccgcccgggccggggtggggggttgcgggggcggggacgcccggcccgccgcgcccgccccgcacaaagcccgcggcgcgggggtggccgctgcgcccccgccccgggaacggcccgaagcccgacgcggtccccgcgccggttccggcgggcggccgcaggcgtttgtttgttggttccgcgccgccttcctcgccggatggcttcctgtgacagaggtgatacacagtttccagaactgtctgggggcgggagcgggagcgggagccgagcccgctcggagctcctcgccgccgctgccgctcccatcttaaaaccgtttctcgccggcgcgcccgccccagcccgaaggtgccgccccggagggactcggggagggggacggcgcggccgtttccagcggcgcaagtggcttctggacgcgagggagcgtttgatttgcaactggggccgagcggattggtgcagctggcggcggcggggcgggaggagctgccgcggcggggggtggccactttcaaatggagagggcggcggcggcggggacgccgctgcggagggagcggggcttggttgcgccacgagaaggtgtcatcactgcaccggggctaattccggcggaggtgccgggagttactttcccctcctcccgcgctgttgtttctgtcgcctcgggaggaggaggaggaggaggattgggagagagggaggggtcggcgccgcgcggaaccgcggccctgcgcattccccggcgggcggcgggagccgcgcggagcgttcgccgctgcggggcggcggccgagctcccccacaaccccggggtgccccccttgctgggatccttagccttctcacgtcccctctcactccgccaccctcccactagagctccttattctcgagtcctcaaccccggcttggcgcgtcccgggtctcccctcgccccaggattcctcccgcgccaggctccgctggccccaggtttcccaccccaagcgggtgggggcggccgcagtcccggcgccggtgaatgctgagagcaaacaaaaaagcgggcgatttaaacatgccttcgaaacccgttaggaatgcgtcgtcatccggagaccgtttaaaaggagctttagcttgccttctagtaacgagagggctggcgccctgccttacttcggcaggggcgaggggctgtcgccctctatttgccccggccaagagggaatttaaattttcttttgtaaaatgacagctgcagtgaatgacctgagacagctacgtttttaggaaagtaggagaggatctgaggtttccattaatgggaatgcttagggggttctttcccaaaggttttttattaggtgaactatttttcctttttataatacccgccatgaaggctagctctcttgctacttgtagctcaaggctaatacctttcaaagctaatgaactagttttaagatagagggaaattatttccctgaaagctgatttaggtagtgactccccagtggttacagattttatagtaagttgcattttgatcatatcacaactgatcaagatttaatcacaggtggagaaaggtggagaaaggaagcattcaatatgtccatacttgcattgagtcaacacttttgatgtaataatttgttgtaggtgggcaacatacgtggggggagttaaatgggatgttttgtgagtaacactcttagcaagtacatgcaacccagaatttttattgtccttttatcccaaagatcttagtctcatttacttacggtcacttttttttttttttttttttgttccttgagacagagtctttcgctctgtcacccaggctggagtgcagtggcatgatcttagctcactgcaacctccgcctcctgggttcaagcgattctcctgcctcagccccctgagtagctgggactacaggcgcgtgccaccacggctggctaatttttttttgtatttttagtagagacggggtttcaccatattagccaggctggtctcgaactcctgacctcgtgatccgcccgccccggcctctcaaagtgctgggattacaggcgtgagccaccacgcccagcctgcttacggtcacttgtaaatcagatgactttctgcttggtattttgctgtcttcttcaaagtttggatacttctataagtgtcttttacttggcattgtcattttaatgtgtagaataaatataattttaagctgtttaagtgttaggtttcctgctatttcctttggtccctatttagcagagataatgggagtgtctgaaagtaaggtagaacttgaacttgattccacctttaagagtacagactgcttactagtaaaagttgggttggctgcacatatattttagctttaacaaaggtagatatgtgttcatttaaaagaaaaaaaaaaaacccaccttcttagttctccccgcttcacttgactggttttctgcctgtaaaccagtgctgtgcttatattagttatccaggttgaaagagtagctatacagggacagcaatgaaaagtatgtgtgtctgggtgaaactagagggagaaaacctattggagtttgaggaaatgtgttttgttgcttagcctagggggttggagaagaaagatgacctaaaaaacaaacttggaggactaggtgagagtaaaagcagatttccattgcgtcttacgtatagtaggcacgtgaccgatattaatttttgactttagctgttaaaaagttattacacaagtagtgttacatgtacgtttttgaaaattagaaaatacaaggaaacaaatataaaaacaaattgctaccatccatagatgactactgtattacttttcagataattttctatgcatgtgcatgtgtgttttaataaaaatgagatacatgaatataccatctgtaaggattttttcttttttttttttttttgagatgaagttttgctcatgttgcccaggctggagtgcaatggtgggatctcactgcaacctatgcctcccaggttcaagcgattctcctgcctcagcctcctgagtagctgggattacaggctcccgccaccacgcccagctaattttttgtatttttagtagagacgggttttcaccatgtttgtcaggctggtcttgaactcctgacctcaggtgatccacctgcctcggcctcccaaagtgctgggattacaggcgtgagccaccgcacccagctctgaggaccttttttttttctgtcagctagcttggttagttttaatataatctattactgtaacatgtccagatttccccatttagccccagactgtaatagagaagctttgtctaaaccactgcctaataaaggaccatttattgcatttggttgtttcccttaagtcgattttaatcttaagtaactttttttttttttttttgagacggaggcttgctctgtcacccaggctggagtgcaggggtgcgatctcggctccctgtaagctccgcctccctgtaagctccgcctccctgtaagctccgcctccctgtaagctccgcctcgcgggttcacgccattctcctgcctcagcctccagagtagctgggactacaggcacccgccaccatgcccagctaatttttttgtatttttattaagacggggtttcaccgtgttagccaggatggtctcgatctcctgacctcgtgatccgcccgcctcagcctcccaaagttctggggttacaggcgtgagccaccgtgcccggcaatcttaagtaactttttgacagaatatctgacactgaggaggcaagcctttggaaataaagttgcctggattttaaaaaagcaggaaatccaaatggtatttattgtaatttggaaatcttaaatttggagatcatctgcttgcttgatgttactttccacagacttgttggaaaaagatttatcagatgtttgtgtttcagtactgaggtggttggaacagtaaacatcaagatatcaaatacagattacatcctgtctctttagggtttggtcagagaagaggaggcataggaatctgtcacagttctgcttgctgctttactttcttgtttgtgaagctcttccctgtcatttagtattatggggcacctgttacagcattacagttaatggtctgtcagaatttgcattataaaactggttttcctgtgaggtttataaaacagttatagagggaaatatgacatattagcgaacacaccttgctttttatttgggttggcattaagaggtttagcttgattgttaaaacggtgaaagttacgtcacgtttaaacttatttcctcccttgtacaagcctttagagaattggcaccatattcaacaatactttttttttttttttaaacatgaagggtgggtttgcttggagtttctggtttcttagaaggtatcagcaatcttaaattaggaaagtattttaattcctgagacaggtaagttgtttccttaaaagtcttaaatctgttttctccgttttcaagtccttgcagcactttatatgaccatgtatttacaatctggacaattctttttatgtttgtggaatgtaatatctcagaagttgagatttagttgagtctattgagtctattgtcctttgcctagtgtatttctcatatgaaaactttggtttgtgatcatgagggtgtatgcattatttttattttttctttttttgcagttcatagccctgatgaagcaagttactctgctctcctaataaatgcaagaaaatgaccttggagggcctttttaattacacatagaagtgacaatttgtaagtttaaggttgggtgtcatggaatagaatggaagaaattgatgctaaaaactttggctatgatggggcctttcctagcccaggacttgaatgattattaaggatcctttcctcacctcaaagcacaaacataaagattaccagacttggactggaaagcctttatcactaggaaaggggccatgtatttttacgtttaatcccttagacccatagtgtacgatgtgcacacagtaaatgttcagtgaccaaattttggttactctaaaacgaattcagtatttactttttgcctttagttcttcaggtagaggtaggacataatgtgatagagagcagttgaagaaagttaatttttaaaaccttagatttttttgggcttacttgttgagggaagtaaactacattttctctctctttttttttttttgagacaagttcttgctctgtcacccagggtggagtgcagtggtgggatctcggctcactgcagtgggttcaagtgagtcagcctccggagtagctgggatcacaggcgcatgccgccgtgtctgtctaatttttgtatttttagtagagacggggttttaccatgttggccaggctggtctcaaactcctgacctcaagtgacccacctacctcggcctcccaaagtgctagattacaggtgtgaaccaccatgactggccagttttctattactttgaaagcgctcacaattgacatctgtctctttgtattttttgttagagagatgaggtttcactatgttgctcaggttgcccaggctagtcttgaactccagagctgagtcctcccgccctggcttcctaactgcgattacaagtgtgcacctgtgtggctggtggaagtaatattttaaactattgatcatttagtgtctcctgtgcaggagattttattattttgagaattcatggcatcttccatgagagtttataaggacttactttaagtgaagatttcagtggtgtgggtccacactgaggcataaaataatctttttgtttgtttgtttcccacttaaaccagggtaaggaacaagaaatagcaatgttattagcaagttgcttgaggttgaacttcatggcttgctttaatttagcacaaagtacactaaatgcaatttaaattttttattgattactctttgtcataatctttacgagcatcagttacttccatgtggaaatgccatgatgcacttaacatatagaggctgagtgttggtggttgtaactttttaagttggggacacttgacactgaaacccatggaagctctcccccagaaaacatgggtgtttccttaagcacatccttggattctagtttaagtgtttaaattctggtgacttctttttatgatttctctgtgatccttttactgccactgttaccatgtattgtagttaaaatgcctgttgagaacagtgatttttctgcttattggtcattaacttgaaaatcaaataagaagcctgttagaagtttttaaaacttgtgtacactggctccaagtaggagcctcaggggttttcttttgagaaaaacccactggttttactgtggcctttatttaagttgcttagaggtctcctcaatgccttccttttgattattctagttagggacttcttttttttttttgagatagagtcttgctctgttatgcaggatggagtgcagtggcatgatctgggctcactgcaacgtctgtctcctgggttcaagcaattctcctgcctcagcctcccgagtagctgggattacaggcgtgtgccaccatgccctgctaatttttgtatttttagtagagacgaggtttcaccatgttggccaggctggtctcgaactcttgacctcaggtgatgcacccgcctcagcctccccaagtggtgggattagaaacgtgagccaccatggccggccatagttagggacttcctaaggagtgattgtgtctgatccttaattttgtaagctttcggttgcttgtccagcacctggtaattgattcacattgaactaaacacgcataatggtggtttataaacatcatactactgatcggttgatttataggacagatcagttgcctttctctgtaaagagccaggtagtcaatattttaggttttgtgggtcatatggtctgtcgcaactgctcaagtctgcagttgtgccagagcaaccatgggcaaaatgaatgtgaaagtgatatttatggatatagaaatgtaaaatttttatgaattttgtatgtcatgaaatgttctttggccctctaccctcaaccatttcaatatgtgaaaatcactcttagctcaaaaaccatacagaaacaggctgttgacccctgattggttgattgattgatttgagacagggtctcaccctgttgtccaggctggagtgcagtggtgtaaattccagggctcacttgatcctcccatctcagcctccccagtagctgggactgcaggcatcccacaccaggcctggctagttttttgtattttttgtagagatggggtttgctatgtttctttgttctcgaactcctgagctcaaaggttctgcccactttggccatcactccctggcctccccagatttatagtaagacacagcagctacttgattgtttctgctggtggctgagctcccttctaggaacctgaaaatgcaagttgaaattagaagtttgtttggaggtagttggctacgctgagggctgtgggttgtttttgtttcgctctttttgcccaggctggagtgcaatggtggttttttttttggggggcaggctctctctgctgctcaggcagtagtgcagtggcacgatcacggctcagcaaccttctggtctcaggcagttctcctgccttagcttctggagtagctgggattctgatcctagatcccttttgaggataaaatgtgtaagaacaaataccttggtcatctctcacaccctccgggggggtcaagctaagaagacctgtgtaagaggatatgtattataagattgtgttccactacagagggagataatgtcaagtagggtgtatgtgtcacagcaatcagaagttaatgcctaccactccgggagaactcatactcctgtggtagtgtttaaggaactgctgacacattcttccagctttaccttttgtgtgcttcactatgcaaaatgaatggcatttgtgaccatcttgccatgaatctgtgtttcagttttcaagttaacagactgttgttcattgattacattttcagtttttgctctctgataacgtatcatggccttagtcattcacatgacctctttttaaatcccagtgtacatccaggaggaagaagcccatagtccaggaatctgggaggaggtggctggcacaggaggagagtgcccctccacccacctggggaactggtctttggttcttccactgcctttgcactagatctacttatgtgtgtttgtgcaagttgataaacatgcagaaatccatgtactcctctttaaaagtaggaaaggtggattaaattattttaaattgtttttgaaatcctctctagctctgcagttaattatgattttatgggtttcttttgggaagatttctttttttttttgagatggagtcttgctttgtcacccaggttggagtgcagtggcatgatcttggctcactgcaacctccatctcctgggttcatgcaattctcctgcttcagcctcccaagtagctgggattacaggcatgtgccaccatgcctggctaatttttgtatttttggtagaggcagggtttcaccatattggtcaggctggtcttgaactcctgacctcaagtgatccacccacctcaccctcccaaagtgctgggattacaggcgtgagccaccacgcctggctttcttttgggaagatttcttctagacacaatctgtgttgtgagacttgtaggcagagtctacgttgtgagactgagacttcagcctcagagagtgctttctagaccttgcttctaggtttgagaccaacttaggtttccatgatcataataacgaggcttgtacaattgtgatgaaacgtttgttttcatatgtaacttggatgattgtgtaaatgttgtttttgtcaagtgtgtcatctaggttttcaaatatacaacattgggagtctctctcttttttttttttaaaacagtactttaaaaatttttggtgacttaacattgttagtggtaacggatagtttctgacaaccgggtataatcaaggaacaaagttcctgaaaaacagctgcatttcaatctgtgcacagtgtaattgtcattagctggtggagtctggtttctgcagaagctgatttgtatatcctgtataagaacatctggtttgagcatttaaaaatcttttaaaattaccctgtagacatttagcatttattggcttactccaccaaggatggaataatgggttgtagaatcctttctcatgcttattcttaccttcgttcattcagaagcacttggttttcctaaagtgtctaatgagcttttagagtttgatatgaagtgtgtaggtttgtattatagaaattagtacctggttcagagacccccaaggcagaatggaacacaaactcctgatttcagtgaaatgctttaaaaaataaacatttcatttttgtatattctgaagagattaatctgaccctagctttccctgataaattgtcagaaaactgagacgcggaataagacatatagggcaaatgggctttatctctcttggtgatagcactgtgttaaggaggattctgaagatatgtgcctgggggtgtggaaaagaatgacctaatttgtcaaccatgccttgccataggtggaaggaatggcataattgccagctacctcttgaacatagcctttttaaattttttccaaagtagtactactgtgataatggataaggagttgaaatggcttcttcttttttttttttttttttgagagggaatctcactctttttgcccaggctggagtacagtggcacgatctcggcttactgcaacctccgcctcctgggttcaagcgattctcctgcctcagcctcccgagtagagtagctgctaggtttgagaccaccaacctgattacaggtgcctgccaccatgcctggctaatttttgtatttttagtagagactgggtttcgccatgttggccaggctggtctcgagctcctgacctcaggtaatctggcccgcctcggcctcccaaagtgctgggattacaggcatgagccaccatgcccagcctgtgtatagtttaaaccctaattttcttgtctgggttagtttttttctattattattgcatatattttaagtgacctccttctaatgttggctgtttttacctgtttcaaaaacttaagcttttgaagtatgtgatgacctaatcaagcaaataggggataatagcattttatggcattattaccttttctcttttttttcttctgcacctttgcatcagatattcttttaaagcaagacaattctttgatactgcatctcaggaaagaggtggcatatacatagtttattgatggttgctcgttagttataggctggtgctttgcactggggcaagaagttgtgcttccaggtcttttatatagtgaagagcagggaagaaataaatctttactactggccgggtgtggtggtgtgcgcctctagtcccagttacttgggaagctgaggcaggagaatcgcttgaatccgggaggcggagtttgcacttagcagagatcacgctcctgcactccagtctgggtgacagagcaagactctgtctctcaaaaaaaagtatctttactattataagtgtagtacacaatcatcgtaaaaagttaaaatcatggccaggtgcagtggctcatgcctgtaatcccagcactttgggaggccgaggcgggtggatcacctgaggtcagagttcgagaccagcctgaccaacatggagaaaccccgtctctagtgaaaaaaaaaaaatacaaaattagccgggcgtggtggcacatgcctgtaatcccagctactagggaggctgaagcaggagaatcgcttgaacctgggaggcggaggttgcggtgagccgagatcacaccattgcactccagcctgggcaacaagagtgaaactccgtctcaagaaaaaaaaaaaagttaaaatcatattaaaggtcataaagaggaggaaaagttcccaactcagtctgtcttggaaccctttggtcacatttctcagagatgaccactatgaacatttatattctttcagaaatgttctatgaatatacaagcaattgctgtaggtattttctctcctcctattatatataaatgctcttatattttgggttttttccctgcagttagcctgtttttctcccctaatatgtcttgggcatctttccacatctgagcatttagatctaacagaaaagaattctgagtagatggaaataaggataaaagctcaagattggagaccatggtgactgactgccttttttgtttggttgtgaattcatttactcccatgtcaagggaagttaaaaaaatacattccaagtacaaatgattggaatgttttgtcatagctgctcttattcagttgctgactcttaattgagtcagcaattacagagtcctggaaggggtttaatagattgccttagagctcataagcagtgattggattatttatacattggcaaatgagagctgcttgtgattcattcagaaccactcaaatttaaaattccttaaagtcttgagaaatgctttcttggtttttaaatctgagttcaaaaataacttataaagaatttaaagtgaactaatgtattatagtacatgggctttatgagtaatgctcctaagagtaaatattatagttatttattatgtggtcagttatcataattttttttcttttggaggaggtggctattgctaatgtaaacttgtcagctgaatatttgtaagttttacctccttccagaggttctgtattagcttgggccagcattttccttaaataagttttgatgtatgacgttataaagagcacatttttttgcttgagatatttagacaagattaaaacattaacgcttaagagttaagctatttgtcagttaaatgtatgactttatttttgactagatataaccctttagttaaattgagaatctgtgtttgagttatagtcatagtagcatttttagattctgtgagcatatgaattagataatgttgccagttggaaaacttcatatttaagcgattaatgtttactttaaaaactgaggtaagaaaccagctgggtttccttcacattcatttaggggcaggtggacagattttattgtgaagttataggtcattatatttgggtatttagaactgtatattccatagaagacaaaagtgaccaattattaagaatataatgtatctttttgggggagtattctatgttcagtaatttaggaatcaaattatcaggtacctagtgtttaaaaaataatttgaactatgtgaacttaaacagaaaggagtggcagggcgcggtggctcacgcctgtaatcccagcactttgggaggccgaggcgggcggatcatgaggtcaggagatcgagaccatcctggctaacacggtgaaaccccgtctctactaaaattacaaaaaaatatatatatatattagctgggcgtgttggcaggcgcctgtagtcccaggctgaggcaggagaatagcgtgaacccgggaggcggagcttgcagtgagctgagtgagccattgcactccagcctaggtgacagagcgagactccaactcaaaaaaaataaaataaaagagaaaggagtagctcataaaatacttagttttatataagaccacctggtttctgaaaatacattctttagtacctttaggtattagattttagctatttgacagaatggaagggcatcaataaatttaaaagtgaatacaggagaagttattccagttaaaggtcaattagatattaaagtaaaagcatctcaaattcaataaagtggagtgaacataaggtaacagtacgggaactaaggcattcatccagtaggttattttaatacatagtattgcattgggtgatatataaaagtatgtagcggtctttaattgagtaccttctagaacttcttgagtgaaataaataaaaatggaaacagtagataaaactgatactttgagagagaaaccagcctttctgcatatgagccataagacaaaatcactaggttgtaatccttattatagctatagagtttatggcctgataaatgggccctgttccaccacagagagtaagtaattctagtaactggacagtttgttttcctcaaatcagtccttgtttcccaggaatagcattgaataaacatcctcaaattcttagttacctttccctttttttgtttcttttttcgagacagagtcttgctatattgcccgggctggggtgcagtggtatgatcttgactcactgcaacctctgcctcccgggttcaagcgattctcctgccttagcctctcaagtagctggaacaacaggaatacaccaccaaacctggttaactttttgtgtttttagtagagacggggtttcgccatgttgctaggctggtcttaaactcctggcctcaagtgatatgcctgcctcggcctccccaagtgcctggattacaggcgtgagccactgtgcccagccctcttattcttttgtaaaagtccttctctccttgtccatgacgttctcattctttcttagaatcatcacatcagtcatgaccacgcccaggtcactgaacttgttcgctcaaattcctgagccaccctagggatgggttccttcacatagtggctcctctgaatctattgcatgcagatttttcccagtttcagtcagaggaatgtaaatttcaaggttttcaggtgccttgctatctcatgtgcatgtaagcagtaatctggtgacttttatagcacttaccacactgaagccacttgtctagttatttgatgtttcctccaggtagactgtgtgctcctgcagtgcagacattccatatcttgttcaccgtatctctgacgtctaccttgataaaattttcctcaaattattatgttagctaatgtactgcattttaacccacatgacagaagggatccaaggagagagtaatctgcatataatctaaataggggtttgggccagtgggtaaagcctgtgtttgcatttcctgaggagatggttctccggcagctgccacagatgctcagttgtcttggtgcatctcttcgtgcagtgagtggagtagagacaccagaggattgttaagtaactggtccagccagggtctttggccagtggcctttccaggcagtgttctgtttttaatttaacttcctaggtagtcttcctctttttgggcaaactcccaaatgcccactaactagctcttttgtctctgtagctattatgtttctcgtggcaagtggacactccaggctccgataagctggataactttgcatcagttttgaggaaatgtaaacagaatgtcagggtgagccgtgtcgactggatccagagttctgagggcatctattgtagccacgctgagaggccttgtttctgaccagtctgagttggattcaatctctgtcccgtactgcaaggtcccattgcagtgttccctatacctaccatcatggtcccccttctctgttatgtctttttttttgaaacagagtttactcttgtcacccaggctggagtgcagtggcacacgctcagctcactgcaacctccacctcctgggttcaagtgattttcctgcctcagcctcctgagtagctgggactacaggcatgcatcaccacgcctggctaatttttgtgttttttttttttttttcagtagagacggggttttcccatgttggccaggcttgtctcgaactccaggcttcacatagtggctcctctctatctattgcatgcagataatatgcctgcctcggcctcccaaagtgctgagattacaggcatgagccactgcacctggccctatgttatgtttatttcatatttgacttgagagaatctgttctccagaaattactgtaatctttagagacacacacatgaaacatttaagtcatgatgcaaggcagtagttgattgaatactgacaaagactcctttgaccaaaactttagtcacgctcctccggtcctccgcgtgaatgggcactaccttgggcttctctttgtattattgttgaatccagttgaagcaaaaatcctgttaaaatcagtttagggaaaattcttcacctgggtatctgaccactctgtcctatcttatcctggcctgtcttcaagaataatcctatcaaattagccataaaccccttatccttgatatttctgtttagtagtcagtctcctatccaccggccccaccctcctccttggttataaatctccacctcttttggaatctgagttgggttcaatctccatccccctctgcaagatcccattgcagtgttccctgtacctaccaccatggtcccccttgagtaaaatctgctttaccatttctaacaagtgtcatgaggaatttttttcagtgatactattaaggtaacagtgcattgaaaagcaaggtgaaaaagttctaaaagaggaagaaagttgaactgagcagtacagaatataagtgtttggagttggagtggtcagtggctttgagctgagccccagaaaagtggtgggattaggatagggagcaaggagcaacaggagcagcattagcagagaatgagaactgaaagtaagcagagtgttcagggaagaagcctggcccaaccaatgcaagctctgggttttggggcttgctagaacagatgcctgagtaaagctgtgagaagtcagaaaacttcatttttggctggacactttggacttagacctatttgtaatgtggaatggagggagagatctgcatatagtattttgatgaggttgcctcatggggtgtagttaatttgttgttttaataattggaagtgggaagagatcatagtttggagaataggtgtttaaagctttctaggtacaagtagttgaagggcaaacccacagggcatatggggacttcagagagtcataacattatgaatcagtaaaccttggcaattggctataaggtgagaatggatgtgtatgaagatgctacccagagtaatatgctgtgttacacatatgttggtaagtacggtgctctgccccaaacatgcccctttttctggctacctcctctttgttcttcaggactcagctcagtcttaccagcctcctctgactcttatccaccttttgtattcctgtagaactccgcatttaccactgtcaggcacaaacagtagtgaatttccgttgttttcctgtctgcccaactaggccagaagctctgtgaggtcagggttagtaattttcatccagcacctcctaatatatgagatattcaaatgtttgtcggctgcattatgtgccattatatcttcttgctactttggggtgttgtgagtagccattttaattgattattacttatcctactactgtctagattagtaattagccattgccctgagagtcaggaaaggtgatgatgcagatgctggcttttagtggggcagatgtttgcagcatacaaccactgtattgtgtagctgaaagatagtaacatgtattttgattttctgatacagtaagtcatcctgggtgagataaatcagcttgatgtcaaggtttaagtactttagagccacagaggaggaaattctgctgagcactaacccccatactgtgccaagttccctggagaagcaaatacagcactctcaaaccctcattactcaagatcttcagcggatgaaaatggatttcattagaaagaaaatactatttttactcttcttttacttgaataattttgcttaagagagtatttatgtgtgtttaggtgcatcattgtattttggccaatgcttgcgttctttatttagtgactgttgaagtgcttcctcagggagttgtgtttgaaagctggaaagtaagcattttgattcaaaaagattcttaaaagctactctgttaggtgaatctaatttttaaatttttttatagagataggggtctccctgtgttgcccactccggtctcaactcctaggttcaagcagtcctcctgccctggcgtcccaaagttctaggattacacatgtgagccaccgcgaccagcctagtactaattttttttagcactcttttgtaatgttggctttggggagctgaagctgttaggagtgagtggtcttctgcctttcccttttcccttttacctcttgctggatcctgaggggacccagaggtgcattctctagaaggttggagagcttacctgtctgcagttggtgtttttggcacacacagggcagagaaaacagttgaatagggagtggaccactggtgtttcttggttatggaacctgagggctggagtgggcttaccccaggccaagttgcagattgcctggttatgggtgagtggggcttttggaaaagggatggagtgggttttaggacttgactatgcctacagcatgaaaccccagcttgtaaagcgtgtccataatatagctcatgacccatactgatcaggacttatgttcagcctttctcttggtacatcattttaatggcttttgaagaatcaattgataaacaaaaactttaactgggtgagtttctcaggaagaaaatataaaatattgcaattatagattagggacctaaatatttggatgaattgtgtagatccattttttaagtgtagtataggaaaaacttttcatctacttttttaggttcagttcatgcgagtctgaattaaatgacaaaagacattacaggagaaaaggcaaacttcactgatgttgatatttttatgtgccagatgtgggtaaagggaaggagacttcaccgaagagaaaaaacccaagaagagttagacctgaaggcttatatacaattttaacagagggtgataaattgtgaagtgactagtcaaaggaaaagggagtttaggcttttttgactgctcttttgtaggcctttttagagtggagctttggttttttaaaattgctttcttgttctatcacagtggttctccacatttttctttttttttcaagacagaatctcactgtgtcacataggctggagtgcagtggtgtgatctccactcattccaacctccgcctcccgggtttaagtgattctcctgcttgagcctcctgagtagctgggattacagatgcgcgccaccacgcacggctaatttttgtatttttagtagaggcagggtttcaccgtgttggtcaggctggtctcgaactgctgacctcgtgatcctcccacctcggcctcccaaagtgcagggattacaggtatgagccaccacacccagcccggttttccacatttttttctccacaccattcctatgtgccccacttctattgttgtgtgtatgtgtgtgtgtgtatgttgagacagggtctctgtcgcccaggctggagtgcagtggtgtgatctcggctcactgcaacctccgcctcctgagttcaagcgattctcctgcctcagcctcctaagtagctgggattacagacacctgccaccacgcccggctaatttttatatttttagtagagacggagtttcaccatgttggccaggctggtctccaactcctgacctcaagtgatcctcccgtctttgcttcccaaagtgctgggattacaggggtgagccaccatgcccagccacatttgcattgttaacaccacatcatacatattgtgattcccaatgaggaggaggttgggatgtacttttctgagagggtggatgggtaggtaggtgatggactaccatactttttctcacttgaaaaagctccctttcatttttaggattcattgaactgacagaccagtgccctaaagatgtcaggttgatcagtaattttaatttggaaaagctttttgtatttgtttagagagctgccctgtgtgaatataaccgcgagaccatctgtataagttcattactggccattccgtctcagttcactgccttcttacctaaatgcagcctttctcatacttgagggtagtgctagaattctgttatcatcagctacctgggaggagttggccaggtgcgctgggtctttgtacaaactgacttcttattttggctggatttgggtctatttgtcctgaagggagctgaggtgaagtggagtggaaatagtgttggatttggaattagaagctccattcccacaacgtgaccttggggaagttgctgcttaacctttcttggctttagtttcctaatgtgaaagggaggggtctggatcaaaattgtataatgtctgtggttccttcctgttccctctgtggggttagagatggctggaggagacatttgcattccattacccgatttgttttgtttctttcgcctttagggttattttagtaaaatttgcctgagaagcataatcatgcccagtgcagtgtaaatattcacacatccaggcacaaccccaccccaccccccacatgtacgcataaaatatgaatctgtctgtagtgaggaagcacagtacagtgttcattgctgtggatttttttctgcagtgcttgctgccagtcagctaaagattcctggagtagttatagtaataatgtcacaggaatatagaaagaaacctggcatctttgggagacctactgatatgtgacttctccacccctccccctccttttttaacctggtttgttaatgattgcacctaattatgtatctttggtctttttactgtttacaattcaaatgctacttaaagccatttgtttgcttttgtttgctgtaaatcctgggctgccatctgaagcacaacttgatgattgtgtattatcatcttgggttaagtgctgtctcattgctttgcaggctgcctgctgtttcccggggagatcatgaaacgaggtcgccttcccagcagcagtgaggattctgacgacaatggcagtaagtcctgctttgttgttcttggagcctaccagggtttgggtcggggtaaaaacatgattttttaatgtaatgctttaaattgctgaggccctttgcatgtcaggcaggtcagagaaagccaaagcctggagaaacgtacctgagtgtgatactgcaggtctgtaaccagatcttactgggtaaggttgactgcaggcaagcattcctgaggcttcctatttgttatcctgggaggaataatccagttccaagagtcactggtgtgtctggttttcctaaacatcatttatggtacttcgcagttgcgctttatgaaaggggaacttaatcaaagccaggtaatcattaactggttcaactcaatacaaggggaggttgaagactgcctagtgtgatgtgaaaattattaagtacaggttcttaataggtcgaaagtccctgctcttcacttggttttaatgtgactatattgaatactactgctgtctgtatctcagctctctggcaacttcatattttcacagtgcagctgagaaccagaagttagttggcttccaggcagtcaaaataaatatcacacagtgtctgtgtattgagaagctaacagactactcagagaagagctcccctcagataacagagggaaattttgtacctagcacagtgcctgagctctagcccgttagcttatgttttacattacaaattaaacccaggacaccttgaaagaatgtgtgatgggaaaggagctgggcctgctttcaaggaactctgctttagacatatgtaagaagagctctgatgtgaaagtcatcagggcagtaatagagatgtctttttgatgcactgtggaaacagatacagatacagattcagaggaggggagggcagggaaacctgcagaggagatgaaagttgtatagatccttaaggatgaaatactttttaggcaaatagggttattttcagttttctgtgctctaagttttcagcaagttaaaagctgcacattagaaagcaaggctttgctgctgtaggtgccaccctgttcagaagaggggaccaggaatatgaaaaacagaactcaatgtggtatttcggttggtgtgcttggcacaggcacaggcacggggcttttggggaggagaattggccgttatgggagagtgtcaggtgtgaagggcttgcaatgaggacctctaaggaattgagagttttagggttgactgctgatgttggcagcaggagagaagtgaactagttgagagagggtgtaggggctccagagcgaaagacctttcctcttatttcagagaaaggtattaaaggtctgtttccaagtgcaggcaggtaaagccacctgtccgagcctttgggatgccaccttctgaacttctgaggcgcttgttgtttcataaccctgcctacctgttttctaacgtttatagttttaggcattttactccttgaggcaaaaacatcattgggaatttcttctctgcccctgtgtggcgcctatcaaagtgtctttgtgagttataagtactctataaatgctccttgcttgagtacataattttgtcctacattaattaaaaaaaatagtcttgcctggcctggtggctcacgcctgtattccccagcactttgggaggccgaggtgggtggatcacaaggtcaagagattgagaccatcctggccaacatggtgaaaccccatctctactaaaaattagctgggcatgatggtgtgtgcctgtagtccagctactcgggaggctgaggcaggagaatcacttgaacccaggagacggaggttgcagtgagccgagatcgtggcccctgtactccagcctggcgacagagcgagactccgtctcgaaaaaaaattcttgcttttagggtgagaattagtcagaagactgcttggtgaattacctccatataaagataatgcccaataaaagcttaagagccctatttaaatatttttcttggcattgagcatcaggtgtatgctcactctgtctgctctcgtcactgcctctcttctttgggagagctgtgttagaaaagtttctcctggatgttctctcagatttagagccttctcttttctggactagcattgtcccataggatgagaatgtcctaatctagtgcaactgaggaactgaattttaaacttttacttaattttaatgaattaaaaaatttgaagacacatgtggctagtgtccactgtgttggacagtgtagttctggaccttggcttagtttagtccctttcagttgtccagagggtcttagtagcgcagaaggcctcatattagtcagctcaggatgctacaaaaaagtaccacagcccccggtagtttaaagctacagaaatttgttttctcacagttctggagactggaagtccaaggtactggcaggtgtggtttcttctgaggcctctcgtggtttgcagatggacttcttctcacgtgttcttacttggcctttcctttgcacaggcatcgctggtgtgcctcagtgtgactaaattggattatggcccaccctaatagcctcattttaactcagtcacccctttcaaggccctgtctccaaatatagtcacattctgagattggaggttagggcttcaaagtacgcatttggggatgggggtacaattcagcccataaaagccctagaagaccaaatatttctttttttttttttttttttttgagatggagtctttgctctgtcgcccaggctggagtacagtggcatgatctcggctcactgcaagctctgcctcctgggttcacaccattctgctgcctcagcctccgagtagctaggactacaggtgtccgccactgcacccggctacttttttgtattttttagtagagacagggtttcatcatgttagccaggatggtcttgatctcctgacctcatgatctgcccaccttctgcctcccaaagtgctgggattacaggcgtgagccaccacgcctggccaaatatttcatctaaaatatatatgttcaggatgggcatggtggctcatgactgtaatcctgacacttagggaggctgagctgggaggattgcttgagcccaggaattggagaccagcctgggcaacaaagcgagaacccatctctattttaaaaaaaaaaaaaaattccacctagaactctggttaggaaggaggaagagagtgtccacagtccccaccaaaagtgtgtctgtcaactcacaagtctgtactggcctccgtcaagaagctggggatggagaattaaggtaaatatttataggttatcaaagggttagcctaggctaaacatggaaatctggtggtggaggagaggaatgatagttgctagtagaaggttggctgtccttttgtcatacagctggttcaatataaagtatatattgatgctttacagccatgctgtctgtccacgctcaatgatttgataaggtggatgatggtagtggtaaacgcagagttctcattaagaacccctgaaatgccaggcttataaaaagatgcacatactcattgccatggaacacacccctttccatcccctctgaaggcagctggttcacagcctctgccaccaactcactcatttgcactggagccttccttttgtatataactgggtggcctgcgtcatggggtgtgcctgctgtccctgctttcaggtccacaaaatgagccctacctgggttaactgcccatactctgccttccttcagccgggcctgtgcatttggaaagttctgcttacaagaaagatagggtctatgcagtggccacacctcagcctctccagcctgcaggcctgacagaattttggcagcacttcccagcccagtgcacaccatgtccaagtgaaggagaggcagctgcagacgtcagcatggggctgcagcacgagccacagccatggctgggacttgctggcctctggtctggagccctttgccttgttttctggcctggtccagaggaataccagtgtggtatttacagttggggacggacaggcattttctgtgccaggtgcaagcccttatacagctgcagtcatagttgaagcctttctccaggtgccctggaggcccagccctgcagttggatggaataatgttggggtgtttgcaggcagcgtctgcagttgctgggcttctgggactgggtggctcagccagtctctgaagttacgcattgcgccagagcatggccaagggaaacaagtccttaattttctgctttccagcccaggatcctgtccttagggatttggcacatgtgggaatagggtccactaactactttcagtacagttgatccttgaacaactccccctaccctgcaaatcaaaattctttgtataacttttgactcccaaaaatttaactaataatagcctactgttaaccggaagccttactaataacataaatcaacatattttatatgtcatatgtattatatactgtatttttacaataaagtaagctagagaaaatattaacatcataaagaagaggaaatatatatgtatatatataaaatatactattcattgagtgaaagtagataatcataaaggtcttcaacttcgtcttcatgttgagtaggtagaagaggagaaggaggaagagaaggcgtgggtcttgctgtcttaggggtggcagagagaaaattctcacgtaagtgaactgggcagttaaaacccgtgttgttcaagaggcaactatgtttctaaaacctaaaggacataccatgttatcttcagtaaacctgtagaggctaatttaaacatcaagtaaccttgtttttatcaggaattatatattattgtttatctcaggcaaatagtagctctgatcagcactgtttttttttttttttttgagatggagcctcgctttgttgcccaggctggagtacagtggcatgatctcagctcattgcccgctcagctcacagctcactgcaacctccgcctcccaggttaaagtgattttcctgcatcagccccctgagtatgatcagcatctttatatatatgtagcaaatggtgtttttgttggttttggttgttcttaaactttggtgtctctcaaaggtccaaagggagattggtctcattccttacttcacaaagaatgatagaagtgtgctcatactgttaagattttcctaaagttatagagcaggacttcttattcttgtctgacttccttaaatttcagagatttgttgactttctttgggaagaaggtctggagccaggctccatgtgggccctctctggtctccctgtttctgcacctgagctagggtggaagcagtctgtcttcccacctatcagagccaggctctgccccatcacctgtgataaggaatgggcagaaaggaagccagctgaaattgaaaattagtaattttcccactgacttgtacttggacctcagcagaaatggtgggtgagtgtcaaatgtttgtgtgtcagttggttgaaggcctaagtgtatttaagtatgttgaaacatttctgggccagttctttgaatgtatgtatgatgcctttgtttgttggaagtggaagtgagtttggctgtagagctgggctacgctggggtaaaaaactatggtaggtatagggtcagcctctggtctaaatgacagttatatcagatgcttgtcttctgtcatgccgctaaaacaaataaacagtaactagattaaatttccctaatttgagatgggaattaacacagcattgctttagtctagtacaaggctagcttggcttttaagtaactcatagatgcgtttgtcaggtctgtgtgcccttgctgtgacaccagactgctggactcgatacttgccagttttaagcatcttactttgttaagctggtttaacacccctaaagacagataccagcatattatttagtgtccagagcagtgactgagacaggatgaccgctgtttgatcagtggcaaggttctttcatagtttgcattttgtggtgcagcaaacacgaagactgccattcattctaatttctgaacctttcatgcatggcacaacatgagaagcttatcacacaccagctaccaaatgtggaaggtgtgtgcagtatgtgttagatttactcttcaggttttccttattttagatctagggcaagacagcatggctatttttaatatttcaaaggggagtgagtgttggagatgtctgtataataggacctgaaggaacgttgtgcccgggcagggtccatgctcatggtgctacaaactctgtgccttttataactttatattaacccaaaggattctgttttaatggaagttggggatattaaaaacaagacaatgtttttccccactcagtctttcccatgtttaacatgaggtaatgtaatatagaattgtttttaacagtgtatgtcaagaattttaagtcctttaaatttgtcagtaaagtgaacttaactttaggtaataattttaccttgtgaatggcagtaaaatacttttagacattattagcagatttttagagttcctaactcctttcctgaaagcgaaaagaaagtaaaacaaaattttactcgtcatgtgcttaaattagtttgtcattaaatatcagcactctggaaacaaacaaaatgcaaaccaacccagtgtaatcttaccacgcggtttttaacaatagcaagcacactgtttttaataagtgcgtgatgttttgctgtagtataaatcactgactcctggtctttttagtatttaaaatattctaatttctggtttgaccccactgtcccacccccaatattttccagaaagtgtttataaattttgttttaattaaaaaggagtgttttgattttaataatattctggtagcttcctgacctcctgggaatgtctggggagagcctggctgtagggagaggtgttggtgtagcaatgtcaagacactccctttgagtctctagcctgtggccttccatgaatgtttctgtagatgtaggtgcattccaagcaggaaacagtggctccacaaatctatctttaaatgtattattgctttattttccttgagctcaaacgcatgtcttctattaggtgaaacaggagtaaattcttagtgcctgccaccttcagttcatgggttacagcaatggttacagcatgattgactgtcctcaacaatgacatttaaaaaaaaattatctacttttcaaagaaatattgagaatctgctgtgtgcacagcactgactaacttagctatgctctatgttgtaaattctgcgtcttataccagtggctcttgatagattaactttttggtacaacaagaaaatgagaaggaatagatcaccagcaaatacctgctcctggagatggaaggcagagcagttccctcgggttcacaaccccctcccagattctcacttggttcatcagcaaagtctaggttttatacagaccacttgtgtaaagtaaaatagaatttttttccccttactgttagtggatggtatctcagtgataaatgtttaatagctttattgagaaataattgacatacagtgagcctctgagcctcatatatttaaattgtgtactttgatacgttttgacatgtttatacccatgaaatcattgaaatcaagataatccttccctcccacttttctctagtcttccactgatctactttctgtcactatagattagtttgcatttctagagttgtatgtaaatggaataatacaatatggactcttttttttttggtctggcttctttcactcaggagaattacttcagcatttattcatgtttgcatgtatcagtagctcattcctttttattgctggatggtgttccactgtgatggtgttccactgtatggatataccagagttttttcattcacagtctgttggtggatgtttaggttgtttctgatttttggcttttctaaataagctgctaagagcattccttatgccagtgataatttaaatttagtttctttaccagtctttccctgtctgcaaagtgagtttaataggattaattttgcttttccttcttctgtattgtatcaacactaggtaaattaagaggaaaaggaacagactatttttgggtggactagagtttctcttggttattactattggataccaagtatgtagcatctttgtatatctgtttttaaaagcaaatgtggcatagacagcaattttcaggatttatgaaagcagtcctaggaaaagttttcaaatgagtgtcattatttgggttgtgttctatgccagcaaagctgcaagcttcctgggaaccttggaaactacttgggagggatcctgacagatcctcaggaagagacaagagggtcagaaaacctgagaatgaatgaatttgttgtttctgctttaaccctgaaagtatttgactctgaagaccctcttctccctacttcatgttaatttttaaagtatagcagtggagtgattctctaaatttctggctttgttccttatcatttataaccttttccatagtaattcaaagcagaggaggaccatccctttttgttctgcttctcttcccttccccagaccttctgataattccatccagacactgcgtgtgcttttcctcgtctcttctttcaggctgtggaccggctggaggatggcctccaggacaagagggagaaagagaggcctctttatagaccctaggagccacccagccaccttcatctccaggttcctaacttggcgtctgtcttccttttttccagtaatgaccagatttagaacttctgcaggttgggctcaccccagtgtgcccagaatatttctttcagtgtgggagtgaaatattcttgttcatttagagtctaaagaggcacacttagtatttttttaaagaagaattttctaaaacatttactgaaatgccatggggccaccagcaggagctccagttctgctgattgtgctggtggaacagcagtcagttgacctagtaatgagcctcagaactggtgctcaagggtagtgccgatgttgtccctgtcagggaagcatggcaatcccatttggtcttggtcatcgcaaatctgatgataggcttatgtgcagaatctatttcttaaggtccccaaggtcttaagggtgctttgattctctgttcctgtctctggaatctgtagagataagagcttcctgtctgagtgacaaatgatttcactggcagaatggcagttaaccttaagcttttttggcttttatttttctggattttgttaatttctggaaaatggtacagtaggtgttcaggattggggtgatgattattaaaaataggaggtggaggtgaattatcagaaagttggacaaatactacatgtgggtgttagggttgtttcagatctctggcagcagtacggcacccacaaatggaaggttttgcacttaagttgtctttgtaacaaattaacaggaggcagaggcagagatggagaagaggagctggaattattgggaagttgaattgacctaccattgattgtgtcctgaatgagaagagtctaggacaactcttagatttctgacgtcaagtagaaatggtggtaatagtcatcaaagtaggaatgtaagaggcagaacaggtttgggtaaaatgttgagctcagtttttataatgctgagttgacagatctaaggaataccttaggattgatgtcttatgtgaaggtgaaactggatctggagcttgggagggaggttagtctgggaatgtaggtctggcaggttcctctgggtgtgctgggtaagactgtggacatgggtgagcacccccggggagaatatttggagcaagaaaagagcaaagagttcaggagaaacccatgttgatggggtacatggagaggaggaacccacagagtggaaagagaattgccactgaggctgagggagtatttcaggcaggatggagttgttggtgctgagaagtgtcagggcagagaagagatcagacttggcagcagttgggagaccctgttaggcagcagttaggtaccatgttctgggggaggccagatgataggagtagacccccctttggaagaaaggcagagaacagagccaactggaattttcatgggaaagtggagcaaattttaaaggttatttggcaattggccccttagtcttcactaagtttgtttacctcccgtcctctcttcttatggcactatgctagctatttactacaccataggcctgaggttccctgtctagggattgctaagtttttaggccttgtagagtgaaacctttttttaaaacagtgttttagaaagcttcctgaaaactcagtaagatgtttttcttttcttttctttctttctttttttttttttgacagagtcttgctctgtcccgcaggctggagtgcagtgacgcagtctcggctcacttcagcctctgcctcctaggttcaagcaattctcctgcctcggctttccgagtaggtgggattacaggtgcctgccaccacgcgaagctaatttttgtagttttagtagaggtggggtttcaccaagttggccaggcaggtcttgaattcctgacctcaggtggtccacctgccttggcttcccaaagtgctgggattacaggcgtgagccgccacccctggcctgatattttttcaatttgtatttagcagcatgagactttgaacctcttcagtgcaggcttatgggtgaagactacacctgcatggtgttcttaaagtcctctcttctgttgggtgtggtccttgatacagcatccctgcacagaatgagcacattaggcctgcttatgagaggtgagagttaaataactgatggacgtggaagagctctgtgagagccaggagggcatcacaggtggtctcatggtgcagtgctgaggtgagcctgggatgagtttgggtaagaaaacccctgagaacactcagtgacccctgcaatttctaatggttcttatttggatatttgtttctttaggcctgtcaactacttggtcccagaattcccgatcccagcataggagaagctcctgctccagacatgaagatcgaaagccttcagaggtacttcttgaatgcttgcctgaccgtgcatgaatatatgctatcccatatgcctagttgagtggtatctatttgtgcagtcctgggcaaattattcaaatccttgtgctccagtttccaaatctgtaagacggggagaacacaagtgtctacctcataggattgttgtgaggattaagtgggttaattcacatagactaatacatgcaaagcatgtgaatagttgctggcacataaaaagtgctcagtaaatgttagttattattattaattacattctttttttcctttcttgttgcatcttcgctggctcccaacaacttttcttcctctggccaggatatcagcaggttcagctgctgccaagtcactgccagcctcaagttagttttagccatgggtttgtggcttatttggcaacaagcaaaactctgggacttttgtttaggggattatgctgaaggctttccccattctttctcaatttgtttctcatcttatgtttcctctgctccctaacttttgttatctatctatctaaagttgcttttaggtgcatttctttctgctggtctttgtttaggggtccttatgagacctgaggtctgtttattctaaagacttttgctaggctttaaatcatcgaagaaaaacattttattttatcacagttttcaagtgagaaggttataggaagagtttctttggttgaatgctttgctttgtgctgcttcttatgggatgagttcacaaacagcctcatcctgtaatggcaatgcataggcagatattccttggaggaacttcccaggctctaatagggaacgtcagaaggctgccctgctgtggagtggaggagttatttggttgtggaatagcttcctccatgaggaagtagtttacatcctttagaattgtggaaaaccatcccaggaggcactttagcatgagatcaaatgtacttgggaaggtagccacttcttccccttactttatttcaggccttttttcctttgaacctttagtgctctcttccttttctttgccaaggagtgtctctgctgctctttatttcttaattccttgtgctgtgtctgtaacccccaaaatacctttctgatgttcacactaaactcctgttacttcagcacaggaatacaagggggacttagcagctgtgacctggtgtgacgagggctggtccccagtggtgtagttcgaaacctacttccagcagtgacaccaagcatggagaagggggcccagcagcacgggttgctgtgctggctttgtcccagccctacattttggtccagatgtttttctcaaccctgagtccaaactatatgtatggcactaacatactctaccagagactccagagttgacgtccatttgagggcctttgtttcagttcttgactgagtctttgagcaaaggaatagcaggctgcctttttttcatttcattgcttcagtttgattttctttcttttttggcaaactcctttgttttttatttatatcagttagttggaatatgtttttacctgattggctcttgaaggtataggcccatctcttaggttttaaagtacttttctcttgggggccagggagttggtgtccactgggctgggcacctgcttctgcggctctatgcttgaagggaaggatcctggtattacacgtgatttttgtgggaggtgcatggcctaattcttgcttgttaataggtctttagaaatgaagagtggcatactggggaatagtccgtatggaaaatgacaggcaggagaaatggcctctttattcagacactgcctcagactttattatggggaagtttattaaagtgatcactagcctgaaaagccaccaggaaaaacaaatatggacctattagcaggcgtatgatgtgaactgtgcttagtagcacaagaaagaactccctgtcctgagaaaagagagttcagcattgtgacttgtgtaaacagacagggcagcttacagatgcaagcttgctcgatgccaaacacaactttgggctggtcctgatgtcaaggtcagagctttcttatgcagccttagacaccagtgggccaaggacgaggcttgagagggagccagctgtgcagccctggctgggaggcggtgttgtgctccaccccaggggcaggcctcactgaccaaggatgaatgccacaggcccaggagtctgcagtggcataggcactgggatggctgcctttcctgtggtttccttcatttggcctgtgataaggaattggggagctctctcggtagaggggcactgttggatctgcctgtttttggcagagtggggagagggtagtgactttctctatttcctttccccacaaataactcttcccaggtagaagttttgccaggtgaaggtgtgcaaacatgttttttgcaggcccatcaacccagtggcctgtggttgcttctcttccagatttttctaggccagcccagaccttgacttcaccagctaccataccataaaccctggtgccctgggaggtagggcctgggtgggggcagtctcattatagaaggtgagtccctggccaggagcagtggctcatgcttgtaatcccagcactttgggtggccgaggcaggtagatcatttgaggtcctgacctcaatggtttgagaccagcctggccaacatgatgaaaccctgtttctactaaaaacacaaaaattagctgggcgtggtggcgtgcacctgtaatctcagctactcgggggtgctgaggcaggaggatagcttgaacctgggaggcagaggttgcagggagccaagactgtgttaccgcactccagcctgggtgacagagcaagattccatctcagaaaaaaaaaaaaggagatgagtccctggtggttctgggttttggcttgaagttgttacatggttagtggagttatatttctagagcacccttgagtgcagtatctcccttcagagatttccaggtacatgttttcagcagcccttttggtgaactgagagacatttttcagaggcggacaacaagattttttgttgtttttgttgacgttgttgtggacactatggactgagggagtgagagggcagtgttccctcagcactgccaccccccatgcctgagtgaggtaaaaggcgtgtcaggcaaagtttttctgtaataggtcaggcttgttctatgttgatacagtgaccttgttacatggcagctccatggttacattgcagctgccagcactctgaataagaatgcaaatatcaaatgtcagtgtccctttctcttcctttccaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccaggtagagatgccctgaggacagaagcctctccacccacccttgctcttcttccctgacagcaggcatctgagaagagacaatttctgtgggaagagacagtttctgagttagcattaaaatatcatgaggcctcaagtggaaatagaaattcaggagcaacatacttcaggcatacagggtagtggttttgagggccatgagcctccaaacttaacattacagccaccactgtggggaggtgctgctttcttatgagaggaaggcaaattccaagacatcctgggaagtgatgggctaggggaggaaaatttgggtgttcacacgtctgcatcctcttttcctgccctccgtattcgctctggagagtggctctcctggagagaagcatctggctttgttgggaactagcgcgggcagctgctctgcctactgcggttgcctctgcctttggaggaggacaggtgttaggagacctgtcagttagggtttgtggagaggggagttttggagggatttattttgactggtcacattattcttggggtacgttctctggatttactgacttatctttaaggatccctcagggtcgagtccctgccgactctcctcacaatcaggttgcagctagtttactcatttcctcactgtgccactctgtgccacctggagagtcctgttaggagggaggcttgagtgccctctgtgctcagccggcacctggcttctccgccatcatcagttggctgctgctttgcgaaatagtgtctttctccacgctgagtcattactgaacttgcttcctggccctcacccactttgtgtctctttttttgggcacttaagattatcaaatttgagttgtcattttgggatctctggggagtctatccagtggtgacaaatgcccctgtcttactcaggtttaggtgaccagtcaggagtgccaggatggcccccacaggctagagtctggacctgtggaatggagtggtcatggggccctgcggggcagaccaggtatctgcctcagagcctgtgtctgagatgcagcatcacctgattcagcactggcagccccagtccaggaatcacttgctgaatgcttcactttcagtggggagccaggacagaagtgagcattaatacagcttgtggaagttttacaagctgtattaaagttggagccctgagcaagttggatccctgctcttggctgagtaggagaaataaatcccttcagtttgtccatgtcagtgtcacgtagataaaatcactcccgtaatataagggtgatgaaggtactctgacagactctgggcagcctgttgacagtaatttaaactgtggaaatgcatatgtggaaggactttgttgaggcctggggtctgtgattaggaagatggcctttttttggttccaagtcgggagtgatttgctcttgcacatgcagtcttattttgagtggggtgagttggaaggcaccactccaggtgttaaaggtcgggagagattgtgtggcagtaccaggaggagaaacttgtgcttttgttcctgggatcatgggtatatgttgggagagtcagtccccttcttggctgggactctgtttcttagattttttggtaatggccggggtcttatttccttttttttgtttgcgtttgagacagtctcactctgttgcccaggctggagtgcagtggtgcaatcttggctcactacaacctccgcctcctgggttcaagcaattctcctgccccagcctcccgagtagctggggttacaggcgtgtgccatcatacctggctaatttctgtatttttagtagagatggggtttcactgtgttggccaggctggtctcaaactcctgacctcaaatgatccgcctgcctcggcctcccaaagtgctgggattacaggcttgggccaccttgccccagcccaaggcctgattttcttttccctctctccctctttttttttgtgaggtgtgagggttggcgggtttctccctctggttctcagagtctgctgcgcctgccctgcctgtgtggtgccctggttctaatggcctccagcagggatgggcaggtctggttaagggaaagtgatttaatgactaactcttgaaatgtatgggtcagtgtgttttggtgttggctgcaggccagagtggtcagaggtggtgggcagggcacagcagggtcccgggaagcagattttgaaggcttctacagtgttttcatttgtatctattgcctgttagcaggctttaacaacttctagttaaggttttattagcagtgacattcaggttttcagcctctggtgatgacctggggctctaagggttggaagaggaagacatttggggccttgtggcacacttcattgtctgtggctgaaagggtaacctggctgccttgtttttttattatccagggttgtgtctgaagagaaatccctcatgttcatcaggcccaagaagtacatcgtgtcatcaggctctgagcctcccgagttgggctatgtggacatccggacgctggctgacagcgtgtgtcgctatgacctcaatgacatggatgctgcatggctggaactgaccaatgaagaatttaaggagatgggtgagagaccatgtattctattattttattaaccaatgatgaatagagacattttaggcaggtaggtgagtagcagaaagctccttattgccagttgcaggcagctccatcatagctttagtcagtgagaatcgcagccctgccttagatctcagcctgtttggctgtgtcagatgtgctgagatggtttcagagtggaagcaaggctcctcggctcaggcaccagggattcccatccccgctctgatctaactccctcattcacttaccttaaggaagctgaagtccagggaaacgaagtgacaaaagggcatggcccacagttacctgctctagtgtttttttcctgtgatgccattcggattccttctttagccgtggtttgctgcttctctaaatgaacactcttccaggcatgctccccatttccaagcacatcatgtgtgttttaacttgagcgattttccttatgtcatgctgcaaacctggagttctttttccctccgtttatctctgtcctggctttccttcagtgaagcctgacattagctgtgtgcccagcccttctccacctcttttctgcaagctcattttagcgtatgtagacgttggagcatctcatggtgttgagactgggatggcgtataggtctcatctcacatgccagtcctgattgctaagggttgccttgagggtcttgatgaacaagacagtggagtcaagtctgggctcagtgtgaaaaactgtgaggattaattagcttttgtgctgtaggtacacggtggggaggtggtggcaagggccatgtattgtaatctaggacatagtaaataatcacaagatcggccgggcttgttggctcatgtctgtaatcccagcactttgggaagccaaggtgggcagatcacctgaggtcaggacttcaagaccagcctggcaaacatggtgaaaccccgtctctactaaaaatacaaaaattagctaggcgtcgtggtgggtatctgtggtcccagccactcaggaggctgaggcagaagaatcacttgaggtgattcttctcaagtcacttgagggggtggaggtttccttgagccgggattgtgccactgcattcccacctgggcaacagagccagactccatctcaaaaaaaaaaaaaaatcacaagatttttgtcatggtggatttcacagccttgaagggccaagaccttttgcgtctttccagggaacgtagcatagggtgtggcttgcagtagatgcttgtcctgccattaggctcaccacctgttgaatgggagtgataatgtagactgagctgagcatggtgttgtcttctactcgctcagttactcaagtgtttttatagacaaaatagacttccttcttcttggtcctgctttaggtattaatggccaaaacattagcaggccacaaggtggttttatggcatgagttcaggagttctcagagatcttttggaattgaatactaaattttagcttcacagatgatacagtttctgctgtgttgtaagcacattataaagaccagtgtaatacacttgactggaatctaggtgtcctgtgttaagtcagaggactcagcccaaagactcttcgcatttatgaatggtttaaataataagaactgggctaatccatatttgaagatactgttgaatacattggcaagattaattttgtaattttataacataaacggaacgcatgcttaaatatgtttgtcttagctgttattggtctttttttctttcttttttgagatgaagtctcgctctgtggcccatgctggagtgcaggggtgcaatctcggctgactgcaacctctacctcctgagttcaagcgattctcctgccccagcctcccaagtagctgggattattggcacctgccaccatgcctggctaatttttgtatttttagtagagacaggatttcgccgtattggccaggttggtcgtgaactcctgacctcaaatgatctacctgcaaagtactgggattataggcatgagccatcgcgcctggtgtttcagtcttttttgcatttggttaactatgtttttcaaccttgtagaagtaagaggatgaggagggataaaccatttaaaaatatttgagtgcccaaagtgaaatctgttttgagagaactgttttacctaccaagaaaggcaaatttttaaaaacatccataccattatatgaagtcatggttttgaagtcacttacgtgttagttgttatgtgtaatgagtataatgaaatgacttattcaacaatgtatgtatttaatatccttgaatccttttaaaatttaccttttgcttttccatttactacactgcatcttcactacctgaccataggaaaataacagtttcctggaagactctcccctttgaagattgtttcttagaaggatctgataagcatttaataaaaaattttggggccctcagagatggatgcatcgatgggttgattgattgatagattgagacacggtcttatgtcactcagcctggatcacagtggcacagtcatggctcactatagccccaacctcctgggctcaagcagttctcccaccgcaggctcttgagtagttgggactacaggtgtgtgccaccacgtctggctaattttcatattttttgtagagatggggttccactatattgcccaggctgaccttgagctcttgggctcagatgtgagccaccacgcctggccagtgattggatttatttattgtacaattatttattcattatacattatttttaagtataaataaaccagtactattttgtaatatttattaatatggatttattaaaatgggttttgtggcatttttaacttcaggaatgcctgaactagatgaatacaccatggagagggtcctagaggaatttgagcagcgatgctacgacaatatgaatcatgccatagagactgaggaaggcctggggatcgaatatgatgaagatgttgtctgtgatgtctgccagtctcctgatggtgaggacggcaatgagatggtgttctgtgacaaatgcaacatctgtgtgcaccaggtatgtggggcagggaggccagaaagaagaaacctggggcatgagcctgtctgctgtgggagtgtatgcctggagtccaggattcttcctccgaatggggtctgtgtttctacgatttaaagaaatgtgccctatagactttatttttccctagtaggttcttacagtgattgaaatatatcctctgcttttgcagccagaaggatagcaccctctgtggaaatcgtctttcttcacagtgttttattcttatccataaaagtcaagtttacttaaaaagaatgtatgagccccctctgtcctactgtaacacttaaatttaggtattaagaacactgagaaaacaaacctttgaaaaggtggttagtgtgctgtattagtttcttacagctgccctgtggaacagacaaattactacagactgtgtgtgcttaaaacaacaaaaatgtattgtcttgtggttctggaaactaaaagtccagaattgaggtggtggcagtgctgtgcttcctctgaaacatgcaggagagcccttccttgcctcttcgtagcttatggtgatttgggcaatcttgggcattccttggctcgcggctgccttcatcatcatgtgtgttctccctgtgtctctgtcttcacatggtggtcttctttttttttttttttgagatggctggagtgcaatggcgtggtcttggctcactgcaacctccgcctcctgggttcaagtgattcttcctcctccgcctcccgagtagctgggactgcaggagtgtgccaccacacctggctagagatggggtttcactatgttggccaggctggtctcgaactcctgacctcatgatccgcccaccttggccttccaaagtgctgggattacaggtgtgaggcaccgtgcccggtccacatggcggtcttcttagaagggtaccagtcgtatgggactagagacccaccctacttcagagtgagctcatcttaaataattacatctgcaatgactacttctaaatctaaagaaggtcacattttgagatatttggagttaggacttcaacatgtcttttagaggacacaatttgccgtcatatttgtgagcatgtgttagggtataagctgagctgttagaggaaagcagccccttttcctgaagacgatttcctgtcttaaaaaacaggacagtaggttttggtgattgcttgctaccatccacagaaagggaaacccttagatttcaggaggatgggcgctaggtaacttaaaaagtttatgacaatctcagtgcctcttttttatttagtttttaatgcagtaatgaagaaatttggatttgggtggggacatgtgcccacgtatattcttaggatttaaaaggctatcctgaagtactttctttaaattcacctgttgatgctgagatttaaagcaaacttaaaagaaagacttgtatggaataggtgcttggtgacttcttgggaagaagaagcacgtttgctccatgaagttcttgattaccctttgcttcataatttgtgacctcctaggctttccctctgtctgaagacctccccagctgtggcccagtcctggctccttgatagggagacctgcgactcctgcttcagtcatcgccgtctgttgctctggatctcacactgtctgggaagtctccttacggtagtgagaattcctgtggtggctttgttctgtgacatgagcatcctgatgaccagtgttgcttttttggttgctggtgcttcatgtatttacttggctgacttctcagtctttttcttgtctttacttgctatttttttccccatgaaaaatttttttgagtaaaagctttctgcttgaaaactggtcaacccctgtgttatcagtgagttaactgatgtcagggcaggcttgtgcaagctctcacggtggacgtgtggcagagttgtaacttaaggcttttggatgcccccttctcaccttctcttctttctgccatatcaccttttctcttttcctcaacatttacttcatttttcctttgagaaatccttcatggcttatctttaaggcatactttatgtaatctcctaaattaatttagacctgcttttccaggaaaaaaatttcttccttcacatgtggctgtagaatgtctgatacagacctttagtgttttgaaacctttatagtgtcacttaactccattaaaaatttttttctagtaagtctgcgttgacggtagcttatttatggcccccaaacagcactctgaggcttccatctgaagtgtgacttttctttgctcaactctcatccttgtggtttcctctttgcatcgtcgtgggtattcagattgcatagtggctgtgttttttctgtctgaagaattagagctatgctactgtgactctcgacttcctgacttccaggtcatttatgaataaagtgctgaacagttgggtttttaaagggctctctgaatatgctcctggtaccatcgtggtttttatttattcagttatttaacattaaccttttctgtctttgaactgtcttaattactttagttgtaatagccttgatttctgcagtttatgccatcttgtttaattttgccatcttgtacaaaacaggctttgttttattttttaatttaaattgttttttttgtctccatttctgaaaggctgaatttgttttaaataccagctaaggagacgacattcttcctgtgtagaaggtctcctttttctgccctgttttgttcactgggagagtgctgggatctagttggtatggagtttgcttagcctagggagtgtgcatgcttctctcctgttccattgccatctcattcagcagctttgggagattctctcagctgctgtatgctttttctccacactctgtattccaccccacctctgtcagtaaagtagagaaatagcttctctcacggaaccctgtggagtgtttcgaggacttactgaggacttactgctcaatatttagaaacttggtatggatgggtttctgcggcaacacagcaaagcagatttcatttaaacctttctgtcctcaagtagtttccaggaccaccctctgctaaataaatatgtattgtgtcagcagagctcacctctattatgaatacatattcacctcctaaatgctcctgtgaggctgccgggcattttcccgaggggagacggtcgtagccaggaagctgtgggagcgtctctgctttggtggtagttctgttaaaatctttctaagtgtttaaaatgaatagatataatgggaaaaataacattttctctttctctctattcctctgggatgtgccgtggcatcacaggcctgttatggaatcctcaaggtaccagagggcagctggctgtgccggacatgtgccctgggggttcagccaaaatgtctgctgtgtccgaagaagggtggagctatgaagcccacccgtagcggaaccaagtgggtccacgttagctgtgctctgtggatccctgaggtacgtgtggttctttttttgttgtttttacttttttttaagacagagtttaactctgtcgcccaggctggagtgcagtgagctggatcatggctcactgcagccttgacctgctgggctcaagtgatcctcccacctcagccttttgagtagctgagattataggcatgtgctaccaggcccagcttattttttattttttgtagtgaggggatctcactttgttgacctggctggtctcaaactcctgggatcaagcagtcctctttccttggctttccaaagtgttgggattacaagcgtgagccactgtgcctggtcaagcatggtttttaatagcaccttagctcagaaggtcctggcttttaactgggatttagtgggtgggtggagaaccatgcataaataggcagcattgcagctatgagtaaaaagataccttttagttgctacctttttccttgaggaaaaactgaatcttaagcacactctcatcttgtcatggaatgtagattcatggaaatgttagctggaagcagcagtcacttgggactggaagttagtggtggtcacccagccatcacagtgagccttcccatcgcgactctcactctcaggagcagacctgtagcacttaaacagctgtggcctgggtgtgtcattccccaaggatcagctgtacatcctgtgtgtggcaagctgtacttgagttgaggcaccaccatggttaaaaaaccaccactcttaggcatactttggtgatttttatttaaactcttattgtgcctcaacctttttaatttcaggtctggtctaatttatttctagtctcagaccttgactaatataatttgcatagctcagtgtgagaatataatttgctattcaaattccagcatgttttgggtgtgattttggtacattttcctcttggggaatattatttgaggatgatttggattgaggtttcatgattcgggtcttggtagcactgagtctcgtggtttggtattgatgggatacaattcggtgatccaggctgaatgcagagatgataccttatttatctttgta

SEQ ID NO: 1250 - DNA, 154306 bp, Homo sapiens
gccctatagactttatttttccctagtaggttcttacagtgattgaaatatatcctctgcttttgcagccagaaggatagcaccctctgtggaaatcgtctttcttcacagtgttttattcttatccataaaagtcaagtttacttaaaaagaatgtatgagccccctctgtcctactgtaacacttaaatttaggtattaagaacactgagaaaacaaacctttgaaaaggtggttagtgtgctgtattagtttcttacagctgccctgtggaacagacaaattactacagactgtgtgtgcttaaaacaacaaaaatgtattgtcttgtggttctggaaactaaaagtccagaattgaggtggtggcagtgctgtgcttcctctgaaacatgcaggagagcccttccttgcctcttcgtagcttatggtgatttgggcaatcttgggcattccttggctcgcggctgccttcatcatcatgtgtgttctccctgtgtctctgtcttcacatggtggtcttctttttttttttttttgagatggctggagtgcaatggcgtggtcttggctcactgcaacctccgcctcctgggttcaagtgattcttcctcctccgcctcccgagtagctgggactgcaggagtgtgccaccacacctggctagagatggggtttcactatgttggccaggctggtctcgaactcctgacctcatgatccgcccaccttggccttccaaagtgctgggattacaggtgtgaggcaccgtgcccggtccacatggcggtcttcttagaagggtaccagtcgtatgggactagagacccaccctacttcagagtgagctcatcttaaataattacatctgcaatgactacttctaaatctaaagaaggtcacattttgagatatttggagttaggacttcaacatgtcttttagaggacacaatttgccgtcatatttgtgagcatgtgttagggtataagctgagctgttagaggaaagcagccccttttcctgaagacgatttcctgtcttaaaaaacaggacagtaggttttggtgattgcttgctaccatccacagaaagggaaacccttagatttcaggaggatgggcgctaggtaacttaaaaagtttatgacaatctcagtgcctcttttttatttagtttttaatgcagtaatgaagaaatttggatttgggtggggacatgtgcccacgtatattcttaggatttaaaaggctatcctgaagtactttctttaaattcacctgttgatgctgagatttaaagcaaacttaaaagaaagacttgtatggaataggtgcttggtgacttcttgggaagaagaagcacgtttgctccatgaagttcttgattaccctttgcttcataatttgtgacctcctaggctttccctctgtctgaagacctccccagctgtggcccagtcctggctccttgatagggagacctgcgactcctgcttcagtcatcgccgtctgttgctctggatctcacactgtctgggaagtctccttacggtagtgagaattcctgtggtggctttgttctgtgacatgagcatcctgatgaccagtgttgcttttttggttgctggtgcttcatgtatttacttggctgacttctcagtctttttcttgtctttacttgctatttttttccccatgaaaaatttttttgagtaaaagctttctgcttgaaaactggtcaacccctgtgttatcagtgagttaactgatgtcagggcaggcttgtgcaagctctcacggtggacgtgtggcagagttgtaacttaaggcttttggatgcccccttctcaccttctcttctttctgccatatcaccttttctcttttcctcaacatttacttcatttttcctttgagaaatccttcatggcttatctttaaggcatactttatgtaatctcctaaattaatttagacctgcttttccaggaaaaaaatttcttccttcacatgtggctgtagaatgtctgatacagacctttagtgttttgaaacctttatagtgtcacttaactccattaaaaatttttttctagtaagtctgcgttgacggtagcttatttatggcccccaaacagcactctgaggcttccatctgaagtgtgacttttctttgctcaactctcatccttgtggtttcctctttgcatcgtcgtgggtattcagattgcatagtggctgtgttttttctgtctgaagaattagagctatgctactgtgactctcgacttcctgacttccaggtcatttatgaataaagtgctgaacagttgggtttttaaagggctctctgaatatgctcctggtaccatcgtggtttttatttattcagttatttaacattaaccttttctgtctttgaactgtcttaattactttagttgtaatagccttgatttctgcagtttatgccatcttgtttaattttgccatcttgtacaaaacaggctttgttttattttttaatttaaattgttttttttgtctccatttctgaaaggctgaatttgttttaaataccagctaaggagacgacattcttcctgtgtagaaggtctcctttttctgccctgttttgttcactgggagagtgctgggatctagttggtatggagtttgcttagcctagggagtgtgcatgcttctctcctgttccattgccatctcattcagcagctttgggagattctctcagctgctgtatgctttttctccacactctgtattccaccccacctctgtcagtaaagtagagaaatagcttctctcacggaaccctgtggagtgtttcgaggacttactgaggacttactgctcaatatttagaaacttggtatggatgggtttctgcggcaacacagcaaagcagatttcatttaaacctttctgtcctcaagtagtttccaggaccaccctctgctaaataaatatgtattgtgtcagcagagctcacctctattatgaatacatattcacctcctaaatgctcctgtgaggctgccgggcattttcccgaggggagacggtcgtagccaggaagctgtgggagcgtctctgctttggtggtagttctgttaaaatctttctaagtgtttaaaatgaatagatataatgggaaaaataacattttctctttctctctattcctctgggatgtgccgtggcatcacaggcctgttatggaatcctcaaggtaccagagggcagctggctgtgccggacatgtgccctgggggttcagccaaaatgtctgctgtgtccgaagaagggtggagctatgaagcccacccgtagcggaaccaagtgggtccacgttagctgtgctctgtggatccctgaggtacgtgtggttctttttttgttgtttttacttttttttaagacagagtttaactctgtcgcccaggctggagtgcagtgagctggatcatggctcactgcagccttgacctgctgggctcaagtgatcctcccacctcagccttttgagtagctgagattataggcatgtgctaccaggcccagcttattttttattttttgtagtgaggggatctcactttgttgacctggctggtctcaaactcctgggatcaagcagtcctctttccttggctttccaaagtgttgggattacaagcgtgagccactgtgcctggtcaagcatggtttttaatagcaccttagctcagaaggtcctggcttttaactgggatttagtgggtgggtggagaaccatgcataaataggcagcattgcagctatgagtaaaaagataccttttagttgctacctttttccttgaggaaaaactgaatcttaagcacactctcatcttgtcatggaatgtagattcatggaaatgttagctggaagcagcagtcacttgggactggaagttagtggtggtcacccagccatcacagtgagccttcccatcgcgactctcactctcaggagcagacctgtagcacttaaacagctgtggcctgggtgtgtcattccccaaggatcagctgtacatcctgtgtgtggcaagctgtacttgagttgaggcaccaccatggttaaaaaaccaccactcttaggcatactttggtgatttttatttaaactcttattgtgcctcaacctttttaatttcaggtctggtctaatttatttctagtctcagaccttgactaatataatttgcatagctcagtgtgagaatataatttgctattcaaattccagcatgttttgggtgtgattttggtacattttcctcttggggaatattatttgaggatgatttggattgaggtttcatgattcgggtcttggtagcactgagtctcgtggtttggtattgatgggatacaattcggtgatccaggctgaatgcagagatgataccttatttatctttgtaatttcccatcttgaatgtagtcatgtttcagactgaagaaaatggttttttttggcgagagattaaaaacaggttatatttacttaccctgttgttgacaacctatttgaatcgatttaagatggatttttagtcttcaccaatttgttatgagctagagattatagacggcattgtcctggtacatgactctttgtcatcagacgctccggtgagaagtgaaaactcagttatctaagtgtttttgacagacagggatgtctgtcagatggggactgggctgtgagctcagttgtcactggggctgttctgaggcttttaaagtaagggtttgctttgagtgggtgccccttgccactgtctggtaggagagatgtaggaaagtaatggatcttttagtttctgacattcatgttcagcctttgacgacctgagccaccctgtcttgctgttttccgacctttaggtgagcattggcagcccagagaagatggagcccatcaccaaggtgtcacacattcccagcagccggtgggcgctagtgtgcagcctctgcaatgagaagtttggggcctctatacaggtaattagcttcctaagaatggcttcattttcctttcctgcgtggtggggagcaggatgagggaaggctctgtgaactgtccaagggtttggagaggggactagaatccaggaagcaggacgaggttcccaaggggtgactccagccccagtacacacacctttaataggctaactgtatccggtgtaactagaacccaagctttcacagtcacagggtagttcagaagttcccctgagctgtgaggcggttgcagtttgtctctcgctaccctttctgcccaaagtctagcatcgcaacttctttccataggccaacacctcctagcagtcttagtgagatgttccttgacacggcatttgagagttggccaccctcccacctgcagtcactgagtgtagctgcagaccctggcccacctctgtggcggcctcctgagattgcaggtttccatggtgtgcgcacatctgttagtaatcaaggggacatgctaatgcatttgcagttggaaaaacagagactctttgaacacggcctgggtagaggggcatctgtgaggagttcctgtgtatgctgtcatctcattggggcatcatttggatgtctgattctttatggcaccaggcgcgcatgcacgtgtgtgtgtgtgtgagcgtgagcgaaagagtgcgtgcacacctgtgtgtaaacatgttgcctgcctgcttttgcatatccaggtacagacaagtataggatgtcatgagataggggaattaaggagggaatatagatggcatgctgtttttcatgtggtctaagaccctactgagaagttcgtttttaggcctcacattattgacatctagacagtcaggattagagaggcctgcagtgctgtgtggctgatgggggcccttcaggttaagtttggatcttctcggatgtactagcacaggccacaggctcttcttccttggtttcctcattgaattctgggagcagaggcactgttttgggatggcttctttctcaaagcagctcagcacagacataagctccgagagcatggtcatcctgtcagccatgggttttaaagaaatgacctcatttggcaaagtcggtttgtattttgactgataaatactttttgggaaggtggttttaaaatttttttttttttttttgagacagagtctcactctgtcgcccaagctggagtgcagtggcatcatctcggctcactgcaacctccgcctcccgggttcaggcgattctcctgcctcagcctcctaagtagctaggattacaggcgcgcaccagcaagcccggctaattctcatttttgtatttttagtagagatgggggtttcaccatgttggccaggctggtctcgaactcctgacctcgtgatccacccacctcggcctcccaaaatgctgggattacaggcttgagccaccgcgcctggctatttttaaatttttttaacaagccaagtggttctacttttcttctttatcactttgactagtgttcaagaatccaaaatataacagaaatatttggagggtgggtcatgagacagctggtgggatttggctggggaccttgaaatagtggagatatttttggcatgtgaatacatgacaaacgcctctggcccgagttggattggggaaggaggaggaaagagtggagcaggaagagaaaagggcagggagctgatgaacttgagtgtgtgtgtgtatgcatgtgtgagtgtgtgtgtatgggtgtgtgtgtgagtatgcgtatgtgggtgagcatgcatatgtgtgcatgtgtgggggtgtgagtgtgcatgtggttatgtgtatgtgtgtatgcatgtgtatttggttatgcatatgtatgctgtatgcatgtatgcgtatttgagtatgcgtgtgtgaatgtgtatgtgtgtgagtatgcatgcgtgagtgcgtatgcgtgtgtatgcatgtgtgcatatgtatgcatgtgtgtatgcgcgtgagtgcgtgagtatgcacatgagtatgcatgtgagtatgcatgtgtatgtgtgtatgcgtgtgagtatgcttgtgtatgtgtgtatgcatgcgtgtatatgtgtatgtgtgtgagtatgcgtgtatgtgtgagtgtgcatgtgtatgagtgtgtaagtatgtgtatgcacgtgtgcactggcaggaaacaggctgcagcagaccacattccccggtgttctgagcgtagaatttatgcccttgcctgagtatgccaatctggtccataattaatgtttaaaagaggtgggcgaatgggatctttgtttcccttttgaagagagatgatataatgacttttttgttgccattgacctctttttcccagaacattaatctaaagaagaggccaaagaaggctgatgatttttcatatcttcacagaatggattgattttattaaaagaattcctctctgaaatgtctgcagctgtgaaggctctggtttacgtttctgtaacatctgtttgctgagtcaacctgaatgggaaaacccagaggaaggccatttggcgtttttacaaagtcctgtataaatattctgctgcagttcatttctctttagggttagagcgcttgggttaagtgtagtttaagccaaacacagatagtgtctcagtcatctgttcccacttttacttcccacttggctgtgtgctacaagggaagacactttgtcttctcatgacagtggccaggtgtgtatgtgtgcgtgcttgtgtgtgtgttctgccaccaaagctgatttcatacatttcttagaattgaggttatttatagagaaaatacagatttatgtcagtctctgtggttgaagtgtttgtaagggtggaatggtgaagggagctggattttctcctcttctcagtaaaagagacctcatagtaatggaagaaagcctggttggcagtgagtttcctcttaaatactggaatgattagggggaaagcctcagctctagcctctgccatccttggtgatgtgattcaggatctgttgaatgagttgaattcaacttctcagttggcttgaagccgctggattctacagctctgtgcagcccctggcatgccccggtgatcacttggcttcacacaatgcagtgctgcttttcagggactggcttcagtcaccatgaggaaccaccttctagggatttgctcagcaagatcagtggaggaggagttaatcactttgctcctgctagaccagaggcttgttgtctggatcaaaggcactaaattgtggccctgtttaggcagtgagaggggaagtgttcttctgcataggttgctgatacctggcctctacgttgacctccctgtgacgcatgggaaggatctttcacggttctcctgcctctcttcagtggccaggatcggcgtgcaccgatctcagggctcagagccctccatgcatctggtgaagcttcttcgcaagtgtgaagacctttccctacctttcctgtgctggattcctcttgtctcctattttttggggtttttattcagtttctccttcgtgctgcttcaaggaagtgcactgttcattttctcactcgtgttgggactcttcctggctggggagtcaggatttatgttcaaactgtgagtagtagtcattcttcccaaggaggttcttattcaggtttgcaccaaaagagctcaaatctgtaagaaaacccaagttaatgcctgaaagtggactttgcatattgagtacagattcttttgaatatgatcctagtgccacacctcctttctctacacatgtcatttgtgtaatcatgtctgctccaagatgggatttggatgcagttacttttctgaggaagttagggtttggttgattaaacctttcatttgaagagggcccttaaattccaagacttggctgggcgcagtggctcacgcctgtaatcccagcactttgggaggctgagatgggcggatctcttttgcccaagagttggagaccaacttaggcaacatagggagacctcatctctataaaaaaaattccaagccttacctcttttaaaacatgacaggatcttgcagggttaatccacgtacaactttcctgtcatggcacatgcttgaagcatggctcttctctgtgcatgtgtacatggggtgcctagcactgcaggccttctgccatcattgctctataatggtctattctcatgttctttgtgtgttcttgacagtgctctgtgaagaactgccgcacagccttccatgtgacctgtgcttttgaccggggcctggagatgaagaccatcttagcagagaatgatgaagtcaagttcaagtcctattgcccaaagcacagctcacataggaaacccgaggagagtcttggcaagggggctgcacaggagaatggggcccctgagtgttccccccggaatccgctggagccctttgccagccttgagcagaaccgggaggaggcccaccgggtgagtgtccgtaagcagaagctgcagcagttggaggatgagttctacaccttcgtcaacctgctggatgttgccagggctctgcggctgcctgaggaagtagtggatttcctgtaccagtactggaagttgaagaggaaggtcaacttcaacaagcccctgatcaccccaaagaaagatgaagaggacaatctagccaagcgggagcaggatgtcttatttaggaggctgcagctgttcacgcacctgcggcaggacctggagagggtaatgattgacactgacaccttatagtgacttagagaagaagatgcaaagaggcgaacgctcgcccagagcaagaaatgatagccagtcatatactctcagacccttgtacacaccacagcatgaggttgtgttggttaaaaatatttatgggctggtaaactcattgtacatatgtgcaaaactgctactgagtggggagcttctttgtggtttttttttttttaaaaacactttcccattaatctttactgttttgtaagatcaaatggggtgtgtcttccccacccccattccttcattctagagctagagtgaatgagccccaagaaaatgacccaaggagttgactcaggatggtttacagactgatttagaaaaccagaacggatttcatttctaatggagggggccagagatgggaaaatttcttgttcagtccggggaaacacacctaggtgctggtgatgggcttatgaaggaagctaagcacggctgctcactggcccccactttgtttcttgggtaattcacaggggaattcccagtactgtcatggagcagagcaggcagtgggtgctgatgtgtgtgcatgagctgtatgtacacatgcatatatctgttacagaagatactcctggcagtgaggtgctaagtcatcactgaggctgtgtgtgtgtgtgtgtgtgcgcgtgcccgtgtccatccatgtctctgttgtgtgtctgtgtgcgggtatgggtgggattcctggtggacaggggtgtcagatctgtctgaggagccccagtcatgctcagcacgctacagatgtgttgtttgtcacactgagattgctgaatgtcgtggctgttggctgccgagcctcagctgctggcatttccttctgctgtttgctgcttttgtgcctcccccactttccatcacctctggagtcccgtctggacgtcccttcctgctacaggaataatgaggcgtgggctgcctcccgctagggcctcctgctccctgtaggtagtttctggctgaggcttgctaattggggatgcttcttagagcatcttccacatcaactcccctggctgctggctaccgattaaattcattagtgtgaaagaggtgggagtgaggttttctggcctgaagcagtctgcactgaaaggtacccaagtggcctgaaacagtgtagggaaagacctgggaaacactggaccaaaaaagcctgatctcatggagacctgcatggccctgttagagatggcgtagaagtgaaagtcttaaagggagcattagagatccttttaatacacgactgagtgccagcttatttgtgatgccccttcccagaccaggttaggattcctgggaaggccgcggattccggccctggaagaggcaggatcctggagcagttttgtgaggcttttgtgctcccatacgccccctggtggtgagtgtaaagaagactttgcctctcacaactacatgtatgtgtggcatttttgttagagatgagaaaaggattgagaaggataaactggaatcctggtaagaagcctttatgccagcccgacacctgctgtaattggggtgcatgagctatggagtcagatagttgttgggagggggaggacaagaagtctattgtttggactgtgtttgtctcacaatcaccacaaaataaaagtgtagaaaatgcttgtggtgtactaactcttttctgtacttaagttactcagattaacatgcacttctaattctaaacattttttttggagtcatcactgtcgctgtttaagtagaacaatgccaacgatgtatgagaaacagggaataaatcaggatttgtgtgtgtatgtgtgtggcattacttacatttactttattaaaaagcctaaggaactttaaagaatttgtattcagtttatttttattttttcaagacagagtctcactttgttgcccaggctggagtgcagtggcgtgatctcggctcactgcagcctccgcctcccgggttcaagtgattctcctgcctcggtctcatgagtagctgggattacaggcgtgcgccaccatgcctggctaatttttgtatttttagtagagacggtttcaccatgttggtcaggttggtcttgaactcctgacctcaagtgatctacctgtcttggcctcccagagtgttgggattacgccactgtacccagccttagactcagtttaaaatgggcttattgtaatgaaaaaaaatacgctacccaaaatttgccatgatgcctgtgatggtgaaggcattaaacaattgaaatctttgccttgcccagagagttgcagttatttgtaattataaacagtaagtgtatcagggcaggggtgacaataaaaaaccaatcattactaccaacttgttttctcaagtaagttagttttctgtttaattcacacaatatcagtttatagcagatcctcaaaaatcatttaatacctgtgactacaatcaaggcatatgatcattctcagactgacaaataagtagccatcattagaaatgcagacaactgagtaattatggtgactgctcttccttcagacacacacctcggggcattgcatacctgggtaccagttctggatctggaagttaggtgacaggagtagatttcaggagggcttgggagcacacaactttaagaagacacagttgctgatgtggtgggtagccatgtcattcccaaggctgccacttcactctcattcctttcccctaaaagatgcagtaaatgtgagttcagcaaatgagtatttattcagataaagacgtgctaccactgcactctggctagcgttatggaaagtggccaagtcctgggggcagtcctgtagtcactcagtggaatggtcacctttgaaaatctggtagtggctacagtgtcccctgaacaaaaggcacgttcaactttagtgctgcaaacagttttggattcaagaaaacactgaaaccacttttagatgtcttagagcagtgtatctcagggtgttgtccctgacccagaaacttaggaatgcagattcatgggccccacctccaaagggtggttctgttttgtgggtaccccatgtttctgtttgggaacactgctttaggggaaagggatgatcaggtttaaggtggtgtgagagtgcacctggagatggtttaaatgttttttaagatacctccttgcaggcagttgggagaagataaagcaggggagggagcttggtggaacgggtgcaggaagaagggacaagctggatgtgttttgaggatgggagagcatcagtccagctctgcaggtggaggttgctgagcgttgtcctatagggaactttatgcataagggaagtcaggtttagagtcctcactactataaagtggagttggtcagggctgatttgttccgattgaaaaccatgccctttgctttttgggtttacatttagatatttcccatcagagatcatgaggaatagcagtgggatttttctatttagcagccatggtgtggtcaaagctaccaaaattaaatttgaataatatacaaagttcaaattccctggcttccccgttttccatttttaaggataatttcaagtaagagagatgtaagtatttctattacatgtctgatttgaatatgagagcaacctgtctgctcctaagatgtcaggatttgtttccattttttatttccaggagtcagattccttgttaatgtaaaaatggttctgtttcctagaagttttgaatctgctatggatctaggtctggcccctcgttcttgagcttcactcttaatttcccctgggtggaacaatatcgaagagaggaggatgttagccacttccattcccaagttggtgagaatttctataaaggacacctgcttcttggattgagggtgtgcagctgtcagagaagggaagaaactaccttaactaggctgattgacatccatgtaatatttactatgagacagggagagtgtttttattctcaattctttaaatttaaaataagacaggaaatgttagtgacataagggattgttagagaaaaaaagatgggaagatccgtaaagtgaatttgttaggggcaggagaagcctgacttggcattttcctgtttaggccaggagatattaccataatgcaaatgtgaaagcctgtgttctgtctctcttaatgcttcatgtcctcttgcaaatgagactgccttcagcacagctggaattattagggtttagtctacacttacgctctacaccagagtgcaaaatcttttgtgtcttcacaaggcttgttgatgcttgttgctgtcctcactgccaaaagaaaaggttggtgacctttggactttttccacttaaagtagggtgatactactttattgagtttatggggaaaaaattataaaggtgtcaggggaagagtttgctcataatgggatatttttaggaaagtgaaggcatgcctgtaggagctaatgggaaagatgtggtcagataaagatgctaccactcctgccactgagattacttaggaggtcttgtccacatattcctgaagaagggtttaattgtgtatttggtgtgctgtgtctgacatctgtgtttgcaggtccgtgtaatctaatcaggttgaccaatagaagattttaggactgaaggattaggggagtttagagactaattctttaagttttgtgtattgagtgatgacaggtggggaacaaatctaaatgttgattactgagcataggttagggttatgtgatccaaagcagtcacacatcagataggaagtagagccaactcttagcactgggtcttttcagttacaagcgaatcgggagagggcaataccagtttttcaagtgatgatgcagagaactggactggagatgtctaaccagcaaatcattggcaaagctggaaatttcctaggcattcgcacacctcatagcaacacataagctacctgctaactccaggcctttcagtgagttcagtgtgcagttgacaaagacatttactaggattcttggtaaccatttggtcttccagtgggcctggtgcagggggctccactttgatgacccttggccccatgtttacccagttcagcctcagaagatagttgataaagtgcagaagtggcttctgaactgctttaaagccattggccatccaagtaatagaagatattgatgcaataattagcaaagtcgactggcaagaggttgcaagttttgacttggacaccaatggcctctgtgccgggatgggttaggtgtgatggaggaggcaggacttttgtaggagttctctaggtgtccctcccactcctgtgggtccctaaccctcttcgatgttgcttctgcctatgttgagggctatatgtggaatccttcttatctgcccaaaaggagatcagagattggataaaatgtttaaagtacctattgatttcaagtatctgtcaaggccctagtaggagtaatttctcttaggtaaagaaatttaaaaagcaccaaagtactgttatactgtattgcttacttagaatctttattctctacattctaggttcggaacctcacttacatggtgacccgcagggaaaagattaaacggtctgtgtgcaaagtccaggaacagatattcaatctttacactaagcttttggagcaagaaagagtttcaggtatgcattaagccctggtaggtcaaagtatagggcaggggtttgtaagctttaacactgttgaggaagaaataatcatttcttaattttcttatagaagaatttaagaagcatagacgttcatatttaaaggaagtctttaatttgaggcatcatgtttaagggaaaaagctatgaatttgccctctataaatatgggtggaatcctgtgttctctgcttactgagcaaacacatgaaagtcttttgagtctccctaatttcttcatgtgcaaaatggagatatcgcaagctacctcttggaattgagagactaaaatgaaacagtgacttatatattacacagtacttggtaaacacatcatggggatacctaacaggtttatattcagccttgggctctatctgtaacatggtaaatatggtcaatatatgttaagactgtacttaagacacagtccatttttagataatgttcacagtagattttttttgtgtagatggattgttgactatttctgagattgagcaccaaatatttatttagtgtcttctattttatattgccctgggctaggcaaacagaaaaagaaaactagggtatatacttcctctactctggacaacacatcagttacttgggagatcaagggcaaagatcaagttgggcaggttgtttaacctctctgagattccgttgatcttaaagtttgttttagaatcaagaccccttaagtgcatttgagccctatattctgtgatcataagcccccaaaagtaggtagtataaggatttcagagaagcagagctgctgagtgtggatcaggcagaattagggacccatggaacaggtaggtcttagactggacttcattggaagatagtcagcctctctcctgccttggactgccctttaaagttctagctgcaccattcttggtgcttgcgttgtgcaatcatagttgattcactcttgtttttgtgcatttgtggctttttgtcactccatctagattattatggtgcacagagaacaaagaagttgttataacctgttgtgttgaaatccaaattctggtttatctaaccaattatgtgcgactagagggagctcggtcatctgaagaaataaaaaaaggtttagggaggtttaaataatgttcttgaagtgttacatagtttgaatgcaataacttgttgatatcctagatattttcttcccaagattaagtattttccaggtgaatcaagtgtatatcattagctggaacttgcagtttaattgttaagattttaaaaataaattttctaagtagggtgtcatatgtaaaagtaggtcgattcagattccctaaggtgagctctctcttcatgattcctacctgaatacaaataaatgagatctgtttaactgccttggaagactgtctggtgcagatcaccgagcctacagcagcaaatgctgagctgggatcactaatacaagttgtgcctgtggagttgtgccattggagggctttctgcaactcttaggtcattatgtaatgagtgattccctgtaaaaataagccgtaaagagcattttcatctggtttcatttgagttatttctcatggatattgcaggcaggtttttgcatttcatggctgaggtttttactgggtgagcgaatgatattcttaataagtctgggagttattttgtggtaacagagctgtaatgtagatctgcattcagaagtcctactatttcagaaaaggaaaacaaatcttcctttcattctgatgtaagaaccataggtatgatcagttgaaaacatttatcttcctgtaggattctgttgagtaatgcagttgaaaccctttagggtgctttttttctttttccagtcctaggcttcagtcgtgttcttattcatgcctaaaggctgtctcctgcctgaagtagagcagatggtcatgatttatatgtcatttagggtccatggtttaaactctgtgattctgagagtgggtagggtcatttgctgagagtgtcctcagtggcaacagtgcttatggggggtgggagggtcatgagttggaggctctttagagacatggattacagtcaaggagatagaaatcagagttcagaaaatgttagcctcttcttaccattctcttttcctgtggcaggtgattgagtaaaagaaatatatgcagtgtgatgtgaaggttgattctaatgattgattcttgagaaagcagcatttccaaaccagcaggttgtaaaacacctcctgtggtcatgacagctctgtgttctgagtcgctagctatgtttcatttgcttgcagtgtctgtgtctggtgagcactaggttctcatatggcctcctgtctcataacctgggggctgaaccttgttttcttggtggctcatatcttatgggagacagaaaacatgagaactgctctttctagatgatcttgaggctgttgtagaatcatggtctttatgacaaacactaatgtgttatgaattcacctgctaggggtaacaactcattagtgggttgtgagatgaattcagtgggtcatgaccagtattaaaaacaagtaaagtataataggaaatgtcagagtacattatcaaatgatgagggttaatattatttcgtgaaatgtgaactcttactaggtcatgctgtggaatttagtcactgtgatttgcatcaaaaaatacgaaaaacatcaatttaacttacttcaagttgaatgacaattcagttgaatcccacaaatgtattttgcacataataataatgaacatttttggaacgcttactatgtgtcaagaattatttcacacatttcctttattcattcacatgtttacatgtacttgtcctcgtaatagccctgtgagggtacagacacatagagaaacttacaagccccgagccctgctttttgggtcctctcagtctcgtacgggaggcagaagactggaccgtggaggagcgcggcgcaggtgctgctctgtaaccaggtagagggagcagaggcagccatcagccacctgatgagttctgcatggagtccgctctgaaaatcagatcagttattttgtttggaggaggtctagttttatgaaaaattatgtgagcttcagctgttttagaaaatgtggcatattgagtctgcagattgaatggagattctcaaggcaggtcatctcttcactataaaaaccaaatttgtacaaacttggtggtgtaagtgttgtgttgttgggtggggagttcacatcaattgggccacactaagggtgtagaattttattcttttggatttgcttctgctgtaatttttctttatttgtggttttatgtttataggtgtgccttcttcctgctcctcctcctcactggaaaacatgcttttgtttaacagtccttctgttggccctgatgctcccaagatagaggacttgaagtggcattctgcattcttcagaaaacaaatgggtacttccttggttcattcgctgaaaaagccccataagcgagatcctttgcagaatagccctggaagtgaaggcaaaaccctgctgaagcagccagacctgtgtggtagaagggaggggatggtggtcccagagagctttttgggtttagaaaagacctttgcagaagcacgtctcatatcagcacaacagaaaaatggtgtggtgatgccagaccatgggaaaagaagagacaatcgttttcattgtgatctcattaaaggagacttaaaggacaaatcttttaaacagagtcacaagcctctcaggtccacagatgtgtcccagaggcatctggacaacacaagagctgccacctcccctggagtggggcagtcagcacctggcacaaggaaggagatagtgcccaagtgcaatggctccctaatcaaagtaaactataatcagactgcagtcaaagtgcctacaacacctgccagcccagtgaaaaactggggaggattccggattccaaagaagggggaacggcagcagcagggagaggcccacgatggggcctgccaccagcactcagactacccatatttgggcttaggccgagttccagccaaggaaagggcaaaaagcaaattaaaatccgacaatgagaatgacgggtatgtccccgatgtggaaatgagtgactcagagagtgaggcatcagaaaagaaatgtatacacaccagcagcactatcagcagaaggacagacattatcaggagaagcatcttggcttcttgatgcaacagagatgatgcggaagccctttgggctcgtcattgggtttgctagaggagagctctgatgtgggggagaagcagaaacccattaatcctgagctacacaaacacatttacttgcaattcagattaatttttttccagagtcatttttaaatcatttttgtgagaagtttgtgttatttgcaacttgttgaggaaacagaagagtagattgtaaccataagacactgctaagactagaacccgaactgaacactaaaataaaaatgaaatgttttaaagaaggcaaggcttaaataagcctcatgaatttttatagccctctgcattcttcccaaagcacaaactcatggttacctgaatatagggaaccagatatggttcttgagaaaccctcatggtaccattcacagcccataaagtttattttctaggactgtggtagatcttgaaatcatatttatatttggccctcaaggctatttttgttgcattatagcatataggcagcagctctgaagcttcagtaacactaagaaatttatgtgtaaatatagcagtcagggaagagaattttaaaaaaggtcattattgaagaagctgaggggacagggtagagctgctgcaatatggagatttagggtaatatggcaaggtcctgctgcttgaagcctgtgagtgggttgtggatatgggactggtggagagtgagactgttaggaaagttgtatctatgaataagggcagttgaagtagaatttttaccagtccacttgaccttcttcttccctaaccactggctcttgagccagcttgggatttccctggccattgccaatacctggccatctggcttccaatagtacagtggctactcaagttcaagcgaagaacttccagactctggtgactgttacttcccagagccaaccactagtgcatatgttagggaatctgggcttccaacatgaatggattccttaagaaaaaggaaaaaaaaaaaaaaaagaaaaaaagaaaaaaaaaagaaaaaagaaaaaaagagaaaaaagcgaaataggttatattttaaaaacaatagaaaggcaataagttgcgataagctcttactattgaccaaggttatacaggaaagagactgaagtgtacccttgaataggttttctgtagtcagagttctaaactctaatttgtaacttggactttctaattgcaaatggcaataactattaagttatcagcaataataaatttagcattaaatttgagtacaatgttttgtttttgcactccccatagtgcgtatgtattaagacagtggatagtgtttaggtcctgttaattttctttggaattcaatgtggttgtgaatcaaacttaaggaaggaacgtttaaatagcaatgagatacagaattatgggcctttggaacaagcccgacttcccctaaattctccttagtttgttaataccagtattcagattcctgattcatttatacatctgtttccatatggcagggacattatgatacttaatgaataatgctttgaggagttctgcagttaactttcaagtcttccagatgattgtcaacaacaaaaaaggcttattgaatcccatcttgctatgcaagttttatcagatgatcaaatagtagatctgatacatccccattgtatgtacgacattttcaaaccaagtcttaacttttcaaggacattttagtagctaattcaggggagggggaagaatgatgcaggtttttagattgactgactatttttgagttatggggctcattttgaaagactgctgtccagatcagcttgttgctgcagataatagaaggttcttatgaatccaagttgtatattcacttgtaggataatttaaaaattagattttttttgcatatgagcaaaaaccttttgctggatacaggagaaggttggactttatctacagttatcttttgattacagcaacagctctgggtgagagtagaatttatagagggataatttgtcaagccatagaaagaaaatctaaattaatctagtaagtgtatgacctctcaccattttaagaggtatcagattcatttgcactattaggaatgctagttttgtgcaaaaataatgccttacctgttttttccccacatttaggttgaaaagctttcaaatgttccaagttatgctgaaccaaaaaaaacaaaacaaaaacaaaacaaaaaatattaaaaaaaacccacacaaaaacaaaacacacaaaaataaaaagcccacactttttattcctgcttcgaaatgcaaatggatagagcacggtttctctgacagtataatgatagctttgtgagttagtttcatgtcatgctgggaactctctatgaggtggccataagcagcaaccagcccaaacacccacttgcgttctattagtatggaaccatttgcatttgttttttttaagctttatctttccttgtgcatcctgaccaagaaatatctttgattatgattaatgtattatgtcaaaatgtaggctagttaaacttttgtaaagttgcctggaatgtcatttgttaggttataaacacaagatctaaatgaagggttttatgtgttgtgtacaaatcttattttgaaatggacaaacttgtcattacatttgtaaccttgtacagaggatttttcactatgtgcctagcttggtgtccattcagctaaaattgaaaaaaaaaaaaaggtgcatgaagagttaaaaatcaaattaaagtatatgtagagatgactattttatattacatgacccaatcctgtatttatttctaccccctttttgaaagtatttataaaactagttgaggacagctgtatttttttgttgaactatttagtagaattgtgcctttttgtctgtatgtgaataaatgctgtacattttgcaatacattttaagtgtcttttgaaatctgcttttgctaaatatttaaaggtatatatgacttagcagtcctgaatcagttgtttactgtcttccactttaaatcaggaatgagaactgtagagaacatatcaaatttgtgcagagcacagattcactgggctgctttctggctcaactctgatggcgagactgaaaaataacggtttgagtttagtcttccccacctggagttctttccagaatacagttttggatctgaaaacagaatcgttgaaacaacgtagacttcagggtcagagagaactgtatttaaaggctaaactatagtttaccaggcacatgacattggccaagtcacttaaccgttttaagcctcagttttcccagaaagaggataacatcttagtaacttagatattgaagtagttgtgattatttaaagcaagtccattgagcaccttacagagagcatatattaggcatttagtaagtggtaggctattatttttattaggaacaagacactgatgtttacaatattttaactaatgagctttctgaggtgaaaaaatattcctgaatgatgggacggttgtatttttaatacaacctttaaataatttttaaaaataatttttcaaagagcagtttcattaaatgctttcttttgatcacagaactctgggacagtagggcaaaaaaatattatctgcattatacaccttaagacttggccaagatcacagcagtaggtactggcagaactgggcctacactctcattctcatttctgaaaagattgtttcctgcctgaaacaatcttttgtacatccactacatgcagaaattagcatatagtgaaatgcacctttttctttatgttgggaacagcaaaactggtgtgaattatgcattctcatgtagattataatgattaggatccaaaacagggtagctatcttaatctaatttataatttttgtaaggatttggccagtttaaaagaaaaaacaattattcgtacattttgctaaaagcttctcatttctccttagtgactatttacttccatattgcttgctctgagtaagacccctgagagaaacaactgattcttcctacaaggtcttaaagttgaataaccacaatagttccctagggaaattaagtccccaggagccaaaggaagggcctatcattggcagctgtgcaatctgtgatgggaaatgtcacaccagggactcacgttcatgttttcacccaaatcactgaaaaaacagtttctacctttgaagcattagccatctgcaacaaacttcacaattaacttcaaggttgaaatcttcaatatgatttccctttaatgctcagaactccattagatgatgtgttctagtctgaggtaggctttgattgtctggtcattgaaaaagaggataaaggcaaatccaatggtatctacttccttcacttcaactgttccctgtactacttactcagtttggtatttctgcaatccagcttttctggagtgtgaagagattgcttattgggcatcccctcttggatgtatacaggtacttgagattttggaactctttctatatcctgttttagagaatgtcctcctagactgaaacctgggagtcctttatgaattcttcaactctcacagccaaatagtgatcaaggcctgtgtattacatttaatattgccttaatattttttgcttcgatcccaccaccatttgctatataattcaggtctcttcattttttgcctggattactggtttccttaacacaagtcttgctgaaattaatctctccagcatttggctgaagccttgccaatggtatctccatagtgatgacttctgaaataaaagctgattttgtcattccacatagcctttgggggaacctcctgacttctgtagataattacaaaggtttatcaagtggcaggcactggtatgtattatgttaattagtttaatccttataacgtgaagtaggcactattatctccaatttacagatgaggaaactgaggcacagagaaattaagtaatttgctcaaggtcagtaggggtagatctgggattcaatcccagcctgtctgggattgagacccgtaggctgtactgcctctcagaatataaaaatagttcacacatggccgggtgcagtggctcacgcctgtaatcccagcactttgggaggtggaggtgggcagatcacgaggtcagtagttcgagaccagcctgaccaatatagtgaaaccctgtatctactaaaactacaaaaaattagccaggcgtggtggcacacgcctgtaatcctagctactcaggaggctgaggcaagagaactgcttgaacctgggaagtggaggttgcagtgagctgagattgtgccactgccctccagcctgggtgacagagtgagactcggtctcaaaaaaaaaaaaagttcacacaaagtagttagcatatttaggactacacgtgtaaacttcagttaaatgaattggtaaatttattggtaaagccaataaacttggttaaaacatgttaatgcactggttaaaagactttgagtataacctaatagataatgagcaggatagtctgcttacagtcaattagttccagccttattctagggagaatggaattaattgtcacatgcatatttatgtaacacacatacatacaaacatatttacagatcaaatatatgtatatgtaatcaaagaaaacaacactgctatcaaagaataaaaagaataactgaactctacatcctaactgcttggaaagttagttacagaaatacttaaaatcacatagtttcttgatgttgagaactaatatcttaacactaaattaaagctacgtaaaacctccaagtcggcatttttgtgatatgaagtataataaatccagttatttttacaaatgaataagcaatgcagaattaagtagcaaagataaaaataatgtgtattgtcattcctaatgtatcgccaatgtgtcctgatattctcactactacttggcttatatatggccgagttttacaaattacatttataattatgggttaatgtgattattttactcactaatctggggtgattgatagttctaacttcaggattatgaccagtgtaaaacaatttctttatgaagcaaatctttttctttggtgtttcccttcccatgcaacagtttcaaagagagcttttctcctttttcccaccaactttggctctaattcagttccatccttggagcttctcttttttatatcaaaagcttgtgatggtatctttgcctcaactagtctcaagtactctaagtaaatacctttcaaactccatactttaaaatatcacactctgaaaggaaattatgcattatatcactttacaataactaaacacaatttaacatttttttggtcgattaaaattggtgaaattgtcatcactcattgaagaaatctggaaactttcaaaagaggtattaagctaattattataacttcctttgcttagatctatttttttctactactttacttacatttagcttgtggccaatttcttttctaggtctggaaaatttaccaaatcccactagatacgaagatactttgttctagcaagtttttagggctatatacataatctgaaaaccaaaagagcttttcgggtagtgccagtcagaaagggaattaaaacaaaaagaggctcactcgggaggggggagggatagcatcaggagatataactaatgtaaatgacgagttaatgggtgcagcacaccaacacggcacatgtatacatatgtgacaaacctgcacattgtgcacatgtaccctagaacttaaagtattaaaaaaaaaaaagctcacagctcagacttgttttaaggttgatgaatgaaaaagtggaagtagaattttttgaaacctatttggcatctatatgttcaatcaagaacgctgatccttgaactgcaaggacagagtggacactggtaagatgatgagggtcacttgaagtctagaatgtgtgaagcatttacatgagagcatctagatgtttacagtgagttcaagcctcctgacccagatgaattacatcccatgacacttggagaacctataaaggttacttttgaatcactgtcagcaaatgggagaggtgtcaaaattataaattcctcaaactctaaagatacaatgttgcacaatagtacaattctggtgttgaccagatctggtccagctgtgccacctgccagctatgtgaccccgagcaaatgatttaacttttactatacctcatatctttggaaaggaaataacacctacctagaagggctgtcgaactatatgaggtaataaatgcaaaatgttagcatgatgcacagcacatgacagatgctccacaaacagacattattaatacacataagcatgttaccataatccagagaaactctccactggattgttttagttatttgaagaaatatgcttataacttctcttattctcttttatcccatagagtagtttaaatgaaaggagatctagtctcacttttaatcttcctagatgtaaatattaaagatttccttatattttatattatgctctgataactttttcattcactgaaaaaaggactgtgctgccatagaatgaaaacattgaacgaaaacttccataatgccttatcaaaggaattaaagagttttaacaaacataaaaggaacatgctgtgattactaggatgccacatggatttactaagaaggctaacttacttttcattttggacaggattactagattacatctggaaaatatgactagtatggcataaatgaatttttgcttggcagaaggctggatttttcttgatgttgttatgctagtgtacaagtagcagtatgggccagattaaaaacgggttgaattaccacatctgacatgtgctgatcagttttatccattaagggagttggtgcttggtatgctctaagactgtctatatttcaatctgtctggtcctcttctttttttcaatggttcgaatgaaaatatgggtagcatgtttatctgatgtgtggctagcattcattgtaaatcaaaaattgcctgtggtgcaataaatatggcagtaaataaagacagacatggcccctatcatacctttagagctatcaaatgaggtaacagaattaggagctaaaatgacctcagcaggttataataatgtaattaaatttaatagggataaataactagtcctgcatttgggcaaagatctggcttagaaacaaaacctttgaaaaagacttaggattttagttgataacacgctcaatatctgtccaacagtgtgattcaactttccctccaaaaaagctaacataattttaagctgcattaatggaagtgtaaactatagaatagtaattcacattttttcctcatcctaaaccctgaaaaatattatatatgtacatttcaatgaatcactaactacagtgaccctcgaagcatgatttcctaagaaagtatgtttcgcaatcttcttggggtggggaaaagagaaagggtacatagtttgaagccgtatctattctctggagatctaataagttgtctgcttacacataggcaagtatcacacatggggggcacctatgagaacgtggggcacatgtgagtgttttgtggtgaattcttgagctagagggtaccagtgttgtaaaaaatttcttttcagatgcctttctgtcctatgacttttattatctaagcatatttttcttcgttatataaatattattaacattgtccccaaagccatatatttttctaaggtttaagggatggtaagggacaggtttttatctgtaacttcagggtactgcaatctctctgtctacatgttgtttatgtgtatgtatgtatgttttaggtaaactagacaaacttaattatttttgataaaaatttttgcaaaaaagctcattacaaatttattttgaaaaaaatgataaaagacattatggttaaagaacagcatttatagtaaaatgtttaaagtgttttttcactctttcttgatttgagagttggtttggcaagactgtgtaactatgaaatatttaatatttgcagacttaatgagtgactgaattgttgctaatgttttccaatgtttggggtggttataattctcacaccagagaagaaattagaagattgttgcctgccctagtttgcatatttgtatacaaagggaagaagaggtaatcatatctcctttcttcttcagggagaaacaataaagaaacatgaataaataaaatgaactagctgtgttgtcctcaattgcagatctatatcatttcttacctctctttcctactcatttctcctgtatagtaaaatacagttcacagaatgatactatttgtatcatttataagtgaagactgacctgtatgagaagtgttaaaaactccactacatttttacattggaaattattaacaaacttttctgaaaagaaaaaaaccatcaagtttagttctgttgctaaacatagcttaagcctgttcaaattcaacagaggtcagaaaggcatattatctgcatattagcagcctattcttctcttggagaatatctaagtacgcaaggagatccaagagaagatgggttatcaggatgtgaagagtagttacctgtggccaaagtttggagaaagtatctatgttcagagattttaccttgaaaaaatgtgtctggaaagttagatttttttgaaaaagtataataatataatacttatattccatttgctagagtgttagtttctgaagtgctttcttctacagtctcatacttttgtcagacataaaattctaacatccctaaaatttttaaaaaacaaattctatgttctataaatatgaatatgaacataactcttactacatggaaattagtctgtgaatgacctgggaaggaatttaaagaatcaaatgaaaaattctttaagaaatgaaaataagctatgtgcctcccatctgattaccatttaactgccatataggtatgatttggtctcatcatcgcatttgatactatcaaccatgtgccttccttgagtgttttatcatgttggagtctctttgttatgaccctctcatttctcctatttagtctcctttaatgacatctttgtgagttcattcaacaaataaagacattccttaaggtcctgttcttaaaaactcagtttttgaaaaaggagttattgaataccctccaagtgccagggactatattgggtgctagggataaaatgaatgacagtacatgtggtcttagagagcttgtactctgttggggggaagatgacattaaagaaaatattccaaaaagaaagagttaactacaaattttgacaagtgctatgaagggaaactacggtgcactattaagagcaatataagaaggggatcttactgaggctagggaaggcctctgaggaactgatatttgagtagagatctgaaaagtgtatagataaaaaagtccatgcagatgccagacacggtggctcaggcctgtaatcccagcacttcgggaggccgaggcgggcagatcacctgaggtcagaagttcgagaccagcctcaccaagatggtgaaaccccatctctattaaaaatagaaaaattagtgggtgtggtggcgggtgcctgtaatcccagctacttgggaggctgaggcaggagaatcgcttgaacctgggaggcagaggttgcagtgagccgagatcatgcctctgtactccagcctggtgatggagtgagactctctcaacaacaacaacaacaaaaaaaaaaaaaaaaaaaaagtacatgcagagagaccctgtattgggagggaggattatatattgacagaagtaaaagaaggccatccaagtcagagcataagaaatggaggggaagaatagtgtgggaggaagctgaagagattgctattcacatcatggaaggccccaagggaagctcttccacttccacagcttcaattctcagctccacgcagaagactcctatcacacacccgggcctgtcgaggggtgaaagggtaggggagggacagcattaggagaaatacctaacgtagataacgggttgatgggtgcagcaaaccactatggcacaggtatacctatgtaacaaacctgcatgttctgcacatttaccctagaacttaaaatatgataataataataaaaaaagattcctatgactatcttaactgttagcaccattactaaatttctgactgatggctgaatatctacacgtgaatgttttcatgtcaccttcaactcaaactcattatcttttatctggacaactgcagcagtctcctaattggttatccagatgcaaacctctctgctttaatcaacagaaaccagggtgcgctaagttcaaaccagagaataggaacatgtatctatgaagatcaataggacttcaatagttcaatgccatgcagtcttagcacctaagatctccatttgattagtattgctttaagtaacatgtaaaagacaccttccaaattcttaaatatcaagttccataaatactgaaaaccgtaagttaaaaatgaagcactacaatcatacattaaaatacatgacagcatcattttagaaagtgcacaatttattacatttatgagttcataataaaatggatacttaggaactttaaaaatgagttagaagtaacaattagatgtaaaattctcaaatcttggaaactgaaatattaaattctagaattttcttaaaaactctttcttatgaaagagaaatttgcatagtttgaaaattattatgtcctttcaagggaaaaaggaggaattaaaaaacagacacattgatgaaggcaatgagttcttctcagctggtttattctccactgaagctcaatataggattatattttctttacttacaggaagtggtcactgctctgttttccaataaccctcaaaacagaacaacaatgcttacgcgaaataacacaagccttaactattatactttgcaggctttaccatttcaatacacttctagtccaactgctttcccaactctaaagttctgtgagtgaactatgaatatttttaaatattttccagattcatcagggaggctgcttttcttctctgcactgtaatcacactgagctgcaattaaaataaacaatcggtaagtagttactttttctgtggaaaatcttagattaatacaaagaagaatgcatcacaacctataagtactgaaatggtcttattggaaagggttttgtaaatgatctttttctttttgaggcaatcttgctctgttgcccaggctggagtacagtggtacaatcacagctcaatgtagccttgacctcccaggatcaagtgatccttctacttcagcctcttcagtagccactacacctggttaattttaatttttaatttttttcagagacagggtctcactacgttgcccagaccagccttgaactcttgggctcaagcaatccacccaccttggtctcaaagtactgggattataggtgtaagccactgtgcccagtcagtgatcattttaaaattaatttctattttactcttgaaactttaaaatgtctattaatttagagaaatgcaggtcaaataagacattctatagctcagggtgatacgcttagaattgtaaaacatattccagatggatgaaaaacatctacataaaagttaatcaggaaagtttctaaaacacaaactaatgtaagccaacacaatgcaaggctgataataaagtgatgatagattataacaagtctaatagaaaaataatctttaaatgttagtaggaattaataacatatacacatagtaaaaaaagatctaacagtacaaaacggtagacagcataaaggaagtctcgttcccattgctgtctttcattccatagacccctctccagatacaaccactatttccagttttaaagtatgtttccgtaaatattttaaatgagaatatatgtatttcttcattcctttaatttaaaaaatgatgaaagtattataaacacttttcatcttgtgtttttcttctaaataatctaccttagaaatagctctatattaggcctactatactttattcctcttaatagctgcaaactgttcctctgtgtgaatactccatataaccagtctgctattgttgggtatttgtatggtttttaatcttttaaaaggagagacaatgcttcaatcagtatttttatatgtttgcttcctggcaaaaatgtttccaggtgcaagtgtgggtcaaaggttatatacatttacagtttttgaaagatactgccaaactgtgctccggagactgtaccaacatgtgcttatatcaataatatgtgaaagtgccagcacaatgcatttccaaacttcatgatctgataggtaaaaaatgatgtgattacagtttaaatttgtatttgtcttataggtgaggatgaacatctttttaaatgtttaaaagccatctgtccttctttctccataaacttcctttatatatttgtctaccggactgtggcattttttgaaaacttaggtatcctttatatgtgtttagggcattagccttttgtcatatatggtacaaatatttttctcggtttgtcactgactttatgactttttctgatacagaaatttgaaactgtgattatatttattaatttttttcttagcttctaggttttgtgttcttgcattgaaaggcttcaccacgctgatttaaaaaactcatatgttaacagaacacagtatggcattcaactatttagagtgatacacttagaatggatgaataacgtgtagagaaagttaatcagaaaagcacatttagagcacagtgcatcagcacgattcagggcttgtattgaaccagtaacacgatgctgcactgcactatggtaagtgtgatgtgtcagagatgataataatttttaaattttcttcattttgttaatatgcatttagtaggatattatttctaatagcactttttcagtttttataggaaaattagaagattcagagagggtaaagataaaaattaaaaaaataaaatgtacgtcttacaaacaaagttgatcacttggactcatttaaaacagaaaaaatattaactccagggaagaaattcctttttgggtaagggaaaagtgctgaataattaccttccatcttcaaataagaacagaatggaaggagaaaagcttagggaaagatttgttacagaacaattcgtgaagtggttactgacaaaacattttaaaaaggttagtcaaaagaacggtggaatctttgccattggagagtttaaacaacagaagaaacatcagtactagactgtttaggtttaattttttcaggggagaaactaaactagatgctaactggttatataattaatgtcctgtaatcgttccctttttactatagaactcaaggtagttgattttcgtagacgttttctttgccatttgccttaaaaaaggtaaacgtgaagctttaaggattatgatacagaaatttaatttcttacatatctgtctaaatatctacttaccactataggaaatgctttacatgtgttaattcttttgatcctttaataaccgtatgagggaggtattattatcctatattaaacatgaggaaactgaggcttagagaagttgaaattgcccaaagtcacaagcttttacttaatggcactaaatggcactaagcgatttgcctgacaccaaaacacatacttgccagatactgtccagtgcacctaacttctgttaccttataacctaaatacattcttgcataattagctaacccattagttaattcataacttcataagacataaaaattatttgaaaaggctgtaattactttcaagagggagagtaacagaaggataaattattattaaattttctttaagtggcatgccatgttcataacagaagtagattcaaaaaaatctgtaaatatcatgaacataaactgaattcagcaagcagagtggctttactatgtataaaatgctgtaatagttaagaataatattaattttgattgaaataatacatttataagcaaatataattaataatatagtaatttgatttgtttttgttttctcgcctcccctatctatctatccatttcaactgtctgtgtctagtctataatcactgaactggtctcattttgttcctcatatgagggactattgctcctactttacaatcaagggcctacttcatttatatgatgtgtgtgtattaagagaaattatcccttagtatttcattgttattctgcattttctactctatttcccactggacaacttttatattgtattttagatttttttggtcatatgaaaatatgcattaagtaaattaacttgtaagccaaggaatttttttccactgataagtaaaataaaaacaaagttagtgaaatttgaaatattacattcaaagcaatattatctactttcaaatctgttagtgaatctctgcctggttttagataggacataattctagagcagtgttgtgtaacagaactttttgttatgacagaaatgttccacatctatgctgtccaatgtgatagccctagctacatacagctattgagcacttgaaatctgactagtatgatggatgatttcaattttaaatttaatttaatttaaattaatttaaatataaatagtggcctgtggctagaggctatgattgttagacagtatatgtcttttctgttttttttttttttgttgatacagagtgagggtctcactctgtccgccaggctggagtgcagtagcacaaacgtggctcactgcagcttcgacttcttgggcccacgccatcctcctgcctcagccttcccagtagttggaaacagagatatgcgccactatatttggctaatttttaaaattttttgtagagaaaaggtattgccatgttttgcaggatggtcttgaactcctggcctcaagtgatcctcctgcctaggcctcccaaattgctggcattacagttgcgagccaccacgcatagcttatttttgtttccaatgtttactttttcaacctcacatattaaagggattaattttaaaatatgttaatctagtaaaaataaactattaagttccctgggaacttctaaaaaacttatctttgaactgtttattatctagggataagaggatgctccctacctgctgggaagctgaagcagctctctcttctgcctgacttagacgcctttgaagtctgttggctttttcttgatgctctagaattagcttttcattctattaaggggaaatagaaaacaagttagaaatccatatgtgacatggagatgttttgtggaataatcaacgaaaaatctggacatcactttaccacttataaaatacaaagaatattatctccaaatttacatttttcaagttatgagctttaaaatacaaactttgttttacattcttaataaattgttttctttctcccacatgccagcaaagaaagtgaattaacaaatctcaaagcaaaatgactcggaagaataagactttcaatttgtgaaggtcactgcttcagaatcacctggactgtgaaaacacagactgctgggccttacaaccagagctttagtaggggtgggatgaactgtttctgtatgttccccaagacatctgcatactccagagtctattagggtcaaaagagctattaggcactgttaggggttgaattgtgtcctaacccccagtatctgggaatgtgaccttatttggaaagagagtccttgctgatgatcaagttgagatgagatcattagggtggaccataatccatatgactggtgtcttcataaaaggggaaatttggacacagagacacacatgtacaaaggaaagacaagttgaagacacagagagaacacaatctacaagccaaagaatgtctgaggctaccagaagctgggagaaaggcatggaacagattctccctcacagctctcagaaggaactaacaatgtcaatacctcaattttggacttctagcctctggaactaagagacaattattttgcgttgtttaagccacccagtttctaatactttgttatggcaagaactatacaggcatcatgaatacaaagctgtcacaacatactgtcagacagacaagtgcaaataatctatcaattaaaaaatggaaattaaaaaatggattagctctctccacacttactagcctggttatagtacatctgaaaaaaatatttttgtacaactagaattgttaaacagtttttctggcacttatctgaatgagataataatacaagcctaatcaggaagagttagaaaaacacattttctatgaagaaccagaaacttatagttcccatgtcctaacatacaagtgataagaatgaatgttatggctattacagtaatataaaatattgaaataacagtatcctgctaaaatgagcttattatatttcttattatgcccaaaagcaaaattaaatgttatgaagagaactatattggctggtccaatttaccaagatgtttaaatatgtagcctctaaattttaagaagcacatcatatgctagagaaaacgggggaaaaaattccatcatctgtaataatcattttcatatttatacgcagacttcatataatgcaacttcttctatactgctaccataatggttgaggaacagttcagattggataaatcctagtatatgcaactgttccttttctattcatcattttggttgcttttgatcttcctatattattaacattactgtactgagtaccttctttcaaattttttttgtattttaaattactcattagaatagatatctggaaatgggagctacctgaaagattatttcaatggctattcctcaattaacttctaaatggctcatatcaattcataatgccatgatgcttaggagtaacgatttcactatagctactacagtagaccacaaagatggagtagaccatatattcagagaaattccaacaaacatttgaagttagaacatcaaatgaagagatctaaaaagcctcaatcataatccaaaaattgtttactttttgaatgcctcaaggaaaaaaacttgaactcttgctatatttagttctaaggcataaatctaaatatattttaatatattccagtaggcaaaagtattttttatgtgatgtgtcttttgggatggattaaaatgaaaaaagatgaatgggttaaaaaataattttagagatgcataagaataaaggggatcctaatacgttctctgaaatactacacaagttctattggtaaaacagaaataagagctctaccttttattatttacatatgatgaatcactgatgttcaaagcttttattcacattatattgcgtgtgggcttttagggttatggatgatttctgtattgttatttccaagtagagaaataatttggatttggctcaggtaaaattctataacatgtgtatcatgctgcagcagaaagcacttcccaggggagtcattatctcacctcagctaccttttcatttgccatttccagctgagaaagcagctcttgggtatgaagtttctgtcgactcagctcactcctattaagagcaccaaaaaatccattaatataattgttccaaatagaaaacagaatctttattagcaagatacatgttcatgatttgaacaaaaatatcatcttgaggtggaaaataaagtcacttactaatagaccatatctcaaggacttgtttatttctttttaacaaaacacacatatactctagagattagttgcacaacaatgtgtatacatgtaacactattggattgtacacttaaaaatagttaaggtggtaagttttatgtgtattttatcataatttaaaaaattttatcacaattaaaatggtaaattttatgtatattttgccaaactaaaaaaagcaaaataaaaatacatattttaaaagtacaaaagtatcttcaacattattttgagatactattagacactaaaataaaagcatactcatattaaaaagatacagtatttattattacaaaatcttgtaagctactgtgcttcttagctataatatgctttttttttttttttttttgagatggagtctcattctgtagcccaaactgaagtgcagtggcatgatcttggctcactgcaacctctgcctcccagggtcaagtgattctcatgcctcaacctcccgagtagctgggactacaggcttgcaccaccacgcctggataattttttgtattttagtagagacggggtttcaccatgttgccaaggttggtcttgaactcctcagctcaagcaatccaccctcctcggcctcccaaagtgctgggattataggcatgagccactgtgcctggccttagtatgcatttgtaagattcatatacagtgctttttaggggagctcaactcttagaaatttaaggaaacattaattactccagtatcacttcagtgcagtatagttagaattcttatttatgttttggttgtaaatgtactgtgttttactcattcatatcatttatgcttcattagctgaaattatcttacgcacagaactgtcttcttcttcttgttcaacgtataagtattctattgcttttagccaaatgtcacttcaagagtttcaggttaagggtacatacaatgtagccttaaaagtaatctgaacaaatatcagataaatttgtgagtattacatataaggaatcaatgacattcaaagcttttcttcacatcacactgtgtgtgaacttttagggttatgatgattatggatgatttctgtatcattatttccaagtagagaattaatttggatttggcttaggtgaaatccttgattcagtattggcttttatcctttgaccttacttgtgcttcttaaatcaatcaacagattagcacttccaaaataacttcagctttgatttttttcaaatgagccagcaaacagcctaaaaacttggtaagcctctcaagtatcctatagttgagtgaatagttgctaaaaataacaagtaatttgttataaatatataaaacagaaagcaatgtcatccactattcaattatacaaatagttactgaacattcgttacaggccaggtgcaaggtatgtggtggcaaacataattgttgtcatcacagaactgacagactacgagggagatcagttattctaacttagtgatttcataaacacaggttcattgactatgaggagtttgggtatctatcattaattccatgacagacaaaccaaaatatattgttttagctttgagtgataatgacaaaatagaataaattattatgcttactttaatgtatcttgtgcagcttaaaattactgcccaaccatccccccgacaacataagaaaaaaaacaactaaagaatgataaacaaaatgactagtggtcagtcttctaggtcaaatgtaattacaggtaaaagttacgcatattagtgctgatgaaaaataaattgtgagtataattgagattaagaagaaacgatgaacacatttataaagttagccaacattcagtttacacaaaaccttttcaggaaaacacctactggtataatttcatgcctaaactattattcacttacttactcaagacaatcttaatgatggatagtaatgattttccacaatatttaagatcacaaagacacaaatcattaaatgaaaatatactttgttacccttaatctatgtaaatatttatctctttatatatcaagctctgtctcccccattggatagtgagcaacttcattattcatctttgtactcaacaaagcttggcaaataatagtgaaaatgatgtgatgatgataataagagcaaacatttccatagtatttgcttacaatgtgccaggcactgttctaggtgctttcataaattaatttaatatttagtttgcatgactaatatataaaatctccatttttttttgagatggagtcttgctctgtcccccaggctggagtgcagtggtgccatctcggctcactgcaagctctgcctcccaggctcatgccattctcctgcctcagcctcccaagtagctgggactacaggcgcccgccaccacgcccagctaatttttgtatttttagtagagatgaggtttcaccatattagccaggatggtctcaatctcctgacctcgtgagccgccctcctcggcctcccaaagtgttgggattacaggcgtgagccactgtgcccagccccgaaatcccaatttttacatatgagaaaattaaaaaacagaaattaaaaaaataagtaacttgcctagggtcacatagcctgtcaggttttttgtttgtttgtttgtttgttttttgagagagggtctcactctgtcacccaggccagagtgcagtggcacaatcacggctcactgcagcctgcacctcccaggctcaggtggtcctcttgcctcagcctcctgagtagctgagccttcaggtgcatgccatcatgcccggctagtttttttgtattttttgtagagatagggttttaccatattgcccaggttgatctagaactcctgggctcaagcagtcctcccaccttggcctcctgaagtgttgggattacaggtgtgagccactgcatctggctgcttgtcagttgtacagtcaaggttaaaaaaacttggtcctttgattccaaagtccgtgctcttaaccactgccctatactgcaacatggcaggcaaataatgaaagttcattgagtaagtaacacacacacacacacacacacacacacacacacacacacacacacacacagagtatatgtgtgtgtgtatgtgtattaggccttctaggaatatgaaaatttatatacttacttggaaagctagcaattaaatttttacttcagacttcttccctaaaagtccagtcttaaattcaaacttaacaagcctaatatcaagctttttgcattgtcccacaaatctacttctcatcctgctcctcagtttatactgacatctcagccctaggtgtctaggttaaaaagcttaaagtcaactcctatttctcactttgtctttcttttttttttgtgagatggagtctcactgtgtctccccggcttgagtgcagtggcgtgatctcggctcactgcaacctccgcctcccgcttcaagtgattctcctgccccagcctccccagtagctgggattacaggcacccaccaccatgcccaactaatttttgtatttttagtagagatggggtatcaccatgttggccaggctggtatcaaactcctgacctcaggtgatccaccctccttggcctcctaaagtgctgggattacaggcatgagccaccgtgcccagcttctcactgtcttaaatgcaacatctcatttaccctgaaagagactctctctttgatacgtctcttgcatctatttttcattcctattcagtgttaccatcccaattcaagtccttagaacttaattcttagagttattgtaataacgagctgcttgggtttctcaatatcaggtgaaacaatatatgtaaagcactctaccacagggcaaatgaatgtactcaactaatatagtgggtttccctctctaaaccatgtatctctagcatatttctctttccaaaacaccactttaataatttgcttctttgagtgataatcttcaatggctctcagctattggacaaaatagtccaaattcctgagaatgtcataagatcctccaaaattttgtgtaatttatctttccaaccttatccccaaaaggaaccttccacacttcagttgggctctcactgtctcgaaaacaaactgcatatgtattacctcaggatcaggtttatattattttttagattgtgtttttcggatttcccattacaattctgcccattctttaagactgcacccttggtggggtgaagccaagatggctgaataggaacagctccagtctacagctcccagcatgagcaacgcagaagatgggtgatttctgcatttccaactgaggtaccgggttcatctcactggggagtgtcagaaagcgggtgcaggacagtgggtgcagcgcacctagcatgagccgaagcagggcgaggcattgcctcacctgggaagtgcaaggggtcagggaattccctttcctagtcaaagaaaggggtgacagacggcacctggaaaatcgggtcactcccacccttaatactgcgcttttccaacagtcttagcaaacggcacaccaggagattatatcctctgcctggcttgaagggtcctatgcccacggagcctcgctcattgctagcacagcagtctgagatcaaactgcaaggcggcagcgaggctgggggaggggcacccgccattgccaaagcttgagtaggtaaacaaagtggccaggaagctcaaactgggtggagcccactgcagctcaaggaggcctgcctgcctctgtaggctccacctctgggggcagggcattgccaaacaaaaggcagcagaatcctttgcagacttaaatgtccctgtctgacagctttgaagagagtagtggttctcccagcacgcagctggagatctgagaacagacagactgcctcctcaagtgggtccctgacccccaagtagcctaactgggaggtaccccccagtaccgggtactggctgggtgctcctctgagacaaaatttccagaggaacgaacaggcagcaacatttgctgttcaccaacatccactgttctgcagcctctgctgctgatacccaggcaaacagggtctggagtggacctccagcaaactccaacagacctgcagctgagggtcctgactgtcagaaggaaaactaacaaacagaaaggacatccacaccaaaaccccatctgcacgttatcatcatcaaagagcaaaagtagataaaaccacaaagatggggaaaaaacagagcagaaaaactggaaactctaaaaatcagagtgcctcttctcctccaaaggaacgcagctcctcaccagcaatggaacaaagctggacggagaatgactttgacgagttgagagaagaaggcttcagacgatcaaactactcccagctaaagtaggaagtttgaacccatggcaaagaagttaaaaaccctgaaaaaaaattagacaaatggctaactagaataacgaatgcagagaagtccttaaaggacctgatggagctgaaagccaaggctcgagaactacctgacgaatgcacaagcctcagtagccgattcgatcaactggaagaaagggtatcagtgatggaagatcaaatgaatgaaatgaagtgagaagagaagtttagagaaaaaagaataaaaagaaacgaacaaagcctccaagaaatatgggactatgtgaaaagaccaactctcgtctgattggtgtacctgaaagtgacggggagaatggaaccaagttggaaaacactctgcaggatattatccaggagaacttccccaatctagcaaggcaggccaacgttcatattcaggaaatacagagaatgccacaaagatactcctcaagaacagcaactccaagacacataattgtcagattcaccaaagttgaaatgaaggaaaaaatgttaagggcagccagagagaaagatcgggttacccacaaagggaagcccatcagactaacagctgatctctcggcagaaactctacaagccagaagagagtgggggccaatattcaatattcttaaagaaaagaattttcaacccagaatttcatatccagccaaactaagcttcataagtgaaggagaaataaaatcctttacagacaagcaaatgctgagagattttgtcaccaccaggcctgcctaaaagagctcctgaaggaagcactaaacatggaaaggaacaaccggtaccagccgctgcaaaaacatgccaaattgtaaagaccatcgaggctaggaaaaaactgcatcaactaacgagcaaaatcaccagctaacatcataatgacaggatcaaattcacacataacaatattaatcttaaatgtaaatgcgctaaatgctccaattaaaagacacaggctggcaaattggataaagagtcaagacacatcagtgtgctgtattcaggaaacccatctcacctgcagagacacacataggctcaaaataaagggatggaggaagatctaccaagcaaatggaaaacacaaaaaggcaggggttgcaatcctagtctctgataaaacagactttaaaacaacaaagatcaaaagagacaaagaaggccattacataatggtaaagggatcaactcaacaagaagagctaactatcttaaatatatatgcacccaatacaggagcacccagattcataaagcaagtccttagagacctacaaagagacttagactcccgcacaataataatgggagactttaacaccccactgtcaacattagacagatcaacgagacagaaagttaacaaggatatccaggaattgaactcagctccataccaagcagacctaatagacatctacacaactctccaccccaaatcaacagaatatacattcttctcagcaccacactgcacttattccaaaattgaccacatagttggaagtaaagcactcctcagcaaatgtaaaagagcagaaattataacaaactgtctctcagaccacagtgcaatcaaactagagctcacgattaagaaactcactcaaaaccgctcaactacatggaaactgaacaacctgctcctgaatgactactgggtacataacaaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatcgaaaattgacaccctaacatcacaattaaaagaactagagaagcaagagcaaacacattcaaaagctagcagatggcaagaaataactaagatcagagcagaagtgaaggaaatagagacacaaaaatcccttcaaaaaatcaatgaatccgggagctggttttttgaaaagatcaacaaaattgatagaccgctagcaagactaatgaagaagaaaacagagaagaatcaaatagacgcaataaaaaatgataaaggggatatcaccaccaatctcacagaaatacaaactaccatcagagaatactataaacacctctacgcaaataaactagaaaatctagaagaaatggataaattccttgacacatacaccctctgaagactaaaccaggaagaagctgattctctgaatagaccaataacaggctctgaaattgaggcaataattcatagtttaccaaccaaaaaaagtccaggaccagatggattcacagccgaattctaccagaggtacaaggaggagctggtaccattccttctgaaactatcccaatcaatagaaaaagagggagtgctccctaactcattttatgaggccagcatcatcctgataccaaagcctggcagagacacaacaaaaaaagagaattttagaccaatatccctgatgaacatcgatgcaaaaatcctcaataaaatactggcaaaccgaatccagcagcacatcaaaaagcttatccaccatgatcaagtgggcttcatccctgggatgccaggctggttcaacatatgcaaatcgataaacataatccagcatataaacagaaccaatgacaaaaaccataagattatctcaatagatgcagaaaaggcctttgacaaaattcaacaaccattcatgctaaaaactctcaataaattaggtattaatgggacgtatctcaaaataataagagctatctatgacaaacccacagccaatatcatactgaatgggcaaaaactggaagcattccctttgaaaactggcacaagacagggatgtcctctctcaccactcctattcaacatagtgttggaagttctggccagggcaatcaggcaggagaaggaaataaagggtattcaattaggaaaagaggaagtcaaattgtccctgtttgaagatgacatgattgtatatctagaaaaccccactgtctcagcccaaaatctccttaagctgataggcaacttcagcaaagtctcaggatacaaaatcaatgtgcaaaaatcacaagaattcttatacaccaataacagacaaacagagagccaaatcatgagtgaactcccattcacaattgcttcaaagagaataaaatacctaggaatccaacttataagggatgtgaaggacctcttcaaggagaactacaaaccagtgctcaaggaaataaaagaggatacaaacaaatggaagaacattccacacgcatgggtaggaagaatcgataccatgaaaatggccatactgcccaaggtaatttatagattcaatgccatccccatcaagctaccaatgactttcttcacagaattggaaaaaactacttgaaagttcatatggaaccaaaaaaagagcctgcatcgccaagtcaatcctaagccaaaagaacaaagctggaggcatcatgctacttgacttcaaactatactacaaggctacagtaaccaaaacagcatggtactggtaccaaaacagagatacagaccaatggaacagaacacagccctcagaaataatgccacatatctacaaccatctggtctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaatgttagacctaaaactataaaaaccctagaagaaaacctaggcaataccattgaggacataggcatgggcaaggacttcatgtctaaaacaccaaatgcaatggcaacaaaagccaaaattgacaaatgggatctaattaaactaaagagcttctgcacagcaaaagaaactaccctcagagtgaacaggcaacctacagaacaggagaaaatttttgcaatctactcatctgacaaagggctaatatccagaatctacaatgaactcaaacaaatttacaagaaaaaaacaaccccatcaaaaagtgggtgaaggacatgaacagacacttctcaaaagaagacatttatgcagccaaaagacacatgaaaaaatgctcatcatcactggccatcagagaaatgcaaatcaaaaccacaatgagataccatctcacacccgttagaatggcaatcattaaaaagtcaggaaacaacaggtgctggagaggatgtggagaaataggtacacttttacaccattgggactgttaactagttcaaccattgtggaagtcagtgaggcaattcctcagggatctagaactggaaataccatttgacccagccatcccattactgggtatatacccaaaggattataaatcatgctgctataaagacacatgcacacatatgtttattgtggcactattcacaatagcaaagacctggagccaacccaaatgtgcaacaatgatagactggattaagaaaatgtggcacatatacaccatggaatactatggagccataaaaaaggatgagttcatgtcctttgtagggacatggatgaagctggaaaccatcattctcagcaaactatcgcaaggacaaaaaaccaaacaccgcatgttctcactcttgggtgggaattgaacaatgagaacacagggacacaggaaggggaacatcacacaccagggcctattgtggggtggtggggggggggagggatagcatttggagatatacctaatgttaaatgatgagttactgggtgcagcacaccaacatggcacatgtatacatatgtaactaacctgcacgttgtacacatgtaccctaaaacttaaagtataataaaaaaaaaattaaaaaaaaagactgcacccttgtcccccttcttttcaggtctcctttccattcattttaatccagacagctttctttacacatcaaatctctatgatattaaatacttattttatgtataagagatttatcaatcctgtattataatgctagtattttacatatatgtatagatatgcacatatatgtacacacacatacatacacacattcttctaagtggaataggaacttttttttgtttttgttttgagatgggggtcttgctctattgcccaggctggagtgcagtggtacaatcatggctcactgcagccttgaccttctaggctcaagtgatcctcccacctcagcctcccaagcagctggcttggctaatcttgcctggctaatcttgtgttttgtagagatgatgtctcattatgttgtccaggttggtctcaaactcctgggctcaagcaagcctcccacctcggcttcccaaagtgctgggattatagttgtgagccaccgtacccaggagaaacttttaaaagaaggattatttttagtttccacagtatctaccacgctgctttacaaatccaaatggagtcatgcatcagttaataataggaatacattctgagaaatttatcattaattttattgttgtatgaacaccacagagtttgctacacaaacctagatggtaacgtctactacacacctaggcaaaatattaatagtatagcctactgctcctaggctacaaacctgtacagcatgttactgtagtgaagactgtaaacaattttaacattgtaagttttcgtgtatctacacatagaaaaggtacagtaaaaatactgtataaaagataaaaaatggtacatctgtatagggtacttgccataaatggagcctgcaggactggaagttgctatgggtgagtcagtgagtgagtggagaatgaatgggaaggcctaggacattactttacacttctgtagactttacaaacactgtatactgaagctacactaaatttataaaaacatattttttcttcaacactaaccttagcctactgtaactttttactttataaaatttttaattttttaacttttgactctaaaacacaaatgtacagctgtacaaaaatattttttctctatatccttattctttgagttttttgttaaaaacaaagacaccaacatatacattagacaacgcctacacagggtcaggattatcaatatcagtgtcttccacctgtacatcttgtcccactggaaggtcttcaggagtaataacacacatggcactgtcacctcctttgatagcaacgcctccctctggaatatagctcttgaaggacttgcctaaggctgttttacagttaacttaaaaaaaaaaacatgtaggagtatgctctaagataacaataaaaagtacagtataggaaacacataaaccagtaacactgctgttgattttcaagtattatgtactatacataattgcatatgctatacttttataagactggcagtgcagtcgttttgtttagcatcaccataaacacctgagtaatgcattgcactaagacattataacagctatgacgtcactacgcaacaggaatttttcatctactttataatcttatcagaacactattatatatgtggtccatcgttgaccaaaatgttatgtggtacattaccatatttgctgatttatggctaaatttctaattttctaaaattagaaaagttctaattttctaaattatagaaaacatagtagttagaaaattttaatccttatttgctcaagatttactgaggaatttatcagaaaaaccatattttagataaaaactattggtatttatttagacttatttatattcttctttctccaaagaaattgaagtggctaagaaaagcttatttttcattcaagcatttctttcaaccttacagttttcttccaaatgaaattttagaaggtattaaagggtgaagagaaaagtgatttcacaaactctatcccctgagactttcctagagccttcctgtcagtactttgtatcttcttatttctctgtcaggatgtttcattgcagggataaaggaaagacccgggaggatgattcgactctttgttatctacaagacattttcccttcattagagaaaataattgagagttccctgtatcatgaatgatttaggataaacattaaataagactttccagaaagtttcacagtggtattacagttgaaacacatgcccagtaagactatataatctcttccctggaaatctttaagaacagaaacattcatacctatcagagatgatttaagtgtagcttgccggaagacacagagatagaggaaatttcattctggtatgatattttaaagagtattttgcaccaagtaattgaaataaaactgtacccaatttctctataatttctggcttattatagggtataaggatcaaggtgtaattactatcttccactaattttaaagtacatatagaagaatgaggaatcccttatagtatcactgggaagtgcttagttcatcagtgtctcatacgtttttagttcacttatataattcatgtttatgtgacagaaaatcttactcatccttacaaaacataatttagaaatatacttgcaaaatgtaatttctgtgtaagtaaaagtttactaagtaatttacatatgaagcaatttatgttgtatgtattaaaaaattaaatgcttaaataaacaaaatactgtaatcaacactgatatgccatcagattagaccattgttggaagatctttcagcccttccctctcttctcctgagtgcccactgtttgttgttcccatctttatgtccacgttgtaccagtcttttaatcaaaatgttttctcaactaaatcatattgtttcccacttaagtccaatcaattacgagagatgttagtaaagcaaatctgtaatatcatataatattaagatctaaaaggcaaaataaatattttctgaacaaaatatttaatcctagtatgtggcaaaatggttagcaaatgcaaagattgtaatctcaactttttgtatggcttcaaaagacctgactgctaaaaaagaaaattcattccaaagtttcaaatcttttctcattgttaactaaaaataccatgggttaaggcaggcgggtcagcgttagatatactggagaactttgggtcagtgttaggttctttctttccctatttacactttccccctaagtgatcttgtctagtccatgactgtaaatataacattacaaatttctatctttagcctgacctctctgtgctcttcacttgtgtattcaatgacctacttgacacgtttactagaaaaaaactaataagcatctcaaatgtaacctgtccaaaatggaaactacttcttatctatctcttcctaagttcccttcttcctagtaaataagcattgccatctacctggctgctcaagtcaaaagcttaggcatcatctttgattcctcctttttccttcatgccctatatttatcagtaagttctattctaccttccaaatgtatttcaaaactgcccacttctctccatctccactgaagataaccctattctaagccactatcatctattgccaaaactactgtaaaactctaatatctggtttctctgattccatttttgctccctctctagtctattttccatacagtagttataagtggtctttaaactctaaggatgtttcaaattctccagtgatttcccactgctgcactttagacttttttttaaccttaaaatagtactacttaaacattctacttaaaatgagtaaaagtatctcatttagaatagcccactcaatctgatccctgctgaggtagcttttcaatattacagcattctttcccctcactcactatactcactcacatgagcttactccttcctaacactggacctttacacttgctattcttccatctgcctggaatattttcctgactttttagtataatttcttctcatttttcagacctcagtttaaatgtcacctttttagactatttttttttttctaaaataatctagctcttctaactcctacctccattccagtaatgtatcacatgactccatttattttcttcataccactttaaacatcttaaattgtttatttgttggttctgattgttatattgttggttcttctcttacagcctctccccactagaatgaaaactcctaaggagaagctacattcacaaggcttagaatgtaactggcaatcaaaaggtgtttttttttagcctatgcatgctttaattaattccacagaatcagttgcctagtccatccagtaataacatttctaatatcttacatcttgccttttcaaagtttttgctaagtacttgctctcatatcagaactaatgagataattcagtgattatattttcttttttttgaaacagagtctcgctctgtcgcccaggctggagtgcagtggcgcgatctcggctcactgcaagctctgcctcccgggttcacgtcattctcctgcctcagcctcccaagtagctgggattacaggtgcccaccaccacacctggctaatttttttctatttttagtagagacggggtgtcatggtgttaaccaggatggtcttgatctcctgacctcgtgatccgcccgcttcggcctcccaaagtgctgggattacaggcgtgagtcactgcacccggccgattatattttcaaagtagccatcaagtgatataataaatttgggagattactaataggaaaatcaatgtgttctaaagctttatttataaagatccttcacaggaagcttattttaaagttatttgaagaatgaactgaaagttacaaagtaatggttgaaatttcctcacaacatctattgttaagtgctcatcttagaaggagtttggggaaattatgaagttcactcatttaataaatactgaaatgagtgcctgttacatgctacatactactgtgctaggtgctagggagacaaggaggaaacaagatctagtcactgccatagtgaaacttatgaaccactagaaatattggaaagctactaggcttaaaataggtagcaaatgctataaaaacttcatggtgctatgataaaacatatggaagaatcgggggttagagctgtctcttcagaggaagtagacttttaagctgatatataaaagataaatagcagttagatggaaaaaggcagaagaaggaaaagaagagtgtcacagtcaaatccgtgtgtgaagaccaggaaaaaaggataataaattcaggaaacaaaagaagttcagcatgaatgagatacagagtgttactaggaggtgggggtgggagtgagagaggaacaagctggaagtgcaaggaaatacagatcacaaagaaccttataagtcgtaacaggaaattggcactgaagtattttaagaagagaagtgacgattcgatttgaacatcaggaaatcttgctgactgtagcaggaaaaatagtaaggatattaatccatagtcaaattagagtgttattgcagtaatccaggtgagcaatgttgacagcctgaatgatagcaactggaaagaaatggacagattgaagagatatctaggagattgaattagtaacactggggtttgggttatgaggaggagtccaagatgatacccagagtttttcttgagcaactgggtagatgatattaccattcacagaaatgggaaatataggatgaaataaaaataaaaacttcagctaggggtgaaataatgggttcaatttagactaaactcagtttgaagtacatatgaaaatactcagtagagagttggaaatacagactatttcaaaaaggtctgcattagaagatgttttataataataattggcccatttctgtttttctctatcatagaaatgaatatcctaacccatattgaaagtcaagagtttccacactaattgtattttaattgtgactatcactggcatatccattagctgaaatggtatggttatgagagtatgagcaaggttttccctgcaatgtatccatctctttgaaaacatcacacatactttaaataaaacaaataaaagacatatgaaataaaacaaagttacttaattatgggataagaaatttaaatttaggctaacatcttggacactttaattaattactataattgcttggaccagtctgttatgattgaggcaccgtttaaggtaaggatgagccatgtagattttggctgatacagtacaaaggaaaattccttcaatgcatgaaatgctttagtgatgactgatgattaaattgcataaggttctattctatattatatgagagaattaaaaacaaaaggtgcgctattcatttcagtgaaatgatggatctgccagctgcagcaagcactttccttggaactctcttatgacaaattaacatagcatgtgccagatgtttttttctttttcctgttgaattatgctataatatgcttcagttacttttagtaattatgtattttgtaatttgctggtacctgcagctgcctctcatcctgttaattaaaaaaaaaaaaaagaaagaaaaaaacagttacagcagccaaacattacagatatacagccaaggaattatattgttttacaaagtgaagagaatgccttaggtgcaaatgctgtgtagttcactctatatgtacagtttgttttggacaagcgaatattacatactgtatattcatgtgttcattcatttattcaatacaatctaattgaataattagattcctttcccaattaaaactgtttaatctggttaataaaaccataaatatttagatccctgtctgcagcagagacaacagtgttcaccagacattccatgtgtaccatacatttcccagacttctatgcagttctcaccaatggaggtaaaagttagtgatatatataatttcaaaactgagttagttaagtgcccatgttcctcttccattcctctctttctcagaggtgatctcaggaaaccacgtgttaaagaaggcgtacactctagtagagccttcctgccaaactgcctaagacatgcaacgtaagcaataataaacctttgttttgtttagtccctaagatttcagtttgtttgctgtggtggctgacattgcttaacataataaactgcgtagatctgacctactcttacatcactattgcctcattttgcatactatttcttttacttcaaacatactgattgtattactgctttggcggtctttgaactagctgttctctttgcttaaaatgctctttctcctgatctttatatcctttttatcattatatctcaccttaagattcatttcttcacaggatctacctggtctaccaccctcagatatccaacaatccattatcacactggcttattttaaattttctttctttttttacagacaaggtctcgctctgtcactcaggctggagtgcagtagcatgatcatacctcactgcagtcttgacctcctggctcaagtggttctcccaccccagcctcccaagtagctagaactacaggcacacacaccatgcccagaaaactttcataatttctgtagggacagggtcttgctatgctgcagaggctggtatcaaactcctggcttcaagtgatcctcccacttcggtctcccaaatgctgggataacaggtgtgagccactgcacccagcctctaaactttttgcatggtacttattatctgataattaacatgcgtatgtttatttattcaataatttctacttcactgtcaataatctaaacttcaaaaaaataagaatcttgtctttgctgtattcccattacttcaagaacagtgcctgctcaataaatacgtgataagtgaataatatgtagactaggaatatgtccgagggctggccaagcacttttggtttattggggtggttgttcagtgtgactggagcataaagaacttgaaggctggaggcagagaggcagactgcagataaaatatggcagagaaaagactgtgaaaaatctgtaggcaacaataaaacagaagtctttaagtaggcagggccagtatacttactttttagtaaaataactgtaacagcagtatgaaagatggaatagagtggggaaaaatttgatggcagagaaaccagagtgaaggcggccactttaggagccatagttaaagatgtgagggccctgaccaactgcagggacacgtatgtcaccgcatgcttatacacatgcaagtatttctataggacagactcctgtaccaggaactgcaaaaggatctgtacagtttaaatttagttagattttgctacattaccttataaaaagtatttgccagtttacattcccacctatactgtatgacaactcctgtttccccatgtatttgtagatgctggatgttaaccatcttctacattttgccaatttgctgggtaaaaattattgcttaaatttgcatctctttaatgaaaagtgaggctgaacttgctttgctatgtttaaaggagatttgcatcgatacttttgtgagctttgtttgaaccactgagttcacatactttgtccatctttctattaggttgttaaccttttaatgtggaacttgatgaattttgcacattaacccttttaaaatttttccagtatcccatttgtcatttatctttgtttagtatctttcttcataaaaattttaatttttatggttagatcgattaatcactttttcttttttggattctgggttttgtgttttgattagaaagtcttctctattccaagagaataaaaataattttatttcttctaatacactcttttttacacttagctctttaatacgtctggaatttattttatatatgaaataaagaatattctaaatgattttctatctttttaacatcatcttttcaccaatgatttgaaataccaccattatcataaccaaaatttctgattttatatttttttttctttttctgcattctgttcaaattatctatccttgtgccaatactgttttatgtattttgatatctggtagggaaaatctcatttttttcccacagaggtttgttgatttcatctataaaaatagtaacaacaggccaggtgcggtggctcacgcctgtaatcccagcactttggaaggccaaggtgggtagatcacctgaggtcaggagttcgagaccagcctggcaaacatggtgaaactccatctctagtaaaaatacaaaaaaattagctgggtctggtggcaggagcctgtaatcccagctactcgggaggctaaggcaggagaatcgcttgaatctgggaggcggaggttgcagtgagccaaggttgtgccattgcactctagcctgggcaataagaatgaaactccgtctcaaaaaaatataataaataggtaaataaaataacaacaatctctcatttaagtaagattagtacatatatactgcagttacagatactatacactaataagttaactagtaaaacagcttcttctttgaagctcaaaattctttgtgatacatacattgcaagataaagtagtagtagctaagaggggataattatagaggaattaataagatattacaaattaaacttcaaaccaaaagataccatacagaaactcaaatttttaaaaagcttctgatcctaagttctccgatactaagatgaaaaattacctatgaaaaaattattttatttaattatttggtgttacatttagttttgaccatagttacttatgggtagataattttaaaaatcacaggtactggtaatcatatttaattgtcagttgcgaaaaggtatagaagtttccacggggaataaagcaagtcaagggaggactacgtatatcatgactatacttatatttggttttgcctctaatattctcctaactgtagcaaataggtggacaaaagcaagcaagaaaatagcaacttaaaagaattcaattcttatgaagtagagaggacagaggcaaacagccaagtactttcaagattcaatgcatacaactaatttagagaccaaggaatgctagcactttttaaaaggcatattttcagggggaaagctttgatgcttaatacatcacaataatgcacacagagaagcaggatgctgagccctaacctgaaaaggctcacttttgaaagcgagtaataacacttttgatatgaatgctagaatatataatgctgtggtatatatagagacatcattacacggagagtcaaatgcatcaaacaagccatttacttttaaaatgctctgtagtttattttgcaatttattattaattaaagacctaattggttcaagacttggactataccattgaatcactaaaaacaaaaacacttctaaggagaacaaatgaattcttccccagagatatggaagtaccatctagcagttagtctggtactttactgatgctcaatatggatgctattgtatgtcaagggtagattatcacctttgtaacgtattttttcattaaaattaaaaataaattttttaacttgaaaattataaatctattatgactgtcatagaattttgtattatgaccaataggtaagataggtcagtgaaaatacttcagtagatacattttattgatttcatgcataatcttcagtattatttatgttctccaaaaaggagggatacaattcatatatataaatcttgcctaaaatctactgccttctagaactagtaatctttttgtgcaagtaaaagtaagtacatgggcttttctctcctactcttcctcctcctccttcccctcctcctcttcccctcctcctcttcgccctcctcctcctttttctttgtatatatatataaatagagacagggtctcaatgtgttgtcctttaccaagacttggtttttaaggctgggcagaaaaggaggtaagctttgaaacagaaagaaaaaaagatggcaaaaatcctagtgatatttactggatttactggattcacatataccactggtcaagatataaactgcaatcttgactatttaggctaggcagggctttgttaccaaatgtgatttgctgagcatatctggccagtgctggcagaaagttcaaataaatttaaaagccaagatttcacttaagtaggaattttctttagaaggtttgttggtttgcttcaaattgcttattccatgaattatttctatttgtttctctcagggtagttaaccatttcatgttgctacgttcggcattctgttgttgtggaaaattgttttttaaaacaattctttgtatttaactgaacatctaacaaggaggcactacagcaaaacaaaaataaaatctagggacaaatgaagagtttgttcttacactggagcattacagccaagttgacaggaaacacaggcatgggaaaatataactgcagtgtgggaaactgcagaagttctcttctgattgcttctcttttctcagtgaaacaggaattgaagttattgcctaaaagggatgatgggggaggagttgcaaaaagatttgaggacagaataaagggtatgaaatagtcaccaaagagagtagaatatataaaatgattgtcttgcagcactaaaggtcccttttgtggtcatgaatttaaagtgagacaacccagaatggctgtgtgtgttttttccagccaccttgagctgaatgagtaaagctacagagaagacgagttatatttaaacagggctgtggttggccaaggaagaagagaaagaagggcaggagagtggaggatgattatctctgctgacctcttctaaaatggggcgctctcaaaaatacatacagtgcctattggctttttctgtttatttttctctttagcactcaccatctatcacatatttaatttctcttgtttaatttgagaccaattaatgtttgtctcccctattagaatgaaagctccatgagggcagggatttttgcctgttttgttcactggtattgtcttttaaaaggtatgagtctttgctggataacagcaaagcaggtatcagagtactggtactcacccgctcctcaccactgcccacaaagagaagtgactagctggcttactacttagcagctatttctaaagcactgggcgatttggatatcattttgatctttaaaactagtaatattgccgggcgcggtggctcacgcctgtaatcccagcactttgggaggccgaggcaggtggatcatgaggttaggagattgagaccatcctggctaacacggtgaaaccccgtctctactaaaaatacaaaaaaattagctgggcatggtggctggcgcctgtagtctcagctactctggaggctgaggcaagagaatggcatgaacccaggaggtggagattgtagtgaaccgagatagccactacactccagcctgggcgaaagagcgaaactccgtctcaaaaaaaaaaagaaactagtaatattatcttttattgtaataaaaaatccttaatgtgatagatgtttctctaaaatcttaaatagagtaataaaaaataggaagtgatgagaaatgagattggacatacatgtgaaaccagatctaaaagctgttgcagcagtccagggataaatgaagagtttgtaagagaggtcagagatgatggtgatctgatctaatataggagtagcggggatgaaggcaaatggatttgaaaacattaaggagaaagaagagaaataatcaaacatatctgaaagctgactatagaggtgcacaaaggggatacagaaagaggagcaatctatggaccacatttaggtcattctatggaccacatttaggttgttttcaagatcatggttattggaaactatagtttcttctacagtatttgaattttagttaaaatcaatgccaaaaagcccacacaaacaaataattttcagtattcaaatgaattaagctatgatggtgtgataacaagtagcaagattgatgaggttttttgacacaactcattctagtaaactcctttaagttagtcatatatgggctactctgcttgctcataaaggggcacggcatactagaattcaagttgaaaggattcttctttggtgttgcactgctggctagcacactcctttaaaaatcacatttcaataattcttaaataaattacctgtaaacatttaaagaatcattatcaagtgcccaacactatactatagactgttatgcttaaccaaatagttatgttcatatatagataccgattcaacatactctgccaataatttctagtggtctggtgcctgtggacatacatgcccagttcacagaggtctgtgttatacggccaacgtgtacttttctagatttcagaataggagttcaaaaaattgaataatcctagctgcaatgttttgtgcaatatttctcctctggaagtatgaccttaattattagcaatactgatttttaaaaactatttcacccaattaatcctagtgcttatgttcaggactatgtattcctttattatcaacagtcttcataataattcttagaatcaatagcattttcaagtttgtaagatgagaaacaagtttcattatacagcagtggtacaattatgggaattcaagtttcttaggtctgttaaatactgggggcacattatatcatgttttaaaagttcaaatgcatttcaaaaagctgaaattctactttgaccagaaaggatcaaaactggaagaagagtttggcctagaaaagaaacaataattgataaaattcactagctttcattcattcattcattcattcattcaacaaatatgttctggatatctactagtgctggacactcttttaagagctagggatacagtgaggaataaaacaaactttatggagctgatagtcccataggaaagacagactgttttaaaacatgtaatgaaacaagtataaaacataattactgacagtgatgaatgctaggagaaacaaagataggcaatgggacagaataagttcttagtggcaaagccttattcatcttgtgtttctagcatttagcagaatgcttggagaagaatggtcactcagttgtcatataaattaaactgagttttaagggatctgcttttgtttctggatccatttgtatacatctgcagactgaagtattagacattttaaattgcaaggtataattctgaacttgatagagtgaaaagatggacagccaagatgctaataatactgctgaacacttttacagggatactaaaattctgaatcagagcagatttgggtattttcaggtaagtgtatgaatacgttaaagcaagtatataaaatattaatgagcttctattattgcagttaatatatatcattttaatagtctacatgttatttttaacacaaaaatgacattaaaccaaattgatttgttacttttttttgttctgaaaacaatgggaaaatcaaatgtaatgaaaccaataaaggagtagcactgcctttctcttatacttgacccaaaatatctgccaagtggcagaagctttctctgagtagatttacagtttctaatcaccaaagcatactgactgacgaaaaagctaaaagacttgaagtctttacaggacatcctcagcacaggcagtccatcattaaggaagaaacatagttaaaaattacggtacattttttcaagatgttttgaagatttcagccaatgcaacagacacttactttttcatctaccgtttcaacacagtgtaaaaacaaatcaaagttaggcacttttggtccattagagcaatgtgtccttgtatcataggcttaggttcctatactataagttgcttcaaggtatagtatagttatacgtcttgacttagttctgacttgtcaagacttaaatgtcttgacttagttctgagaccctggcaaagaggctggtcagttcctgttttgagaagctgagtgtacaactccaaccacttcccttattgggctgtcacattctgggccactacatctgccgtaatcactctagggccaggaaccagaaaaaaccaaccaaccaaccaaccaaaccagaaacagccactacgccgtggagcccactgaacttgttcacatcagccaatctaaaacttgttcaccatggcgtcacctgttcctttctgtaaaaaccacaataaaatgtgtgctcacagttgcccccttcaccttctacctcgtgactgaccccagtgcttctcgagtggtcctgtgtggtgtgctgtgtttgtccagggaactgtgagcataacaaactgtaaaactctttccattttctctctcttgatctgcatctggcctcaccatctcacacaaagtaatatagttaaaatataatggtacacaacatattgattttagtcaagaaataatattaagatcaactactgtttcttaattattatgtattatttaagtgccacattggttttaatgatcctgatactaatccccagcaatagttctgataatttattttatagccacagtccatttcaatttccaggatgctgtaattgaccacagacatatgtaaactctgtatgggacaataattattggaagccaagttctcgattactgtgctaagtgaggtgggatacttttaaagaatatatgtttggatctagtaaaggtatactaagttattcagattaatcaattcagtaaaaactccacaactctgtaaaagcatcaaacagaggaaaatatagtgaaaatgttccaagacaacttctgaatgaaagcttataatgagaaaagctaacagaatcttggagcaccaatacttcctctttcctggatggcatttacaatactgcacacttgggatctgaccctgttaccactgagagaaaggggtgtggtggagagatcctctccatcgttgatctggcatcccaaaagagcatcacttcaaggttaaagtgaaccatatctgaaagcatgccacttctctcaaagtcacaggactacagggaagctactttggttatgaacaaagcagaagaaaaaacgtattcttctgtggccacagaccacagatacacctcaaaattaacaaagcccagaaaccccacccttagttgaagttctcacacccagtagtgctctcaggcacccagaagaggcaaaggcaaagattctctatggaagctttacaacaaaaattttcaatggcaattactaataaatagatagagaaaccagataagatgcttaggaaccaaaagaaacagatctgtctgatgacagatattggagtggtcagaaacaaactttgaaactaaggaatacaataaaatggtacaggacataaaacacaaaatgatcactctaagaaaggaccaaactgaactgatagagcaggaaaactcacttcaagaatttcataatacaatcaatcacaagtattaacagtgcaatcaaccaacctgaggaaagaatctcagagtttgaagactggtttctctgaaataactcagataaaaacaaagaaaaaacaacagagaagaatgaataaagcttctgagaaatataggattatgtaaagagaccaaatgtatgatctaggatcaaacctccacataccaatattaaccttgaatgtaaataggctaaatgctccaaattaaacggcatagagtggcaagttggatgaagaagcaagacccaactgtatgtgatctacaaggaacccatctcacatgcaaacatacccgtaggctcaaaataaaggaaaagagaaaaaccaaatggaaaacagaacaaagcagggattgctattctaatttcagacaaaacagtctttaaacccataatgatcaaaaaagacaaagaataacattacataatggtaaaaggttcaattcaacaagaagacctaactatcctaaatatatatgcatctagcacaggagcacccaggttcataaggcaaattcttagagacctacaaagagacttagataagcacacaataatagtgggagatttcaacatgccactgacagtattaggcagatgatcaaatcagaaaactagcaaagatattcaggatctgcacaggacatttgactaaattggcctaacagatatttatagacctctccacccaaaacaaacagaatatacattcttctcatctgcacatggcacatactctaaaattgaccacaatcagctgcaaaacaatcctcagcaaattaaaaaaaaaaatcatactaaacacactcttggaccacagtgcaataaaaataaaaatcaatactaaggaaattgctcataatcatatgattaatggaaattaaacaacctgcccctgaatgacttttggggaaactataaaactaaggcagaaaccaataaattatttgaaactaatgagaacaaagatacaacataccagaatcttggggacacagctaaagcagtgttaagcagaagtttatagtgctaaacgccctcaaaaagttagaaagacctcaaattaacaacttaacatcacacctagaggaacaaggcaaaccaaccccagagctagcagaagacaataaataacaaaaatcagagttgaactgaaggaaatagagatgcaaaaaaccatactaaagatcaacaaatccagaagttggtttttgaaagaataagattgatagaccaccagctagactaataaagaaaaagaaaagatccaaataaataatcataatgacaaggggatattactattaaccccacagaaatacaaaaaaaaaataacctcagagactactatgaacatctctatgcacacaaaccagaaaacctagaaatggataaattcttagaaacatacaaccttccaatattgaactaggaagaaattcaatccctgaacaaaccaatagtgagttcagaaactgaatcaataataaaagtctatcaaccagaaaaatcccagggtcagaaggattcacagccaaattctaccagatgtaagagaagagctgataccattcctactgagactactccaaaaaattgaggagaagggacttctctttaactcattctatgaggccataatcatcctgatatcaaaatctgacaaagacacaagaaaaaaagaaaacttcaggccaatattcctgatgatcatagatgcaaaagtcctcaacaaatactagcaaattgaatccagcagcacatcaaaaagacgatccgccacaatcaagtaagctttattcctgggatgcaaggttggttcaacatacacaaatcaagaaatgtgattcaccacataaacagaactaaaaacaaaaatcacattatcatctcaacagatgcagatcctctgtcatctgggctggagtgtagtggcacaatatcggctaagtgaaaccttggcctcccaggttcaaatgattctcatacatcagcctccccaatagctggaattacaggcacacgccaccacgcccagctaatttttgtatttttagtagagatggggttttgccatgttggccaggctggtcttgaagtcctagcctcaagtgatctgcctgcctcggcctcctaaagtgctgggcgtaagccactgtgcccagcctagaaaaggcttttaataaaattcaatatcccctcatgttaaaaaccctcaacaaactaggcattgaatgaacatatctcaaaatgataaaagccatatatgatagacccacagataacattgtaatgaatgggcaaaagctggaagcattccccctgataactggaacaagacaaggatgcccactctcactacccctattcaacatagtactggaatcctaggcagagcaatgaggcaaaagaaagaagtaaaaggcatccaaataggtagagaggaagtcaaactatctctgtttatggatgatataattctagacctagaaaaccaattagtctctgcccacaagctcttagatctgataacttcagcagtttcaggatacaaaattaatgtaccaaaatccattgcatttctatacatcagtgacatctaagcagagacccaaatcaagaacacaatcccattcacaaaagccacaaaaagaataaaatacaaatatagctaaccagggaggggaaagatctctacaatgagagtaacagaacactgctcaaagaaattggggatgatacaaatgaatgaaaaaacattccatgctatggataggaagaatcaatattgttaaaatggtcatattgcccaaagcaatttacagattcagtgctattcctatcaaactaccaatgacattcttcacagaattagaccaaaaaaactatttaaaaattcatatggaaccaaaaaagagatcgaatagccaaggcaattctaagcaaaaagaacaaactggaggcaccatgttaatgaatgaaaaactatactacaaggccacagcaaccaaaacagcatggtactggtaaaaaataagacacatagaccaatggaacagaatagacagcccagaaataaagtcacacacccacaatcatttgatctttgacaaagtagacaaaaacaagtaatggggaaagaactccctattcaataaatggtgctcagataactgtccatatgtggaagactgaaggtggacccctaatatcatatacacaaatcttcttaaggttgattagaaaattaaatgtaaaacctaaaactacaaaaacccagaaagataacctagggaataccatctggacataggccctggcaaagattttatgatgaagactccaagaccaattgcaacaaaaataaaagttgacatgtgggacctaattaaactaaacagcttctgcagagcaaaagaaaatatcaacagagtaaatagacaatctacagaatgggagagaatattagcaaactgtgcatgctataaaagtctaatatccagaatctacaatatagttaaacaaatttataagaaaaaaacaaacaaccccattataaagtgggcaaaggacaagaacagacactttcaaaagaaaacatacatgcggccaacaagcatatgaaaaaatgcccaacatcactgatcattagagaaatgcaaatcaaaaccacaatgagatactatctcacccacatcagaattgatattattaaaaagtcagaaaaataacagatgctggcaaggttgtggagaaaacggaatgcctatcctctgctggtgaaaatggaaactagttcagccactgtggaaagcagttaggagatttctcaaagaacttaaaacagaagtataccattcaacccagcattcccattattaggtatatgccccaaggaatataaattgtttttactacaaagacgcatgcttgtgtagattcactgtggcactattcacaagagcaaaatcatgaaatcaacttaaatgcccatcaatggtagactggattaaaaaaatatggtatatataccccaaggaatacaaagcagccataaaaaagaatgagattatgtcctttgcagcaacacggatggagttggaggccacagtcctaagtgaactaacgcaggaacagaaaaacaaatactgcatgttctcacttacaagtgagagctaaatattgagtatacatggacacaaagaaggaaacagcagacacctacttgaggatggagggtgggagtagggagatgatcagaaaactatcaagtactatgcttattgtctgtgtaacaaaataataggtataccaaacccttgtgacatgcaacttccctacacaacaaacctgctcatgtacccatgaacctaaaataatagttaacaaaccaaccaaccaaccccttgagaatatacaacagcaaattgaacattaaaaaagataatttgtaaaataacagatcagaagagactgtgtgactgcagcacaatgaaaaaagatgaaaaataaagagggtgagagacaaataaatgcaatataacagtttaaaatacctttgatcagaatcttaggaggacaggagacagtgaatcatgcaaaggcaatatttattttggttttaaaatcaacctcattgggatataattgtgggaaataaggtgcagccattttgagtgtagagtttggtgagctctgacaaaagcatacactcatgtaaccaccgctgcaattaagatacagaataagccacatgcggtggctcatgtctgtaatcccagcactttgggaggccgaggcaggtggatcacttgaggtcaggagtttgagaccagcctcgccaatatggtgaaaccccgtctctactaaaaatacaagatttagctgggcgtggtggcacatgcctgtatcccagctacttgggaggctgtggcagaagaatcgcttgaacccatgaggcagaggttgcagtgaaccaagatcgtgccactgcactccagcctgggtgacagagtgagactccatctcaaaaaaaaaaaaaaaaaaaaagatacagaataggtccattgccctaaaaagttccctcttcccttttgtagtcactgccccacccctcaaatcccagtcctaggcatccaaactgttttatcattataaattagaattgccttctctagaatttcacacatatgggatcatacagtatatagtcttctatatctgtttttttttcaatctcctttttgagattcatccatgttgttgagtgtatcagtggtttgttcctttttatttctgagtgtttatccatgcacctggtgatgtacatttgggttctcattttcagccattataaatatctacaaacatttgtgtacaggttttttgtgtcgatatattttggttttatttttggaaagagtcttggtctgttgcccaggctggagtgcagtggcatgatcagggttcacagctgcaaactcccaggctcaggtgatcctcctacctcagcttcccaagtatctgggactttaggcatgcactgccatgcctggttaattttattattttttattttgtagagacgaggtctcactctgttgcccaggttggtctatgtgtggatgtgttttcatttctcttgggtaacatctgtgagtaaaactgcatgtctgcatgatgagtatacatttaactttgcagtaaaattgtctattattactgagttgtaagattaaaaaaaaatcaagtactttgtcagatatactaattgcaatttttttctcacagtcttttttcattttcttaatggtggcttttgaaaagcagacattttaaaaattttatttatttttattttttattatttatttatatttgagacagagtcttgctctgtggcacaggctggagtgcagtagcacaatcttggctcaccacctcccaggctcaagcaattctcgctcttcagcttcctgagtagctgggattacaagtgtgggccactatacctggctaattttttgtatttttagtagagacgggggtttcatcttgttagccagagtggttttgaactcctagcctcaagctgatctgcccaccttgacctctaaaagtgttgggattacaggcatgagccactgcccctggccagaagtttttaatttaatatagtccactttatcaaattttttgtactttattattgtgtcttggaagaaatttttgcttatcataagattttcttttagatattttattgttttccttttttatgcttaggtctatgattcatttcaggttatttttgtgtatggtgtgatgtaatggcgtggcacgtaagctctgaaacgaacctcaatgatccctaccttatgaggtccttatgaagtctcacctatgtgggctctacccagggactcacttttaattgatagaatatggttaacgtgatatgatgtcactttcaagattagcttaaacaaagatcttgacttttgttttactttctctctttcaacttccttccctttctccctcactcctctctcctcactctgagggaagcaagctaccacattttagacccataaagagaccaacaaggcaaggaactgatgtctcctgccaatgccagttaagacccgaggcctgccaacacctacagagtgagcttgggagcagatcctttcctggtcaagctctgagataatgcagctttagtcaatgcgttgattgcaactttatgagaaaccctgagtcagaggcattctgattcagacatgtctagattcctaatcctcaaaaactgtgagaaaataaatgttcgctgttttaagtcactaaattttggagcaatttgttatgcagtagtagataactacacaaagcgttttcatcaagtttggaaaaaatttggccgttagttctttttttttttggagctggagtctcactctgtcatccaggctggagtgcagcggcatgatcttggctcactgcaacctctgcctcctgcctcagcctcccaagtagctgagattacaggcatgtgccaccactcctggctaatttttgtatttttagcagagatggggtttcaccatgttggccaggctggtctcgaactcctgacctcaagtgatccacttgccttggcctcccaaagtgctaggattacaggcgtcagccacggtgtctggcccattatttcttaaaacactcccacactcccatccctgccctcctgggactacagttgtatgtattttatactgcttgatattgtccctaaagtctctgaggctctctgtgcataatttttctttggtctttttttctcactatgtttcatttttggatggtttctttcgctctcttcaagttctctgatcttttcttgtgcagtgtatgatctgctgttaatcccattttgtgagttttaaaattctctaatatttttcatccacaggtttccattggttccttttttgcatcttccacttctctccttatcatcttcatgtgttcctttaaatcactaagaatatttacaatggctggtttaaagttctcatgttttaataattttaattaattaataaaaattaaaaaaataataattttatcccctctcatttctgggtgtgttttgatgcactagtttttgtttttctttttttctggttatgggtaccattttcctgcttttgtttatctattttgttggatttgttctggcaggtaattaagttacttgaggaccagcttgttcattttgaagcttgtttttagctttttcaagacagattttcaattctttttactctaggctagtttagttttaacaataggataaagtgatcctgaaatctttattgtatactctgggtgttcaacaaggatgttccactctggccgactggaactctcatgtctcttattactgcataaactcttgatgttttgtcagttcacagctcccaaagatgttatctttaatgttctagaagaaaacacctgtcaacttggaattccatacccagcaaaaatatctttcaagaataaacaaaaagtaaatatattttatgagcagcagttgagaattcaccaccagtagatctttaccaaaggaacttctgaaagacataattcagacataaggaaagtagtcccagatggaatgtatgagaatagtattgttcatatatatttattactttattctacattgcttctagtatctcattcagtaatatacaataaatatattactgttcatatatatttattactttgttttacatttattactgttcatatatagtttgtaacagtaatatattttttactaaatgaatagtaattaacctatcaacaataatatataagctgggtaagagaaattaatggtgctaatatgtttcaaggttcttgagttttctgggaggagaataaaagctttgattaccttcagacttcctaagtatgtgtggtataacatgtagggtagttaccaaaagaacatgagtaattaatttccaaatattggggaaaaaagtagaatgattaaaaaaaaccaaatgaattaaaaagatgagaaagaaaaaaaggaataaagcaaagatgtcagaagtagaaagtactaaataatacaataaaaacaaatcccaatatattttgaattacactaaatatcagtgaatgaaatggcctgaaactgagctatctagtgtttctaaatctatgaaacagaaacaattaagaaaaaaataactaaaatgactgcatatgtttaagaactttagaatttatatgaaaatgtacttatacataacatgtagattaaaaaagataataaatattagaaaataatttgaggccaattactcctataatctcagcattttgggaggccaaggcaggaggatcagtttcttaagtccaggagttcaagaccagactgggcaacataatgaaaccgtgtctctacaaaaaacacaaaacttagccagctgtggtggtggacatctgtggtcctagctacttgggaggttgaggcaggaaaactgcttgaacctgggaggtggaggttgcagtgagccgagattgtgccactgcatatcagcctgtgtgaaagagtgagaccctgtctcagaaaaaaaaaaaggaaaataatttgaactaaataatagtactatgtatatcaaaacgtatactaaagctaagacatagggaaaaatttataacattgaagaatgcatgcattaggtgaaaatttgagccatgcttctatttcaagaagtaagaaaaaagaacagcaacatgaaagaaaggagaggggtaacaaagagcagaaagtaataaaattatgtaataaacacaaaatagaaaagattaaaaatcaaaggttatttataaagagtaaaacaactgagaaactctgataagagtgataacaaaaaaaagagacaaggtacaataatatcaggaatgcaaaaggaagtattacagatgctgcagacattaaatggacaataatatgaaaaacatccaaaaatactaaaaatttagaagaaattgacatatatctataaaaatataatttaccaaaactatgtcaatgaagaaatataaaatctgaagaattctatcactgttcaagaaattttgattgactcaacgataaaaaaacactcctacaaaaacccaacaacaacaaaaacaacaacaaaattccaggccaagagatttcactggagaattctatcaaatattcaaggaataaacacttccaatactccgtaaaatatacgagattacagaaaaagaagggctactctccaatttgtttttgaggctaacataactgatataacttgagagttcaagaaaggatttcagtcaatctctctcatgaacatagataaaaatatattaaataaaattctaacaaatcaaatccagaaatatatataaggagaatgcattacaatcatgttggttttgtcacaggaatgaaaatttggtacactagcaaaatcaatccataaaatttatcccattaacagattacatagaacaaattcaaataatcaccccaaacaatgcagcaaaagcttttataaaatttaatatctgtaggctttgcatgctggctcccagcactttgggaggccgaggcaggtggatcacctgtggtcaggagtttgagaccagcctgactaacatggtgaaaccctatctctactaaaaatacaaaaactaaccaggcgtggtggtgcatgcctgtaatcccagctacttgggaggctgaggcaggagaatcacttgaacccaggtggcagaggttgcagtgagctgagatcgcgccactgcactccagcccgggaaacaagagcgaaactccgtctcgcaaaaaaaaaaaaaattaatatttgtgataaaagctcttagtaaagtaatagcaaaaggaaacttcctgaatgtgatagaggttatcaccaaacacagaaaatattatatgaaatgatgaaaattgaaagctttccttttaagattgggaacaagaataagaatcctgattatccctactctgtgcattgcattggaagtcctagctagtgcaataagcaagaaagagaaacaaaacatacagttatttgaaagagataaaactgttctattgatagatgatatgaccaaaatccaaaagattctacagcttttgtcctaagtaaggtcactggttaaagaaagtatcatcagcaacaaatagctttcacatttctgtgtataaacaatgatgagaaaatgaaattaaaataaatttgacaaaggtgtaagatttctacaaggaaatgaactttactgagacattaaagaagacctaaacaaatggagagttatttcacgtccatagattgaaagacttaatattataaaaattttaattatgttgcttgttctaaatttatttatagagtcaacagaattcaaactaaaattccatcaaatttatttaaggaacttgacatacaattctaatatgaatacagaaatgccaagaaccaagaataggtaagatacttttacaaaaaagaacaaggtaagagaaatggctgtaattaggtatcaggtcacttttcaaatcttgtagttgtttcaaaagtgtcttacaaaggtataataaataagacagtgtggtattgacacaaggataagcaaacaaaccaaaagaacataaaagagatgtcagaaacagatccacacacatatgaacacaaattatgacaaaaggggcagtgcaaagtataatagcaaggaaaagagagacttgtcattaaatgtttcagggatgaatggctacaacatgggaaaaacagaagttgacttgcatctatcctgtgttgttgtctttgtctattcatggtgttataacaaaataccataaactggatggttaaaaagagaaatctatttctcactgttttagagtttgagaagttcaagatcaaggaatttacatgcaaagatgaggtgaaaggacaatataagcaagtatgtacacaagtaaaatacacagatttggtcttacggtggttataaaatatgtccagaaattcttggagattcatgtcttcagaaggtaggccctaaaaccccttactgttaatgtggtctggatttagcaactcacttctaatgaatagaaaaatgtgacttaggagactaggtcacaaaaagcattacgtctttttgctttctcttgaattatttgctctgagggaagacagctgccaagtcatgaggataccaaacttctctgtggaaaggtcacagggctaggaagtgaggtatctggccataaataggaacttaggccttctatccacggaggtgtaagcaatcttggaagcagatcctccagctcccattaagtcttcagatgacattttgattgctacttcatgaaagaccttgtgtcagattcacccagataagccacttccaattatttcatgagtaaacgcttgactcattaaattataaaataataaatgttttccttaagaactaaatgttggggtaatttgttacatagaaataggtaactaatgcagttctagagtcacggaagtgggaatgaaaagatagaaggcgtttcaaaagaagaatcaataggactcggttactgaaagaagataaatacaaagaatgagtcaaagatggctataaggttttatatccaggagttaggggaatagtggtatcaatgaagaaagacggttaaagaagaaatcaatttggaaaatgtaatataaattgagttttgaaatgtagaaattaagataataacaagacatatggtaaatgttctatcgacagttacaaaacgagggcaaataccaggtaagatgtaaagctgcaggagggtgcagtgaagaattcaacagataattaatagtaaaggaatgaatatctttaaaaaaagaatttgataagatcagaagggcttgtttctttgaagcttgtgagtacataaaaatagaaagtaaaagaaaaattattcaaacatctggataaaataagcttggtaataaaatgtagagaagaagaggaaatgagaaggagaaactattttcactttaaatacaggcataggcatctaaaagccaataagggaaggaaggactgagtggtggggggagagagagagaaatagaaactaggcagaaggtttttggggggttggaaattgtaattttttttttctccaatgggtaaaattgagagcttcagaaaaaagagattagtaattcagcagtaaagctaataataaaattactgagcagcaaagagcaaatcagaataatctctgtgggaatagtaattcgacagtatgactaaaaaggaactgccttttgtgtatttctttcttagatttcagcattcgactatcttttattgtcgagatttgttgcctcttagaagccaacaaatgcagatatatttcattatataaacatttgctattacagaattttattttattttattttgagagggagtctcactctgtcgcccaggctggagtgcagtggcacaatcttggctcactgcaagctccacctcccgggttcacgccattctcccacctctgcctcccaagtagctgggactataggcatctgccaccacgcccggctaattttttgtatttttagtagggacagggtttcactgtgttagtcaggatggtctcgatctcttgacctcgtgatcagcccgcctcggcctcccaaagtgttgggattacaggcgtgagccaccgcacccggcctacagaattttaatcagaaatcattaaagattccatttacgattaatttttggttacaaatgtatgttccagtaaattgttattcactgctgagctttgaatcctgtcttctgtagcttatttcttaccttcaactctcaagccagataattatatttattcctaaaatctattatatttctatccctttttttttttttaacaattatagcccatctggtttaatatcactggtatgttgtccatcttcctctaaattgattcaagtccttttctttctcatctctactttgttttaatctttagcatttgccatatgtgggaacacccacattttgttcccataccagatctctgcctcagtttatgcttttgaggaggaataattcatgacaataatagatttgtctgtaattaaaaacaaaactgaaacaaaatttcctttctagagtacctacattataggttttttaaaaagtataaaccacagaacatttaaaataagatttagtaataaaaattgaatttataagatattcatggcatgaattaaagtgtttattggttaaatatatttaaccttatatattaaaatatacatgtataaaacctaagttaaaatctaaaatatctatagtttttgagatcattctttgatttttttctaaaaaacatatttcctacccaaaatagggaagtacctcaacacaataaatggtatatatgacaaatccacagctaacatcatacttaatggtgaaaaattaaaattatttcctctgaaggtcaaaaacatgacaaggatgcccatttttgccacttctattccatatggtactgaaagtcctacccagagaaattaggcaagacaaataaaaggcatcaaattggaaaggaagatgttaaattgtccctgtttgcaaatgaaatgatctaatatatataaaaccctaaagacctcatcaaaaaactgccataaacaaatgcagtaaaactgtatgttcaaaacacaaaatatcagtagcattttccatacattaacagcaatctatctgaaaaagaaatcaagaaaacaattccatttacaatagctactaaaacaataaaatacctaggaataaattcaaccaagaaggtgaaaaatctctatattgaaaactaccaaaaactgataaaagaaatttaagaaggcacaaataattggaaagatatcttgtattcatgaactgaagaaattaatattgtcacaatgtcgatactattcaaagtgagctacagattgaatgtaatgcctatcaaaattccaatgacatttttcacagaaatggaaaagatgatccaaaaatttgtatggaaccacaagtgaccccagttagaacaatcttgagaaagaaaaacaaagttggaggcttcacactagggctattatggcacaaaagaccaaatggcatttgataacatacagtgaacaaaggaaaggtagaataaacacttgatttttccttttattcatttttttcttttagaatgaattgaatctacagcatcttccaaaggtgaccaaagacttttttttctttacttaaaaccattttgaagtcatgaatttaaaaaatatgtttgatatgtttcaatttattgcacatattctttttgatatccagatagtccccacatgggccagggggagctaacttaagttggtccatgggccattttgatgtgaccccagtaatcttgataccttctctttgctttttgtgatgacaaagtattttctaggcttatcttgtactctcctgtcccaaatctgtaatcaatcatttttccaaagagtcctagtttcttttaggagacctcattgcaactgaatactggtcttgtttttactgtttactgaaaagactgaactagagaatacacgttcttaacgagtaaaatacatcttgagttcataaactcttatttccaattccaatttagaactacaagtttattcaatttgagtttcttctcttttatgatgaaaaatttgtttcttaaagacttttataataactcaactgccttatcctataattataagtttcagaacaccaccatgaatattatttctaacaatatgactactagaaacagtttatgatttcttgcatttcctttaatccttaggctttatcccacacagtctaattactatgtttaatatcacttgaaataattcatctatgtagttaagccatcaacttcctatataattaagttaatttgtttaattttacttttgatttttaggtattgcttttcaaattttgatttaattcaaaaaataattatataaacatttatatagttccaaaattaagcttataaatctacaaaacaaggttcattcaaagaagtctagccttcattctgtcccgctctctcctctcagaaattacctttgaattattttttggctcacctcttcacttttaaaaacacaaatgtgtgtacatatgttggtttatatacatacatgtatataaacacacacaggcacatgcactcctcactcttagataataagtagaatactatacatactgttatattacttttttttaacttaatatacttcagatattgctccatgtgctaggattctaactgggattacagtgaatctataggtatattggtgggggagaatgaacataattataatatttagcattctaattaataaacatggtctctgcctttacttagactttctttaattactcttaatattatatatagttttcaaacaaaagtcttacatattgtttgttagatttgttgctaggtatttgatgttttttgatgtaattataaattatttttaaagttttatttttgaaatgtttgttactggtatgaagattacaaacggtttttctatattcacttaataatttgtctaacaattattttgggttttttacatattcaaccatgttgtctgttaagagtggctgttttctttctttcggttttgtcaaccttttatttctttttcttgccttagtgcactgattaggactccagtacaaagatcaatagaaatggtaatagtgaacttctttgacatcttgtcagtcttcaaaagaatgttattgacattattttttgccattaagaacaatgtctgctatagaatagatgcctttagaaaattaaggaaattctattcctagttttttaaggaatatttttgaaaaaataaccatgaaggaatattaaatgttatcaaatgctttttctatatctattgaaaagaccttatgatttttctcttttaataagttaatgttgtaaattatattgattttctaatgttataccaactttgcatccctgacattgagcctaactggtaatgatttttttttgttgttagttctttagtgctctttgtagatgctttgtataattcaacttttttacttgtggtggagggttggttagaattgcctagttcaccactaactctttcattttaaatatatgtcattccaaccttccaccaaaactccttttattatggttaacaaagtcaccacatgatatcaaattagaaggtccattctcagtccttaccttactcaaccaatgaataacagatttttataaaacataatggttaagagcatagtgtctttacccaaactgaatgtaaaacctagatctgtgtattcattatctatgtgatcttatacaagttccttaacctcctttggcctcagtttggctatctgtaaaacatgattaataatgttatacactttgtggggttgctgtaaagattaagtacatgtaagttgcttagaaaaatgcacacattaagtgttcaataaatatcacccattattgcttattccttttctgaatttttatttttgatttttactatttgtctttatttctatttctctggatatgctttctcagtctctctcagtggaataattttcctaaactttacattttggaactcagtcctcacacagtttccatctctctatcctctttttcaacatgttctcattccatgactttaaaaatcatgtgtatgttaatgattcacaagtttatagctcttattgtaatctcctccctgaatatcaacttacatacataatttactagttgatatcctgacttaaatatcttttgggcagctcatacttaacaccccaaagcaaacttcccgtgattatctccaaccctttataacctagtttaagccaccaccattttatacttggactatcatagtactagtttctttctcccttctcttacccttgcctctttacagtctattctttttttttaatagattttattttttagagtagttttaggtttactatagtaaatcatatggtgatatagtagatcattcagtgatcacattcatctgttgaacatttaagtctgatcacatcactttgctcaaagccctctgatctcattcctatgttgaagctcttgagcttcccatctcattcaacacaaaatctcaagttcatctgaggaagggtcagagaattttttttcaagggccagagaacaaatatttcaggctttgcaggcgaaatagattttgttgcaactatctaaactaatatatccaacaaaaactattacattttctgaaacatgcatgaaatttgtaaaaaatataatatttgctttggtttatgacataatatttttatagtagtttcataaatatttactgaagaaaaaggtaaggtccagaattatacattttttaaaaaagattatggcaaggacattaaactataggttaaagaatttcttctgtaaaacatgtcaaacaactaacagtagacttactttagattattgattctaatttctgcactttcagtaagtttcttcgtttcttctttccacctattggctgccttctgttgagtcgctaggagatgcctcagttcaacaatggaatttctattactgtcttccatctctctcaattgaacttcaaatccacgttcctttattgaaaattcatgttccattgtactgatctaaagaataaaatgaaaacgtattttctttttcttttcttataggtgctatacagatcaatgatatatacaaaaggaatcattcattatgttgtctgagggacaaaaatgtttggatgagaaaactacgtaagaaatcaagtttggtcaggtgcggtggctcatgcctgtaatcccagcactttgggaggccaaggtgggcagatcacgaggtcaggagttttgagagcagcctgaccaacatggtgaaaccccatctctactaaaaatacaaaaattagctgggcgtgatggcacacgcctgtaatcccagctactcaggaggccgaggcaggtgaatcgcttgaacccaggaggtgggggttgcagtgagctgagatcgcaccactgcactccagcctgggtgacagagtaagactctgtctcaaaaaaaaaaaaaaagaaaaaagaaaaaagaaattaagtttacaattggtcttcattacaaacgaaaacttataatgttatgtcagtaaaactagaattatgatgaactatatatttttgcaacactttccctaacaccttaaaatgccagtaaaagaaaagtctatttattataacataacacttctctctttatttactctgatttctgttgccagaatccaaggaaagtgttgatgctgttggtatctgagttaagtatttactcaaaccacttttgacttacatactaaatttgaaactctttcaaagggctttgtaaagtcaaagataattatatacaggaatttctttaccacttcagctccagtattagtgaatgattaatgaatgaattatttttcaggagaaagagacaatataaacaatgattttgaaaatctcttacgaaaatgtcttcagtacacttctaagaatttatgtcattatagtaaaagcactttaattgcagcatgaacttataagtaaatgctctttggataccctagaagctttctctgctggggttcagggagagaattaagccctaatgctttaaggcatccaatgtatataatgacttgcgttctttcatctgtgtctacaatgtaactacctaagtaccatttttggggaaattgagaaaaaagttactgcaatatttttctatgttttgtggttcagatgaaaaacacttgtggaaaaaggcagcaaggtgatttgacttccttattgtactctcaggccatctatattttgctatactaaagaagtataaagaacacttattttgtgatactttaattgctttacaaatgtccacagctggctagacttctagtaattcattaaatacagttactttcaaactcaaaaaacaatgagagtaattcattaaatacggttactttcaaactcaaaaaacaatgagatcaactttagtgtgtcaaaaaacacaaaacaaggcccaacaacaacaaaattcttggctcactggagcaaactgcaaacattctgtccttgccacccctgctaaatgcaaaatgcttcctaaaactcttcaatttgctttctcaaatagtacacatgcagaaattgaagactttataaatacagacactggaaaaccaatcttggatgtgttagttttgtgttgtattactgctgtgcaagcctcctgaggccacttgacccctgctgctatcttaataatttttgaattattagattctgcaaatttagattgcctgccctttctccttcccttccttaatcttcatctcctctggagaagtcatgttggtctaacatctcaggtggaaaacaaaaagtacagcccctgtgagttctttcttatgaacacatgttaaaaactgatctatgggccaggtgtggtggcttatgcctgtaatcccagcattttgggaagctgaggcaggcagattacttgaggtcaggagttcgaaaccagcctggccaacatggtgaaactccatctctactaaaaacacaaaaattagccaggcgaggtggtgggtgcctgtaatcccagctactcaggagggtgaggcagaagaatcgcttgaacctgggaggtggcagtggcagtgagccaagatcacgccattgcactctagcctgggcaacagagcttctcaaacaaacaacaaaaacaacaacaacaacaaaccacatatgcacacaaaactgatctatgcatctgtacagttttagaatttggctgcctagttaactccccattttcacttggaaaatctatttatcgtttcacaagctttgctttaagaccctttatgataacctggtccctgcttacttttacaagcttgtgttgtgccacactattcccttgcctttcttttatttccactataatgcctttttattctttggttcttttcacatgctgtttcttttgcctgaaataatctctttctgcttacctatttcaacttttggaacacagtacggttgtcaaaacatatttgcagattgaatggtggctttttgatgtcaaaattcagtctcgaacaagcaccatagcctttagtatatacaattcgaattactacctaaattggacaggtctgtggtaatgctgacaggctaagggccacaacaactgatctccgattacaaaaattctattaatgataaaattcagaatgttggatgggaaaaggggttttatggtctctcttctttcttgcttcttccttcctttacagagaaatatccacacaagtagataactgaattgctggaaacgactccatttcttaattttagatggtaatgaggcggaatttagaccatgaagaaatggagagccctggcaaaaggagtggttagaaaaggagaaagcgagggctgaaatcaatgcagtggcattaagatcaaatgaaaacttcatatgataaattgttaaggtttgtagccaactgacctcccaatatctcactgtctttatctttttggcttctttcagtttatctactgaagatcatactcttttgcaagagggagaaaaacagcaaggtgtaggtgcaccaggttcctattttgtcaaagaaagaatcagttacaaagcaatttatcttacagccttcttcctccataaaatagaattatagctagttagttaagacgttcggctctttatcaatggctattctcttaagctagatacagatttggtgagatatgtggggtagataaactttctattactcttttgttgtccataacatcagttactatcctgaaatgttaaagacggatctagtggagtactagataggaaaaattcattgattccatccccactcattataaaaaaaagaaagcaaaacaaatacatattgtaaaattatggaaaataacaaagcattaaagtgaaatgttaaagacggatcaactggagtactagatagggaaaattcattgattccatccccacccatgattaaaaaaaagaaaacaaaacaaatatatattataaaatgatggaagatacaaagcattaaaaagacaactataaggtccctctattcccaaaactcagataatcccttctaacttctacataattgtttttatttatgaattctaaaattgttattacagtatgtaaaggattactacatgtatgtgtgtatacacataaatttttcaatcatagggtgtatcaatataaatgcattataaattatttggaaatatagtttttaatgacaatacagtatcttattaaaaacatatacactatatgtcaaaaatacatatgtgtacacacaggtagtaatcctttatacactatagtaacaattttaaaattcataaataaaagcaattatgtagaagttagaagtattatctgagttttgggagtagagggactttatatattttttttaatgttttgtattttccataattttactatacatatagatgtaacatatttacttctagatatttaggttgtttctaatttattataaataatgctgcaatgaacttatttatgaaatattttaattactttcttatgactgaattttagactctaaagtaaatacgtaccatttaatacttttagctgcacgttcacttagagatacttagcaattaattaatggtgagtttaaactgcttactgcctactgtttttttttcttagattgcagattctgttcaactctcacatgattttttattcggttacaaatagttttctcttatatttttaaaagctctttagataaaagcatgggaaaacctgcccccatgattcaattacctcccactgggtccctcccatgacacactgggattatgcaactacaattcaagatgagatttgggtaggaagacagccaaaccgtatcaggatgtatgtatgtctggctttaaaagataatgctacattcccagcagtatctatcaaagttctaattgctttatattcttaaaaatacttgatatttttagtctttttaattttagccattctggtggtgtgtagtgttatcttgtagttttaatttaaattctcctaaaaaataatgaagttgaacatatttgcctatatgctattttatgaagtgcctacttaagtcttttggccttttctggaaatggagtatctatttttttctttattagctattagctgttttttccttattaatatttttcttattaattggtaaaagtttttatattttggatatgagttctctttttggttatatgcactacaaatactttctcccacttttccctttcttaatggtgtcttttggtgactaaaaatatcttaattttagtgaaatccagttcagcttggatttttcaccatggttagtgtttttttgtgctctgtttaagaaatatttcaaacccaaaggcaagaagattttctcctagaaactatcatttcacatttcacatttaggtctacaaagcagctccaactaatttgcatatatgctgtgatataggagttaagttttatttttaaaatatggatctgactgatctagcaccatttgtgaagccagttttccccccactgaactgcaatggtgcctttgttataaatcaagtgattatgataaatgagtttgtttctagactcaattttttgccattgatcaagttgattattcttatgttgataacacattgtctaaattattttagctttttatcaagtcttgatatctggcggtatgggtcctctccttgttcttcaaagaactcccatagtctaaaggtcaaagtacaaacttctttttaaataagactctctttttcatttcggagttcaaggttttacaaataactagggcatttcatacctgcaataggaggcattcaataaatttatgttgacatgaattaggttggaatatgacttcttaggagtccttgcagcaataaaaaccaaaataaaacagtgacatgacctcttcatattcttactatgaaattggaagatgtagatatttatcataaaaagttagtgccactttttacaaaagtctcatgacatggggaaaggtaagcaagatgttgatgaagattgtgttacttgaaagtcccttaaaaagaggatcaccttcctattaccaaaccatataagcatcagaggagaaggaaataagagagaaaagaaagggaatttgttttagatgacatttttgcctcttgccttcttcctgccatggaattttcagactagttatgaatggttctcagagcctactgctttaacatcctctatacagttagttttagagaagttcaacttttcaaaggctactacagagagagaagagaggaaggcagtctgtaaagttatctaatccatggttttgctagtgctgcttaaattgctttggcaggaatatcagtatatttcgtggttggaaaagaatttttttgtgtgtagcaaaggcaatcattttcaagtatgcctgccaagttctacaacacagaaatgattggttaacactctgaattatgatttagtgctatctgatgagaaggcaaaaaaaaagggggccttaaagatgttttgctaggtctctctaaatattctctatactttgattttcataagtacacatttaactctagtcttgaaaatacctttactttggcttttttttgagcctccagggcaatcttccttaaactctcagtctctttccgtaactgtttattttcttgctgaagttttagcctttgttcactgacaagcccacagttctctctctcagactccaatacattttgaagtttctgaatcatttcttggtaacgtgatatttcttctgaggagctgattaaaaaacgaaatgaaaagaatccttaaacttaatgatctatagtagaagataaaagtctgtctacattttatcacatggacttttgtttgctttattctgagccatttctttccactttagactgaaactatgtggtttcaaaatgttatgttataccaggcaaatacattcaacttaaatatattcaaattttaactaagaacagatgaattgaactgttatcacttatctagaaaatcaatgtgagacttctttcaaatttgtactaacattaagaatcactgtgtatggagaacttcaaggaaatgaactgaagcaacaaaaaaaggatgaagcggataataaccaaaactcctttacttaatcaataaactccatggactaacacaatagctgactatattactaaattataaaatctacttttatatttttccattatatgtcttagaaatactttttataaacttctagttctgtaaacttcttgttttatcataggttaaacggattatatttcctgaactgtctcaacaatggaccactgatcactgggtgagacaacctctatacattaatgttgcttcaaatcaatatactgctaatttttattcctatcttttaaaacttccatcttttcaataacagataagcactgtgaacattccctggttaataggtttcacagggaattgtatggaaatgctactaatattgtgaaagtttaagaaaactactagttaaaagtattttgcaagcagaaaaatacttaaaattcttaaaataaagaagcaactttgacctggtggcagttttatcaccatgaaccactccttctgtcctattttggcatgctgacctgcccatatctgccagtgctttgggtgaacacagttagtgactgattttctttgatctctacctctgcctttctagatctttgcttccccagcaactcccacattcttgtaaactgtttcctacattaaatcctttattcccgcaatactcatagtcttttttctgtctaaacctaggctgataaagttcctaataaaatgacatatctagggaatgataataaaaggatgctaacatcagaagatgctgagatcagaaacaaccacagattgtaagcctcctaatagacgtccacaatatcatcatctatgaagaattcttccaaaaacaacaacaacaaaaaaagaaagctagaccagatcaagcctctgggtctaattgctagtttttaggaattacatgagacagagtaaatagcatcaatatacaggcatgtagtggaggaaactctacattactaagaactcagtttttaaaacaaattatttgcaacaacaacaaaaatacagaaaaggggattcccagagattaaaggagatgcaagactacagcactccaaacattcctgaaattagaaatggacaagagaactcgcactcaagagaaaccctttaaatgaagtaactaagaaaaaagttcatcaaatatactttaaagcacatatgaaaacttaggagaaaaactctttgtatgtggagaatgtgggaaagccttcattaattcctcctgtcttgatgaacgcgtaagaactgatactgaggagaagaactctgcttataaaaagaatgcatgggagcctttagtcatttctcatttccttaatgaaagaaaaggactcatattggaaagaagcctggtaaatctaaagaagatgggttaatccttatccttcactcaaccttcaaaatttatcctggagagaagctttttgaaagtaaggaacatgggaaggtcttttacccagtcctcgcaccttattctatgtttacaccctttaggaaatatgtgagagttcaccctggataatagctttatgaatataaggaacacaaagaagacttcgatatctccttttactgtacacacgcaaaatactcataatgcagagacaccatgtgaattaaaacaaatgcaggaatgcttttattcaatactcctcccttaagagacatatggatatacacattggagagaaaccccgtgaatgtatggtattgggaaaagccttcatgtgtgatacgtctcttagtacatacaagatttatgctggaataaaccagctcctcctgcaggtttgatctggaagtaatcatatgagcagattatctgaaaaggttattgaaaattacacatatatttattaaacaaatttgcaagatctcttactaaaaaaaatctttattaatttaggtattagtatttaattaaaaatatattttgaacacatatagagattgtgattttaggcaattcaaataagaaaattttgctatattaggtaataccgtcggggtggggaggtagaaaaataaaatggtatgtcaaattatgactttatcattttatagataataaaatatacaagatggatcattatagaatattcactataacaagaaatacactaagtacaggtagtataaaagaatataagcaagctactataatagctgcacaattggtacaaagacaacaatattataaacatcctatttaactgccagaaaggatacatttaaaagaaaatggtatgctactgttaaatcttttcttcctgcagaaattcgctttcagaaataatcttgaataaaattatatttggtcctaattgtttttttcaacataagatatattgtaagtcctaccaaaaaaaagaaaaggtagcgaatctgtcaaaaattgtgtgaattctgaagatgttatcatagaaaatccaaaagaaaaacttactcagtttcaagttgttttattctattttctgctctcgtaagtcttagctgaagatcatcttttgaacgctctgaaaccaggaatctttggtgcatttcttccagttttctgtaatcactctcatttcctctgccttcacggtaaatctgcagaaaaggcttattaggtatataatattacagaagaaactgtcttaataaacagtttagaaacagaaatcaatggaagaaataaaaagccatgattatgtgttcatttgttctgaccgtaacatatgaaacatatcaataattaaatctggttctgtcacatttacaaaataaaatgctaaaaactaatatataaaataataatagttttgagaccagcctgggcaacatagcaagaccctgtcatctaaaaaaagtattaaaaaattagctgggcatggtggctcacacttgcagtcccagctattagggaggctcaggtaggaggatccttgagcccaggagatcgaggctgcagtgagccatgatcatgtccactgtactccagtctggataatcgggcaagaccttgtctcttaaaaaatagaatttatttttttggaattattcatgctcatggtaaactatgcaataatacaaaaatgtaaagcagctgaagtaaaaataaatgtcaacttagagataaccactggtgattctttgatgagtaccgttcaatacaatcctcttttccaatattcaaaaataaagatacatgccatggtgcaataactagaactctctgcaagtgactccagaatctcactctgggttacctggacaatgatctagctaggatggggcttcccccttcctcggcagtggtggttgtacctaagctcagctttccatgcaatggggctccctcttacagcacaaggtctgtaacatcctaagagatccaaggtctccaggtgtaagcagttcatacgttgaagcaaatcctgcacacagctacccccaaaatctagactgcctggccaagtaacctgtgtcttccccactgacaggactgctttgtcactctctataaaaacatggagtatcagcacgtcaacattccactactggaatacagatctaagctgcagacccagcagtactttgaccttagaacactggtctgtggaacagtgggagaataaggcgctgtgctttctctttacctgttgtcttttgccttgtaagttttacatttccccaaaagccttttccttaacctttgccatgtgatgttaaaacattcatcccaaaccctgatgtgtaacaggtggcaatctaaatggaaattgtacgcagatggaaactcagaagggacccaccttgcaggagagtggtaaccaaaagtcctattttgaacacatgtattttttttttcacaaatggaattgtacattatgttttgctttgtgtattactcttttactgatgtcataattttttcatgttcataatagatatagaccataatttttacgctacatagctctcctttgaaaatcaaactctgactctaccatttaccactttttaacattgggtaagttacttaacctctctatgaaagttcttagtgcagcacctaaaacacagtaagtgctcaatcaaatttggcctccttttcttttcccaaggtactttacaagagcaggatattactgctaataaaaaagcatatgaaagagatgaattttaaactatggagttctccctatagtttttctgaaatatcacgggggtaaatattcttcctaagtgtgaaattaaaatctgtacttctaaaaggtaaaaatcatagcaatgctataattttctggttatatatacttgttttatttatagatggcctaagcaccataagagctaaaataaaactcaaaaagaaaggaaagacaaagtgaaatttcgtaggatgaggtttaagcaagaaatataactacttcacaaaatttatatctttaagtacaaagttcaaagaatacagccgcccttggaaaagaattgtatccaggcaacatcagtatttaactgtagactctgaatatatttaagaaaagtgtgaggctgaggcaggcggatcacgaggtcaggagatagagaccatcctggctaacatggtgaaaccccatctctactaaaaatacaaaaaaagtagccaggcatggtggcacacgcctctattcccagctactcaggaggctgaggcaggagacttgcctgaacccgggaggtggaggttgcagtgagccgagatcatgccactgcaatccagcctgggtgacagagtgagactccattgcaaaaaaaaaaaaaaaaaaaaaaaagaaaagaaaagaaaaacttaccaggacaatactaacaaataaaggaattgctagtagatggcatgatggaggcagacagtaatgttgcatatttgcagttgggttttaggtagttatatttcctttttctttttaccttttctagttcttcttccactgcttttttttccttaatgactcgttcaatttggccttgtttttcagcacactcctataaattcaagtcatattgtaaatatatacatttggtaacatcttaagaaaagtggggaaaaattataatttgttcataatgggaatatcatagttatcaacacaagtttaaggttatattgattaaaaacaaaacaaaactcaatatttgaagagcaacctaacccaggattgcagaaattgcctccagcagtaggatgccaaggagttctaattaaacagactgaggttgggggattccagggagaaaaaaataaatagaacccctttctcatactatagattttcttttcatatactcttatcaagtattttgaaaagggaacatagaaccagatagtggcacaaaaccctcagggataacctatggcctaaaggatatgtgggtgtataaattctaaaaaagttaacttttttctttacaaaaattacagccaacagaaatactaaaaatattttattagcatgaacataaagtatttctgctcaaaagattttactctgtatttagcaagcatatcaattagataataaaatttaacattttgctaatgcacctaaaacaaaaaaatcataattattagttcttcacaattatttgtatttatacatttattctggagaatgggtaatgtgtatggcttgttttttttttttttttttcgtgagacaggtgcacatgtgtatgttaataggacagtaatcagtgcagggggaggtcatctctgccccaccctgtttgcgacccactaaggctggcctccactgcagagtgcccctcattctgtgcatttgcatttctgtcccttttttttaattgttatactttaagttttagggtacatgtgcacaacgtgaaggtttgttacatatgtatacgtgtgccatgttggtgtgctgcacccattaactcatcatttagcattaggtatatctcctaatgctatccctcccctctccccctaccccacaacagtccctggtgtgtgatgttccccttcctgtgtccatgtgttctcattgttcgattcccacctataagtgagaacatgcggtgtttggttttttgtccttgtgatagtttgctgagaatgatggtttccagcttcatccatgtccctacaaaggacatgaactcatccttttttatggctgtatagtattccatggtgtatatgtgccacattttgttaatccagtctatcattgttggacatttgggttggttccaagtctttgctattgtgaatagtggggtatggctttttttcctcttttttttttttcccctaattgtgaatcatgctttggaggaacccactttgctaactgtacactacgtactaatgatgttcaattattttatagaagaagtgtatttcaatatgtttttaaattttaaagtaagcttcttttgtgacccaaaattaatcaccattgatgataatgaagatctttaaacctgttacaaatcagttgacaaatttaaatttaatatcttttattaagatagaaccctgagtgtatacaaaatgcaacattaatattccacatattcatatagtaagttgcttatctaggagagggtagtttcagtgctaaatttgggattttacctacattcgtaactcctcccatgtgatttttaatatatatgttaataacaaagtctggctcacacttctggggctggcaagtggtatataaagaaatgcatgtgtaagtatgcttcatatccctctccacccaatccaccatttcactgacaaatgatgatggcctaaagaatatttggttaacctgggggtaaaaaaggtaaaatgagacagcaaagtttaagcctttagagagaattaccatactaattctagtagaaatgcactataatactaaagcaaacattaaaaattactattacaaagtttttagagatatttgcttatcaccactgacatgcctacctttgggggaaaatatgacaaaataatagatattttttcaggtactcatggagtatttccaaaataatactctataaaagaagtctcaatacatattaagaaccaaccatatagaccatgatctgtgctgccgacctaaccaaatgagaaatcaacaataaaagacagtgtaaatcctcatgtatttagaaactaaaaaaaagacttccaaaaaattcatccatcaaagaaaagatcataatgaacattttatgttacttttgtaagtttgaacattttataattaattttcttatttgatatagattaatagcaatctgctacatggcagaataaaaccttgaatattcttaagataaactacaccttaccagagaaaacaaaggctgttaggtacgtgttggtctccaaagggagatatgtagcttgaaatgtaatggctccggctttttcttaatctattaaataatctgcacactcatctaaaatacaaatttttctccttcctgtgagcataccttacttttggatcagcaaaagtatgcataacttccttcctggacttcatagtgtaaataaatagtatagatggatagtatattatactaatactattagtctagatagtaaaattgttaataatagaaaacaatagcaagcatcaggttattatgcttcaaactgtagcttagattttttgagaaaatctgtcttaaagtagccaaatatgttttcctttgaacatatttttaacataatacttcaaacttttcaattacacagtatagttctccccatagaatcaacatgactatgagatgtttcatatctttagaaaaatcacttagctatgaagtagaattgttttactataagaaacactttttgcaataaactgaaattgtcattctttttactctaaagtgagtttaatatagctctggttgttacacagctaacaacgatttgaaaaatccctggaagtcttagccagtccttgttcccttgagaatacagaaagaatgaatattcatgcccttgcagagtttaccatccattaaatgatcttggactggggtagtacccttctactcctctttttccacaaagatacgaatctcttgatagctaatcagcccatgaaagaaaacaagcaaaataactgggtgatagaaaaggaagcaaaactccacaacaacaaaaaattacatgtcactaactggccacattgcatctcactaattttacttgatgttcctacattattaaaataagtgacattaaacaaacaaatacaaaataaatattccttgttctattacatttgggaccaatacacaatgattaagatcccgtcatgtgctctccaaagtttgtagaatggcgaaagaaaatgtgatccctctttcagagtgtttaaatataccattcagttgataaacatttaaaaatatactctgcaaaacactgtactaggcaagcaacagggaaaataaaggaaggcgtaagactctactatgttgagatgcttacaatctaattgcagaggtaagattttcatggagagagacagagtgtgtatgctcaacatacacctaaagcatgatagttattacaagatatgattcattgctaaattttgtaacagagataaaaagtgatacagggagtcagaaaagatgaaagtttgtgaagttataaacattttctcaattcttgaaaattgttatacttttattctcctataagcaaggttattaaatttcattacatcaaatcttcaagttaaacttctatttccaatctcacctctagccacacaagtattcttttcctctcccctcttggcctactcattcctcagtattcatttctttcaggaagctttctgtatttcttccttcccactgttatatatactttctctttctccttggtttcccagataaactcagcatatgataggagctacagctagcaatagcatcctgtgcattctctgtcaaagacaggtagttacagtaaaatgtgataaatgccatctatctttcctgctagaacataagccacaaggctgctgcaaacatgtctatctggattttcacttttttcttagcacctagccagggcttggtttaataagtatcttttgaatgaatgaatccccaatagtatatatcttggcctttaaaataagtaatatttggaagaaaatatcagtatagtcaaacataccatttgaagggctgaaagttcttctgttaatcgagaaatttgtatattacattgttttttggtgtttgcaacctgtaaattaagacatttactcattatttggttctagaataaaaatgattaatatctgataaaaacactcaggataataattttgataaaaataaaattgtaacttttagggcataaaagacaaataagcacataatatattaaagagccaagaatttgccatgaaagtggaaggagagtgaatagaatggtatatccaaaaggaccgtggttgtcaaacattttggtcataggatgcttttacccacaattaaaaaaaagatcttttgcttataatgggttctatgaaaatctaccatattagaaatgaaaacagaaaatttaaagacatttacctactaatctcttaaaaagtaatttcttaccgattaacctgaacaatatttttataagaaataagtatattctccaaaactaaaaatttttgagaagagtagcatttttaaaatacttttgcaaatttccttaatgtctggctgaatagaagctagattctgatatctccttctgtatcaacctattgtgttgtcacatatcatacagcctctggaaaacaacactgcacacgtgtgagagaatgactgaaaaaggcagatgatgtcttaactacaattatagaagtaggtgtgaccttgtggcctctctgaacaatatttttgagaactgctgctataaagcaagtcaaaatttaattaataacttctaaggttttgggaggccgaggtgggcagatcacgaggtcaggagaccgagaccattctggctaacacagtgaaactccgtctctataaaaaaaaaaatacaaaaaattagccgggcatggtggcaggcacctgtagtcccagctactcgggaggctatggcaggagaatggcgtgaacctgggaggcagagcttgcagtgagccgagatggcgccactgcactccagcctgggcaacagagtgagactccatctcaaaaaaaaaaaacaaaaaaacaaaaaaaaaactttaaaggtgcttttgactcataaacagaatactttttaaataatacacaccacatcccagtattaaattacttttacatatgaagatatttaaattaacatttaataacatttaataagtaacatttaataaaatttaattaacatttaaatatcttcagaaagaagactattaatgtgcacagagcattttgaagagttagtcacatctcatcaggatttcgctatgacaataaatttttctaataactattcatgctttttaaaaggactgtgaagaatactgatgccaatagtatatcatcagtaaattttatgatctaaaggtcttcgagaattttctagtacaagatggactattttgaaaatatgatgtaaactttgtttagaacatttacaatactgccatgtactttatatggttaattaatatgagtgttatctttttgaagacctgccaagcatattatttctgggtctattttagtttttttttttttttttttgagacagagtctcgctctgttgcccaggctggagtgcagggtcgtgatctcagctcacggcaagccccgcctcctgggttcacaccattctcctgcctcagcctccagctgggactacaggcacctgccaccacatccagctaattttttgtatttttagtagagacggggtttcaccgtgttagccaggatggtctcagtctcctgacctcgtgatctgcccacctcggcctcccaaagtgctgggattacaggcgtgagccaccgtgcccggccagctcttttaaaggttataatttgatgtagacttttcctatgaataattatattaagaatcaatgtattctgtttatgaaatcagtaacaataacagatagaatttattgaggattaatgggtgttaggtactattcagagtgctttacatgtattatctcattaattctcacaaaaatccaatgaggttgttattatttccattatagatgaggaagactgaggcagagaaattaagtcataaatgttcctataacataaaaattttggttcttataagcctgtcatgtctgtcgctctctcacataatttctaaaatgtgttcttttcagtatctagaaatgatacagctaacttgagggtttatgtcaataagagggtacatattttgaaatacatttatagtaatcctggcaaagtcagacgaatcaaactactcatgccttttaaaaggactgtgtagaactattgacactgatggtatatcatacgtaaacttctaagctccaaaggtcatatggaatttcctagagttagcatctaatgaaacaaaatgtaaacttttgtcatgtgaggaaacacacatttcagtgaggtagtttactgtgattggggttttgaagtctgtagagggactaatatccttctctcatcctaacctcactttatataagcatttttcctctataattttatgaatagtaaggacatttataaaccaaatagtaagataaactattaagaaataggaaaatccaataatggcaccagccatgatttaaaatcaaaagtgaacaatgtatattttttacaaattttaattatttgagagatatctaagaaataaagtattttcatattttaaagaaataagccacgtcatatttttgttcaattttatagccagaacagaaatatgtgacaatttattcattatatttactttagtcaataggaagagatacatgtaaagttattctcaattcaacaggttaattctacatatttgaaggacatgccgtgaataatttgggattaaatgaaattcacagaacaatgctaaaaatagtgctatctctgggtattaaacttgtaattttaattttcttttatacatatttttcatttatacatattttctcatacatattttccatttctttttacaatgagtatatatcacttttaataataattttaaaagtttacttaaaaaaatcaacttggcaacagtgtggaactcagagggggcaaagacgcagcaaaatgcttggcacacaggaagtgctcaataaatacttcctgagtgaatagctgtaatggcagggaaaggctggctacaggaaatcaacaggaacacctaaggaaggaacaatctgggactgactatgagagtaagttcagtttcagacatgttgagtttcagatgcctggtaggactacatatttgaatagggaaataattggattttaggaagcatctgtattttccgtttgcaaaacatttggaatgaatgagatcacaatgcttttgaaaaattctacttagattatttaaagcttcatgcaaaagatgaccttcatcaacctcaaaatcaatttgaatttattttaggataagaaaatacaattagaggaatgctcataccaagaatactttaataaaatatttttatcattaaaagtataaagtttattaatatttattttaaaaatatgtcatcaagaatattttaggctatagtccaatgttacagtactctcaacttcacaaataggaaagacagagctcctgcagaaaggatatagaagatgacaaattaaaaagcccagggtttactttggactctgccttaaattaaaaattttatcttgggaaactatctaatttcagtcatataagacaaagtaatagatttttttctttacaccatgattctgtaaaagtaatagatttctaagaaatacttctgcaggaagaaatgttgtacagtggctttatggaaataaaaattctaccacttagttgcttgggagaaagcaaacattttaactttattttttctaaactgatggaagttttgaaaaccagtttaaatctacagttcacctaggagagaaataatattgcccacaaaaaatacagataaagaaaaaaaaggaacatctttattttatccagtggagggctatacagtatatcccactatcctactggagataattttaaaggaaaggagcctttactcagttcctttagttagtttttaaacacttaggttaataatttcatatggagtctttataactatgtaggcaagtattttaattttaatttacaaatatttaggtagaatttagtctttagttgtgacttaaattctgaattttaaatataattaaaaatccttacttctttcttggttcttatggtagcatcttgtacaaaccgagaaactgtctctttcattttctctatgtcttcttctttttgcttctcctcaagtagagccttcagaaaataatcatttcatgttatagataacattattattagtaaagataataacaggtgaaaacctatccactagtcacttccttattcaaaacttctgggacatctctacttgaatatcatgttgaaatcacgaatgatatttattttccctaacctcctcacctgcccttgtcctaactaaagacactttctctatggtatttatttcagccagtgtttctaacacccttctaatctctacagccagaaatcttaaaaccattgttgaattttccattttttcaagtccctatataaagtaaataatcaaatctaggtattgtatccttataagaatctcttgaatttctctctctttccattatttagtattattcaaattatgtcactcattaactcataatttgatcattgcagacactacttgttttgtctctttgatgtatttctataattccaatcatttccatcctccaccaaataaatattgccataatcctagctctgctgtcagtcacagtccatttccttgcttctctgagaagcaaaactctgtaacttgttcatctccaagacttttcctctcaatctcttttatactcccttgaatcaggctttcaccaccatgatctccatattgattatctataagtaaattttcagtacttctttaccagcagcacttgaaatatttactttcctctccttgttgtactttctgcatgtgattttcagcacatcacacacagtaccggttttcctcctatctcactgatcattcctcttcagtctacattgctgattcttcctcatctcctgaacctcttaatactggactacccaaggttcacttcttgtccccctctctatctgtccttctcttagtggtctaatcaaatctcacagttttaaatatcatttatatgctgacaatccccatatttacatctctaacacaaacctttttctgggcttggaacttcttcaattaggccaaattgaatccattttaaatcaacatgtaaatggccctgtgttctgttcccaccatcttccaaaggtaccatacacatttttacctctgtttttgtaaaaattgttttttaagataaaattcctccaccttaaacaagtaagctagtgagaagtaacagctgttcttatgtaataaccttgagggggagaaggggaactatgctaggctgtacttcctgccttgtttgtgtgatcggctgggagaacctttgactttgaacaagcaactgaagatgggaaccctctagcaattaagcaatgagtcaaagagcagcttaatattgtaaccatagacagcctctgtgagcgtctgttgacttaagatttgagtgagaagatttgggaggaggatgggcaatgagtgttcctactattttctctgtccactgtgctctacacaagatgtttatttttaatggcttggtataagagtgctcatacaagtaggcttcagagggtagagataaaaattttttcttgaccttaatttttccagctgatttaggtattcgacacaattcccaagcatattatgtctattgtgttcctcttaaccattctaaaagacagtattcagatcacagatgaaaatattagttgaaaggcatgataaacaccttagcatccccacagttaggatttagataattaattctttttttatttatgagcttctcaatatccaacttacactatattctgttttagagctctcttgaaaaatcctctgtaaaaagggaaataaaaataaaacaaagcatttcctttgtacccgtattctgcatatactaggcattcgatgaatgttggtaaataaattaatgatttaatgaactctacataagggaggccgcaaaataaacattaaaacatttgttttgtgacttcaataaacttaaatgtatcattcatagggaagcagtatatgacaaggaacactgtatttgacagcacaggaatcacaattgttagagaattaaaaaagaacagtgacatgaagccttcagtaaataaatctttaaagctaattaagcttccgctttaataaagtaattgagtatatgatgaaggggaatagagacgggtaagatttatcagattcaactgaataaaatatagggtatactgaagtaaagcactgttaacagttttttttttttaagtatgagactacaggggatgaagattagttacgcagcatctgggagaataagaaagtctgatatttatacattattttagaaaagaattgatgttttatcatatgatgatatctggttttaccatccaagaatatggatgattactaatgaaaagagtagcaatttcattttcatgcatttattcaacagctattgaatcccttactgtgaggtcacatgggagaatagtcaacattttattatatctaaacatatttactagctttcttacctgacttttttgaaggttagcttcttctaagagttgcatgctatttctggctcttacaatagcctcatatctctcattttctaattcattgcactttgcttgtagctctctggtctgtttttccagatgtgtattttcggttcttaattggttggcttcttggattgtcacacataatctagaaatcaataattacactgggaaagttaaacttttttaaagggaaggagggagatttactgagcatctactacaggacaggtattatgccagtaactttcacatgtattaatattttctcatttgatactcattacccttctataaagtaggttttactatctccataccttcattttaaagaacaacaaacatacccagagaggttaggcatttgattaagatcatagcgctaatgagcagtggggctgagactaagcctggattttctgatcctaattatgttatacttgttatggtatcacactgtattatatagttacatgacaatgatataaagcaaacccttaagaaatgagttgttctttacatttatatggtcttttctcttttctctcctttcatactctctacccagacaagctatgttaacttactaatgtatatcttaaaataattttctcaatattcatatgatcatatgtacatatatatatatactcatacacatatacacataaatatacacacatattatacatacaggtaatgacaggagctttttaaacttttgttataacaataaaaatcatagtatacacccttttctgtacttgcttttctcatccaataatatagaaatctcatcaagttagaaaggctccttcctttcctagtctaatgaatgtaacctcatttcactgttaatctgtatttctctattagaaagtttaggcatattttcctccttttgtaagccatatggattttgttctttgaatttcttctaatcttctttgcatatttttttccgatgggttgtttactttgctcttccctttataagaactctaaattaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggctcggtggcgggcgcctgtagtcccagctactcgggaggctgaggcaggagaatggcgtgaacccgggaagcggagcttgcagtgagcagagattgcgccactgcagtccgcagtccggcctgggcgacagagcgagactccgtctcaaaaaaaaaaaaaaaaaaaaaagaactctaaattataaatattaacccttagtctgtcctttatgctgcaaatttttttttttccaaatctacttttttgttgttgttgcctattgactctatttagggaatcttcgccacactaaaaatttaatacagctaaatttgactattttttttcaacttttgcgatttcagtttttataaagatggtctccttcatccatagattgtcagtgtaatctcttagatttcctccaaatatttccatgactttaatttttacccctaaatttttaatcctgactcatttgaatttactcctgaatatgatgtaagagaagagtccaatttaagttccagactaatggccagttgtatgaataccattagtaactaatgaatttaaatactcctattatcacccccaaaatatgcaaatatcatatatgcaaatatcataatttactagtagagtatgttgcattgatctacttatttattacatgctcaactcattttaatttgattattgtggctttataacatgtttggtaagatatattttataattttctttgttatttgttattttcagacatttctttttttttaaatagtagaagcagcagccttctctattctccccactaaccacatcaaaaccctcttcctgtcagtcaagtggtttattttctcatgtgtttggtaatttttgattaagttcttatctgtctaaacttaatctgtaggaatcctgaggggtctgtgttcaaaagtatttcccccaaaggtttactgttgcttcttccatgcaccaggactccctaccaatctgttgccactttagtgtttggggctgaggtttccaaatcaacaaatagtataatattaaacaacaggctcatatgagggcagagttatggttacacattctcagagaagactgcaatgattgttatgatttctactttccatttggctacatggtggaaatagttttatttgttggctatcgttgttaagaggcaggatttttttctattttagtcttttaatgagagtgtagttccttcaggggttccagcctgcctaaggacatttaccttcttgcaatattatacagatccagccctgacctccttggcagggaagtcatttatttatcattcttgttttagcttcctgtttttgtttttgtttgtacacttgagaatacccaactatataagttgagcatttaaatgtaattaaacagttcatgctataaagtttttatgctattagcattctaacatgtaagttaaagaaacaactttgaaaacaaatcatgttgtaattgatcaagatgcttacattaagagggtttttttcagaatatttagtctgacatattatgtgaatggaatagtctgcacaatcattattaatcattactttgttttcctccatttctaacctgtgttacagaattgttggtccactcaaatatctgcctcaaatcttaagaacagacgttaattgtatattatgtctactgtatctggcttttgttcttcctttatactgataatattagactttacctgagccaagaaaacagggatggctaagaaatcctcccaccttttttctctaaaccccctctatcattttgtgtttcagaatagagctaacagcataaaacaaccctgctctcgcatattccaacataagacccacctccatcccttctcatgactcccctaagactcatacacaacttgtttatccacctatgtaaaacctcagaccccttccttttctttgaaacattcctcattaatgagcattctccctactgcaatagcctgaataaaataatcttctgaattatctggtacatttggtctttcacagtactaaagactcacccaactaatcttgaagaaaaacaattgtatctaaattctgtttttcaatcactttcatattacttttctcaagctctcatatacatatatcctatggtaacttagcttttaaaatgtcttcagtctaggaagtgaatatttgctgaagaaaggcgaaaaaaatgatttggattctgattaagtaatgaatgatatataaatctgggtgcattctttagtaaatatgggtgaaatctcaaatatcaattcaggtggatagtggcagccaaccaagagtcaattatattattgaataattttctttccctaacaatttaagcatatgagtaatgaaggtcagaaggtagtgggggtgatgatacaagtaagtgatgcctttcagtcagacttcatttaagtttttacttattttttaaaaaccctatttttaatagtagtatccattggtgaattttccctactgatgataatcctttgtatttgtttaaataggtataaatgttgtttaaggacttttctctgtcatctacggagataatcagatatcaccagatactggccactcctagaattccagaacctaaaacactggctggtacaacagtaggtgctcagcacacattgaaaacatgatgcttcacctgtgaatacgaaagtccctcttaggagggagtcttacagacttttcttctaacaatgtatggaaaatcatacctagtcatactggggcatatctcaactatctcttagacctttttctactactcctgttcaataggcataaaaatagaagtttcaagtatgctgcatatgtctcctttatactgcccaaaattaccacaaacaaacatacaaaaattattaaaacttcatttcacttcttttcttctcaaatctaattattattgattccttcaaggaccatacttgttttcctctacctatattagttattctaaatattagtacacaaaaggcattgttaatgtgggaggggcaggcatatatttattgtcacttttattatagtcattgtgtcaaatgaaaagattttattaaacagataaattattcatttatagcaaaataaaatcatcaaagcacttggaaaatgtcatcttttcaagatgacttttagcatctggttaaaaattacttctcagctttagaaaaagacaaatatatattctccctacctaaaataaagtccacaatctaatatgaagtcatgtggctcaacttgtacaaagaaaaaagatttttaaaaaagtactgcatggaccattctgatataccagtgtcccatactcaacagtttgcaactatgatggtattggcatttgaaatgtgtagggacatttggtagttacaatgctaagagatgcgactagaatttagtatttggtgccagggatgctaaacatcctgtagttattggcacagtctcaaacaactaagaattgtctcactcaaaaagccaatactcctgttgaaaaacatgacaccaactgatgatggctatcagggcagagataagtgatgggtaaaggtatccgaagggccattgcaaattagaattcccaagaacacaagggagaacagtactggggagcaggatgcactagcaccttgccttctggaggaccaaaagaattgatgatcaagcttcagcttgcaagatttttctgacatattacgcccaagatgcaaaaagaatctacatttagctcttgaagctaatcctttttgtaggatttatggttcatgattcctaaaaaatagtttttaaaaataacattcctctcctttctttgccttccattttgatggtttatttctactgtaactgtattatttgcagaagtacagaattatagaggggttgaggtaatatcaaatttcctcttaactatgattttaaaattttaaccactctttagaagaaagaaagattttaggttactgagggtcaactatgttcacaccaaactctgcaggatgacctgaggagaaatgaaaataaaggtgtgctttgtgctctgcagtactgatacaaaagcatgatatcaagggttttatttgtttcctaaaaagtactggactaaatttggtacaattattctcattcaaaattaaattaatgtacttagtaaaggttctaaaatcatattaaacaaattatctttgaatatatattcaaagtatagcaatctgttgaatatagtttttaataaacaatgtcgattaaatcagattttacacctatgattatagttttgatttggagtttataaaatatttattctagtaaatatcacacactgaaactctattgtaaaatatcttttaaagcatatcaacaaagctaggtgcatttaacaatttaccttatttctaattgttttatactagactgtaactgctgtaaacgcctatctgatgcttcctctcttccatgggcagacaccacatccttctcctagaaaataaagaaactagaagcttactttgagtatgtgaaaattcaatacaccattatacagcataaagaaaacagctcatgctataaagttattatgctattagcattctaacacttacgttaaaagaaacaatatgactttggaaacaaatcatgtgtataataaaaaggaggggagaacttcatcatcaatcctgtgttaataaaaaatactccaaacagttattgcacatagatttctaccaatatttcaaactatttctatagtacaagtctaacaaaacgagagggatttctatgcagataatgtgcctttagaatatgctctcttaactatattattctatgtctcattaactatcaaggtaatcacagggtctttcttctttgacatagtgatgatttgacctatattaataaattttatttgtatcaactttctaaggaaatttcttgttcatcttttcttgcttcatgtgttaacaaatattttttatgatgccataacttttttttttttttttttttgagacagaatctcaccctgtcgtccaggctgcagtgcggtggtacgatcttggctcactgcaacctctgctgcccaggttcaagtgattctcctggctcagcctcccgagtagctgggattacaggcacctgctactgtgctcagcaaatttttttatttttagtagagacagggtttcaccacattggccaggctggtcttgaactcctgacctcgtgatccacccacctcggcctcccaaagtgctgggattacaggcgtgagccaccgtgcttggccaaatttttttttttttttttttttagagtcttgttatgttacctaggctgcactcaaactccttggatcaagtgatcctcctgtctcagcctctcgagtagctgggactatagatgcacaccaccatgcccagcctaagaatgtcattttaattcctctattgcttttagctatatctgtttgaactattttttagtggttgctgtagagattacaatatgcatcttgaacttacccaatttattcagagttaatatttagataatagttcagagaaaacactgaaaccttgcaacagcatatatccatgtacgatcccagtcctgagtgccattgttgtcatatattacatctgcacactttacaaacccatcaaatacggtgttattagttctgctataagcagccatcttttaaagatattaagagaaaagtatgtacacatgttatttcatatttgccatttctgttgcttttagtttcttcttgtatctgagttgtcatttggtgtcatttccatttagcctaaagaacttccttcagaattttttgaatgcaggtctgctggggacaaactctctcatttttggtttatttgaaaatgcctgtattttgccttcatttttgaagtataacttcactgaatatagaattcttagtattttttttcttcagcatttgaaatatattattctaatactttgtttccacaggtttttttttttcctcccttccagcctttatttttgattcagggggtacatgggcaggtttgctacatgggtaaattgtgtatcgggggtttggtataccgattattttgccacctaggtaatgagcatagtacctgataggtagtttttcagtactcaccctcctcccatcccctaccctccagtagggccagtgtatatcgttccctttagcgtccatttgtactcaatgattagctcccacttgtaagtgaggacatgcggtatttggttttccgttcctgagttaatttgcttaggataatggcctccaactgcatccatattgctgcaaaggacatgatttcattctttttatggctgtgtagtattccatggtgtacacgtaccacattttctttatccagtctgctgctgatgggcatctaggctgatcctatctccttgttattgtgaatagtgctgtgatgaacatacatggacatgtgtcttgatagtagaatgatttatactacttcgttatatacccagtaatgggattgctcagttgaatggcacttctgttttgagttctttgagaaatctccaaacctctttccacagtggctgaactagtttccattcccaccagcagtggataaacattcccttttctcagcaatattgccggcatctgtaattttttgactttgtaatgatagccattctgacaggtgtgagatggtatctcattgcgattttgatttgcatttttctaactcatagtgttgagcattttttcatttgcttgttggccacatgtatatcttcttttgaaaagtgtctgtttatgtccgctgcctactttttaatgtttttttttctcttgtaaatttgtttaagttctttattgatgctggatattacacctttgtcagatgcacagtttgcaaatattttttcccattctgtaggtcgtctgtttactctgttgatagtttcctttggtatgcagaagctctttagtttaattaggtcccacttgtcaatttttgctttttgttggaattgcttttggagtctttgacataaaatctttgccagggcctatgtccagaagtgtttccacagtttcttgatgagaacttagccattaatcttatcattgcctctctgttcaggtcatttttctattgctactttcaggtattctcttcataattggctgtcagtatcattgtgatgtatctcaaagtgattttgtttactcattgagattcttaaattttaatgttttccaccaaatttaggaagttttcagccattatttctttaatttttttctgctcccatccccctccctttggcagttccaattacacttatgttgcattgcttcacattgttctacagatttctgagctcttgttcatttttcttcaatcttttaaactctctgttctttggacagggaaatttctattgatctgacttcaagttcattgattatttcttctgtctttcccaatctatttttgagtccatctagtgaaatttttatttcagttgctgaactttaaagctctagagtttcttttttaaaaattgtgttccagttctcaattaaaattatctatctcttcctagagactttaatttaaaaacagattttaattccttgaacatatatataatagctgacttgaagtctctgtctgctaaatctaacagatcgatccatttaaagtcagtttctaatggcttcctccctcagcacctcccccacaagtataggtcatacttttctgtctagtaatttttgaaaactcaatagtgtagataatacattgcagttactctgtttcgttcttttgagcattaaatttttatttttatttttttagttcaagtagacaattatcttgcttggtcttgaaatttgaaatctgttccacatacagtaggtagcagctgatatctgtaattagttcttactgctttccactgttgcttttataactaggctctgtgcctacataatttgaagatcagtcaagatttgggcagagttagggctcatcatctttgtggttccctcgcttctacagattcccctgtaatatccagctgcctttccagctttgggctttgtcctctgatacttcaaacaataaggaagtcttcagtatgctgatgcttcaattgcacacatttctcgcatgtattcaattataaaaagtagcaaactcaaatatctagttccatacatctctatctttcaaaagtaaatttctcttaggtctctgcctgcttcttcactggcctctctggggtccctcccccacttccatatgcataatttagttgtcaggcatgaatttggtaagaatttacactcagaatttggctctcactttttctgtgtgtttctcttgctgccagtatttcttctttaaatttcctattgctggccgggcgcggtggctcacacctgtaatcccagcactttgggaggctgaggcaggcagatcacaaggtcaggaaactgagatcatcctggctaacacggtgaaaccctgtctctaccaaaaatacaaaaaattagccaggcgtggcggcgtgcacctgtagtcccagctacttgggaggctgaggcaggaggacggcatgaacccgggaggcagagctgacagtgagccgagatcaagccactgcactccagcctgggtgacacagcgagactctgactcaaaaataaaataaaataaaataaaataaatttcctactgcttttctagccctaaactttgacctgggtaccttaagcccatacaaaggtgttttctgaagccacagctgtgggggttgggagaaccatcaggccagacatccaaaatttaacaattcttatttcttttacttctttctgttttgggtgctttctggtgttttaaaaatttatccaagttttaaaattgttacctatgggagggttcttgtaacacttagaaaatctaccattattagaaatctataatcaactttttacagattggaaataaggcttagaaagttacatagctaataagtcccagagtgagaattttcaataattatatctatctaaaactaaagcctgacttttccttgacatccttctgaaatttctctattacatattaaaaagaaccagagtctattgtgtcaataaatactttagtaaataacataaaagtagtattaaatgcttgttttccacctgcaaataaccagttaactgaaacttgatcttgtatcaatttgcgtttcagtaatgatgtgcttaggtgtgattatgacgttctattgaattaggctatagagaatggaaataaaaaattctttataaagttgttttcaataatatagtttagcttcctactttcatattttaagggtattaaaataattaattcatcttctgacaaccctctttaacacctaatccaaaataaatcaacaaaatagaaagaaaactaagcaataggtacccatttgtcttagaaatagaaaataccttctttttcatctgtccctgcagatcttcagtcacattagttaactcttccacttttgctacagcaactctcagctctaatttggcttgcctaaaaaataaagtaaattaataaacactgttttcatagaccactaagaataaaaaattagaatagaaatctgaatttggtaaaatcagttctaactcttgtttatctaaaatggatccatggaataaattttggaagattcctttattactaatgaagtgcatgtagaagatattaaagaggaaaaaatatagctgaatggcgaagggtatgaagtagaggtcatgaatgctgtacttgggtaaattatattatataccaaagtgattcaataagtttcttgaaaaagcactttatcatcttgatacattacctaacaagagctccagtgcactaagaagaatatacttatgtctataatatctttatagatggagatggagatatactgctgattggactttctatgaaaatgaacttaaacttcaataccttgatcattccatagacaccagaagtttgtattatgtaaacacaacataaattaaaacatttgttccaccataatacaatgtttattttcttcagagactgtattggcaacaaatgaaaaagataaatttttttgaacattctaacagaattaaataagtttcaatatcttcttaactcctcataggaaatgattttagaacaataatatgactttcttaaacagaaaaaatgatttttaatatcatcataattaagcattaagtgagtataaaaccctttgattatctaaagaacatacattttcaagaaaaaaatactgtagtgtaggaactgttccctatttcttaattacattttatgtatgtatctaaatgtaaatcatatttgtgctatagaacttacagaaattatttgatgcaaaattcacaagtaaatgttagttcatttccttttgactctttgtctttaaaactgcattacttatatagttataaatttcctacaatagaaaatacaaatctaataatagctgataatatctcaggtagttattagtgccagggactgttgtaaatgctttgcagtcatctcacttgacactcgataataactgtgaattaatactactattatatcaaactgaagtagaggagagcaaggttgatagaggtttactaatatgccctaggattcacaatacgtaataaaactagtatttaatgagtcccctatgacagactgcctaccctcacatggtcctaataatattttatatgatgaggcatttaagaaaatgttttgctttaaattaaccaagattataaaaaaaatcaaacaggccaggtgcggtggctcatgcctgtaatcccagcactttgggaggccgaggtgggaggatcacaaggtcaagagattgagcccatcctgaccaacatagtgaagccccatctctactaaaaatacaaaaattaggtgggtgtgatggcacgcgtgcctgtagtcccagctacttgggaggctgaggcaggagaatcgcttgaacctgggaggcagaggttgcagtgagccgagatcgtgccactgcactccagccaggtgacagagcaagactccatctcaaagaaaaaaaaaaaatcaaacaaaaataggtttttttcatttgcaaaatgattccctaaggacaaaataaaaaccacattattcatgtaaaatctctgcgtcaggctgagagataatttcaggagtatatctacaatctaaatcaacaaatgattctaccagttataaaatcctatatatttttaaaggaaaaacttaaggaataatatatttaagtagtaaggataaaactgagaaaactctgaaaaagcatagcaaccacactgatttggttttcttaccttcagaaaggataaaataattgcttgttctacttgtttcatgggattgctgaacaagtaaaaatagataatgtatattagagtgtcctgtaaactgtaagcaagataaggtcatagcatgatcaaggaaaaaaaaaaaaaaacctgttggagacacaggaagcaaggtacaatgtggagaacactacaggcagggacccaattctgtcactaactagtaatatgtcttaatacaattcacttgaccatgctgcacgtctcaaagacctcatgtccaaaaacagaggtggattaggcaatttgccaagaccaaaattctagaattagattctttccttatttcaatctaattggcctgagtctatttctaagttgtctttcaattgtgtattcctttttcattctttggcccaacctttagcttcattatcactcataagactattccagtagattccaaactcatctcttcactgatggtctcctcttttgttcattctttataatgtatcttatctgttaaaaaaattatctagtaataaaaactcctatttaacaatgattcctggattccacactttttggcataaagtctacactcctctacatataagtctacactcctctactggcatataaggccagtcaacatctagcctcaaagagtctcatctcttgccaattacccccatgtaatttatattccaagtataataaagtactcactcgctgttttctaaacacatccttgtttcttttttcacatgtttggctggactagtcttcttctttttctaaccaattccttaattttgacctagatcaaaaatctccccatcttcaagtcttcactaacttctccttggcaaaaaccctatatctcaatacttataatatataatactttatacattattaattgaacacactgtattgtaatcaatactatagagattctcctttgtggaactgtgagttcataaaaaatatacaatgtaagataattaaaagcaaggatcacatcttattaatttttaaaccttcaggagatagcatagtacctggggcataggagacaagtaaatcaatcataaatgaatgagagggcaaaaggaaaaggtggggggagggagaggggaggggaaggagtagtgggagggaggagagggagagggagggagagagggagagggaaagagagggagagagaaagagagggagagagagaaagagagagagaatgttacagtacaactatatcttgatattttacctagatcttgcacacccaatttaatattcatgtgtgaaaaattctagaaaaataattttatgaacaattattccaaatatatattatctcatattcctttgaaatgaaatctcctgctacataagtaaaaagaaaaaaaataggcactggacttagacctaatttggaagtcattataaaaaaaattctgaaaacattcatattatattatgttcactaaaccacaaatactatttttttggggggaaataagtagtggttttaaatatatttgtttattcccacactgttccatagaacagttagaaagtaagtaaatagttctttatatctacttttggcaggaagtgttgaaaaaaaatctaaaataaaaggcagaaggcctgtcttctagaactgactctaccaacacaaaaggtatgtgaactgggccaatcacttaacctctctgagtcttagtatctataaaatggagataaaaataattttcccatatagctcacagaattataaagttcaaataagttaatacatattaaagcatttaataaattttactgtagtttatacaatgcagctaccatcatcattttgccttttattagattaaattgtcaggaactgtgtagtaaagtattaatttacagctggactgggaaagctctggggatgcctgaatatctagccttgactcttagccagtatacgaacagtgggatttatgatgtgctgtttaaagtatgaatctcttcctgcagcctgcaagttgatttgtttactgataattttcaccaggcataactagatagccaggctaggctatgtgatcagtgtgccagaaaaaatgaccctgatgggaactcctgcctggagctctcctgaagccaagattcattgcacagatcttggtggctcaatgtggagacaaagcatgtctgtatataaataaaggccctagggtgcctatcctgaatgtgttctggacgctagatgcttgcctatgttctttttctggctgcacaatatcctttggcctttaaataaaagccttctgtaagtatgctctgtgcagtcttgtgagttcttttaaatattcaagcttttaaaatttttgaaggaactaacaaaaataattctaatattattttatgaagaaactcaataattatgtttatactatttacatgcaaatgttttagatatatgtctgcctgtgtatgtaattttataaaagtcaagaacagtttaacaaaaaaattttgatttaaaaaaacacaactagttaactattaacaatcttgatgtcataactaccaaaggattttatttttgcttcaaattaatattctaaaaagtacattactttattttcaggtatgcttgttaatccactttatattcctgggatttttcattaatgtattacttcatttcttatgatattaaacagatttgaatgacaacttttttttttttttttgagatggagtctcgctctgttgcccaggctggagtgcagtggtacgatcttggctcactgcaagctccgcctcctgggttcacgccattctcttgcctcagcctcctgagtagctgggactacaggcgcccaccaccacgcctggctaattttttgtatttttcagtagagacggggtttcaccgtgttagccaggacggtctcgatctgctgacctcatggtccgcctgcctcggcctcgcagactgctgggattacaggcatgagccaccacacccggccaacaactttttaaaaataaaactttgttaagcaaaatttaatcaagtataacataaaggataggatataatactagatttaaattataccatcaatttggacagaaattaaaatgctttaattatcaatacacttttttgagacttaacatcaagtacaatgagtctattttaagacaaatttttatgtttcttcctgcactgtcatacaaagagaatcctagaaatgtttatgccttttttgcatacagtgaaaaatggtaagattctcagatataaaagctagtttttgctgatttgatattcttaattttttcctctttaaaataaaaaaatgcacacgttaggtaatttaataaggacttttgtaattacccagtataataaagccaatcatttacacttaaaaactttagaaaatcctgaaacataattttagacaaagttctaaacttttaaaatcactactgcttttaggaaactgagtaagtaccaaaactggataaagttttatttcaaattttttcctcttcccaatctttactggcagtctaataatgaaacctattcaagacagaagggttccaaagaaattctaaaagcagtggatattataatccatacgctgagctatcaaaactttccaaaacagtggctcttcagtttttaaatacgttatttgtatattatttatacacacttgaagttaattcaaaattatacatagtttcaggtaattcaaaattctaatttctatgttagatacaatattctatgatactagtagtagtgtccatactttgtgtgtacgaaagtgagctttttgcaactaatatggataggctttttcacatcatatatggataggctcaatctgagacttactcattcaggacgtctgcaagcagtacttggtcatctctgtttttcagagtctctacaggggattctgatgtatattcactgtcttaaattttacaaaatacctacaagattgacaatttactcttttgtaaacgatgattacaagtctagtcttagagtcatgtaactttgggtaacactgacaaggtgcagaaaatattaattcataatctattattgatcagactattcaaatctcttatgcaacagacatgcttaaaacatgtttacttcatgcctgcaatgtttgaggtgctgcaataatgtggtacaaaacacacaaaggatttttctccttcatagatgatcatatctaccttacccaatttaaactttcagctcaatgtaattatagcgctatagtaatcttgaggagggccacaaagcaagcatatgttaagcaacaaaaaaattaaaataaaacattatgattctgagtatgcagcacatttacatttagctgggagaatattgaagtgagaggtatttaaagcaagaattggcagaggaattatatatctcacaagaagagacagagaaagctttaggaagaaacaagataagcacaagcataaaggtaggtaagtgtagggcttatttagggaagatgagaaataagactgtaaaggccatggggactacaatgtcaatgaccttaattgacagttaagttatctgtatcaatttaaaggcaaatgggaaactgtaccaataatggtatcggagctcagagctgcactttagaaatttaaacctgacatttgtgaaaaagaatagactagaatgatagttctgtctctctctgtaaccaatatgttataataaatgagcaagagggaggaaaagtctaaaccagagtgatgacaacaattctgagagagatggtgtagattttacaaacagaatttaagggattctatgcattcattctttgaacaaatatttattgaatgcttataacatgcccgacactgtgaatataatttggacatgttgagccttaagtgctggtggctcatcagttttttgtttgttttatctctatttcaggagtcctagagttattttactgagcacctacatgtactataccaagtactgtctattgagcacctacatgcaccatacgaagcactgtcttcagcactggtgatgcagtggtaaacaaggaagacaaagcccctgtctcataaagttcatattgtaatggagggagacaggcaacaagtatttcaataaatcaggtaattaaagaaagtgacaatgttacaaagaagatgatacagggaaataggaaagacatgggtcatcaggcacatctatggtagaaatatctgagctacgacctaaaggatgatgaggcaaactgaagaaaacttagggtaggagaattacaggtgaagataattaagaataaatgaaagaatatgagaaagacaaagaaatgacaattaagacggaacgtatcacagagaaaaaagtgtaagataaagtcagagaggaaggtagaggtcagatcacataagggccttctggatatactaggaattttggaatgtgttccaattgcaatgaaaatccactggagggtctgaagcaggtaaatgatgtgatatattgtgtggagaatgaattgcgatggaataagagtgaaagcaggtagaccagagaaaagggtactgcaaacaagagatggtggggtagaggtgatatggatgatgactagatttgtgatcatctgtacatagagccaacacgagcagatgtagagatgaagcaaaggagagcaagcaagcaaaaattctgaggtttgatgatggcattagctagtaagatagagagaccctctactccttcaatcatagccattctacttttataagtttaaattctgaggttccatgtataagatttctttttttaaaaaaggagtttactgtcaaaaaataaaaagtttgaaaaccactgacctagcaattcaattatggaactcaacaaagcaatcaaggtcagaggtgtatacttggaaaacattagggctgaaagtttaaattgggtagggtagatatgatcatctatgaaggagaaaaactgagtcacatggttagaaatctaagaaatgtatacttttcataggtaggataaggaaatgggggaagcaaaagaagcaaaaaacaaaacaaaacaaaacaaaaaaacaagcaacaaaagtcagagaagaaatcatggcataaacacaaaagtcctggtagagaaatgtttaagaaaggtagaaaaaatcatcagttaaggaaaatcaacaaccaaggagaatgagggaggcatttttaagtcataaaaggtaccagtaattcttgaggagaagaatagatggaggggggctgaatccaaactgaagaaaattccaaagagtgactataataaatacagattcttccaagcaacatcaaagaataggaagaagaaagtatctgaggagtcatcagggaggtctatacatctgaagtcttaaaagaaccatgcaaaagagaaactaagatttcaaaacaaaaagaatataaccgaaacatacaggagggaatagaaagaatttgggattgtacagttggcaagaaatgggggtacaatataatagaaagaggagaaagaaagaaatggttactctggtcctagaaattacagcagcaacaacaaaaggcagatttcccaggtctggggggtaaataatccactatttattacaatgttaataacaactcccaaatctattagcaggtaatttgtaagtactgtatatcctacctacagaggttggatactaaagtagaagggaggtgggcaaagacagtaagttatattatattgcaacactgcaaggaaggtaatttcattttcattatagcaatgaggaaactgaagtccatgcagttaaacaacctacccaagtcaatcaccagtaaatggctgttttagtctgagtatctgtgtccctgcaaaattcatatgttgaaatctcatataaatacaaccttcatataactctcaatgtaatgatattaccaggtggggccttttgggaggtgattaggtcatgatagcagtgccctcgaaaatgggattagtgccctcataagagaggcccaagggaggtttgtttgtcccttttacttcgtgaagacaaagagagaaggtgtcatgtataatcaggaaacagcccctcaccaaatcccaaatctgccattttcttaattttgaacttcacggcctccagactgtaataaatacatttctgttgtttatgagctattcagtatgtggcattttgttatagcagccccaatggattaagacaatggcagagccacaataaaaaactagagctgacttcaaagcctatgttttttaaatttcataccacacagaaccacatttttaaagacaggtgtacaaatgtagcgtatctgcaaaagaaagttataaacatcaattaaaatatattttgaaagaaaacagtcatctactcttagaggcaaaagttctgaacaatgatgttatgtatttgttttattcttgccagacccccaaacaagaaatgttaatactaattaactgtggctaaggttccactcttgaccagtgtgttctagaagtctaataatcttcttactgtctcttaaagattgagagaaaaagatatataaacattattgaataaaggtgacagtaatccctttaaataacattaaagtaaaacagtgtgaagaaatagaaaactgacagcaaagccctatttcttatcttaaaacctgttttccatgctcagaaaactagctgccaacacataaggaactgtctggcaattctatgactaagcacatctgctcagggccatttctcacatgggattgtttccaagacacactatgaatcaaaactagtgatccatgaattccagatttccatagcatttttataatagaagacacaatattatttaaattagaacatgaaacatctgagaaaaatctgttagctaaaataaaactattacctggcaaaagtacatgtcttttaaaaaataagatagtatataaaaattatcagcacacacatttttaaagaaaaaatatgcatttgtaaaaaagattaaaaatgaacacaatgaacatatacaaactgtgatttatataatttacctttccagatttaatatgatagagcaatactaagaattgcattcctatcacatcagctctaatgctcttcaatgaaaccacttatatataagtaattttgctagcatattttaaagatgtcctggattttatttcatatttaaatgtcgagagagcactaaacataaaaaatatttaaggctctagcacccagtcaaactttgagattactggtaataaaaacagatttaaaagtcaatacagcttaaatgctggatctataatgagaaacactaaaaatctttttaattcattgtgcaaagcttctattgattatattaaaatgatttttttttccaggtgtgttgttttggaaatcaaacttctaagtggtcacacatttctgtgtagctgaaggagataaaatataattttttaaaataatgacagttcaagaaaataattgtgcccttagaggtcaaagagcaaaggacacaaatagaaaatccacatgaataaattagccttgtctctccaataaagtgtaatttaattatttaattaactgactcactcactcaaaaagtatttttttgagcacctgccatatgtctagtactgtgctagatgatggcaagataaacatcaccagatcataatccacgccttccaggggctcaaagactagtgtagagagatggatttgtaaacacttaataaagtgttaaaaatgctgtgacatggtaagatatcagatctaaccaactgcatcttgcttctaacctccaaactctctttgtccattcctgggcataggctgaactagccttgggaaggaatttagtttatagtttaaatagcccttcccaaaagctagactgttattgtaaaatgaatgaaaggccactagccaccaagttaggataagaggggctggaattctaaatattaccagccatttagtctggaggtcgtaagatttgcaacttccccaattactcttgaagataacattactagtgtgaacctaaaattgtccttttaagatgtctttccaggtttttgcatttctgacagccggatggccccacctggacctgccaaccgtttctgtggcccctacccaggaactgactcagcattaagaggacagcttcgagtccctacaatttcatcctcgagccaaccaatcagcactcctgactcactggccccctacccgccaaattatccttaaaaactctgatccctgagtttttggggagactgatttgaataataataaaactctgctctcccacaaaaaaaaaaaagaaaaaaaaagaaaaaaatgttgtgacagatgtatgtgcagtctacagtcgaggcacacaggaagaaggcatgtttggtactacaggagactcaagctgagtaatctgtcaaactgaataatttggattatatcctataggcatttagtagccattgaaggagagtgacatgatcggacatattttagaaagatcactttgataacagtatgagaaaggaagatgggtacagtaagctaatttagaggttactactgcagctcagatgagaaagtgatgaagtgaaagatcagagagacatttataaggtagagttgggacagaaaagaatttatgatgtctcctagttttctgaatcaggaattggatggtacaattcacaaatatggagaaaagatctgagagataatgataagcttactttggagcctgctgcttttcaggtgcctctgagccatgtgggtagagataaccaggagaaccctgagctagaaaaatttaatgagatctcatcctcacagaaactgtcgaagctacgaaagtgtgcatgagatgaaatgggtcaaattaaaacaactttgaggctatcacattatacataaacttattataaagactgtttctaccttcagagcacagatgtacatgtttaagttctcaatgaatataaaataaattgattggacaaattataggctccttacatgaatataatatctatgtctgttaatgagataagtccttagtggctaagttattattattattttgagatggagtcttgctctgttgcccaggctggagtacaatggcacaatctcaggtcactgcaacctctgcctcctgggttcaagcaattctcctgtctcagtctcctgagtagctgggattacaggctcccatcaccatgcccggctaatttttgtatttttagaagagacggggtttcaccatgttggccaggttggtctcaaactcctgacctcaggtgatccacccgccttggcctccgaaagtgctgagattacaggcatgagctaccgcacctggccagctaaaattatttttaacaaatattctgatgatgccactctgatgagaagttaataaggaccccatgcaaatgctttacttagtcttttttgtttgtttgtttgagacggattttcactcttgttgcccaggctggagtgcaatggcacgatctcggctcaccgcaacctccacctcccaggttcaagtgattctcctgcctcagcttccctagtagctgggattataggcatatgccaccacgtccggctaattttgtatttttagtagagatggggtttctccatgttggtcaggctggtctcaaactcccgacctcaggtgatccgcccgcctcagcctcccaaagtgctaggattacaggcgtgagccactgcgcccggccactacttagtctttatagtacatccttttaaaagataacattggttattcctagaaagatataataaatgacaatctttcccttcgaagactttacaaggcaggcataaaatctgagcacatgagagttggaaaataattatcatcataactcagttggatatatattataaataaatgtataagacaaaaaaagcacctctggaaaaacagtataaatctcagtttaaatgaataaatactgagtaggttcacaagaataaaaaagtaaaaatctggtagaatgaatgagagaagtctttctggagaaggcaagttttagctaggtttagaaaattataaattttctgagaaacagaatgatctaaggcaaaaaggaagttaccaaaagttgttctgcgggaaacagcaatatgactatttttctgtataactggaggtttgaggaggatcaggtgaatgaaggttcttaagaaaataggctgaaaagttttatctactatgacaaggtatcaccaaaaactctcaaaatgaaatatgattaaagctttaattataagttcacatgattttaacttttttgcaccacactatcagacaacaaatgaaactaatatgtttcagtataagtacaaacttaaacaactctagtacttaaggagtttctaatttagttattcttggcatggctatatagagcatctcaaaacctaaattctggtaatgtcaatatgcccatcattcagaatctgtcatacttgaaagcaacactctcttccgtaaaagaagcatctgtttatccttatgttccttcaaatctgtggcaggaaaagcaagtatagttttatgtatacaactctgaactgcttaatgttaagctatggaatactgtcagtaaatattatggcaaagttgttcatggacaattaaacacttaagacgttttaggctttggaaaactgcaactagttttatcaatctctaaactcaatttataatccttaggccctaatgtccacactaaatgaatcttccaggcagatgtcaaaaatcaaagtatctactcatcatacttttttcccctgcaatcaactctgctacttgacttcctcactgctgtgaatactgtcagagagccaggcttagaagctcactagattagcagttacaagatgtgagttctaatttggcttttccatgaatttgttgtgcaactctggacaagacaaatagtttctaagcctttggttcactttgagttttctataaaattaggaagtcaaactagatgaacattaagataccttctagcaataaaatttcatgattcttcccctgtcctttagctcaatattacgaagttctgcccatttttcctatatagatttttttatatgcatttttattctctatttccattactataatatgattgcaggtctttatgaaccagtttccttactcatccttccaggatctctaccttctaatttatcctacatatgccaaaaatcttatatcctttttttcctcccactcttttcttaaccttgaatgtaaagttgaatttttacactattcattccatgacctattatcattatcagctgtaaaagatattctcatttgtttatttttgtttttttgctcattcccaatccctttctcattctcctccatttcataagttcatactaaaatgtgatatatcctcagatatacacatttactggtaaaatatatattgttattacaagcatatgttttatgctatagatccatatattttactttttaaatataaacactgttttctagttctacccatgttgctctaactacatctttacatgtaaatatgtgtttctaaatgatgcacagtattccttccacaggatgtaattatcacattttactgttcattcccttagtgacaaatacctaggttgccttcaattctctacttccacaaatagcctcattccacagagacaatcattaacttgaagtaaggatatatcatttctgggaatggaactttattctcttgtaatacacacacacatacactacatatatatgtaacagatatataatttttactacatattttgaatatatattgatatatccatatacatatatcgatgatcaatacacactattgtttaaaagatttaaactgtatcacactgtaattttttggcctctttattacactccacatttttacattgattgctgagtgtgaagtagtatcatgtttttacttgcattttcctgattgctgtaacttttgaaatgcttattcatatcgtttgcctaattttcgatgagttaattattctcattgatacttaatcagttaatgtgtccttaacactaatctgttgtgttacaatacacgcattgtaaatgtcttctcactgactatgagttgtcttttcatttgacttatattgtttttgtaacagaagcctaatatcttaacatatacaagtaaagaaatcttttcctttttggcttgtatttaaatcttttgtttttttcatgacaggctaattttaatttttgtagagatggggtttcaccatgttggccaggctggtctcgaactcctgaccttaggtgatctgtccgcctcagcctcccaaagtgctgggattacaggcataagccactgtgcccagcctaaatctcgattaagaaatatttctctaaggagaggaagcagagcaagatggctgagtagaactctccaacaaccattcccctgcaaaaataacaaattgaatgaccacccacataagaaagcaccttcataagaaccaaaaaatcatgtgagtgatcacaatacctggtttgaacataatatcaaggaaagaggtaccgatgagtgtaggaaagacagtttttcattacccatacaaactgcccccagccccaggcagtgcagagtggacagataatttgtgtgctagggggagggagagtgaagtaagtgttgaactttgcattagaattcagtgctgccctgtcacagtggaacacaacataggctagaattccaccagcacccatggagggagcatttagaccagccccaggccagagaagaattcaccgtcccagtgggagaaaaccaagtctttgctgccttcaccaccactgactaaagtagcctgggcctggaataaatttaagtggcagtcaggccacaaggactgcagtcctaaggcaagccctggtgctgcactggtctcagaggcagtgcacttagggtacaatacagtgtgaccagcagtggcagccaaaggattgcctgtgtcatcccttcccaaactccaggcagtactgctccaaagagactctttctgctcagggaaaggggaagaaagagtatagaggactgtgtcttgcaacttgaggacgagctcagccacagtaaaggcaccaagcagatttctgaagtcccagattctagatttttgcacctggatgcgtttctagactcactctgtgctagaagagaatccactcctctgatgggatggaccccatcctagcagaattcatgccctgctaactgaagtggtcctgggccttgaataaacatcaggcagtggtggctgcaggccttgggttagccccggtattgtactggtctgaagggattcgggtgtgactctgtgtagtgctagctgtggtagccatgagagtgggcacgtcacctctccccaactccagacagcacagtgtacagagagactccttctgactggggaaggagtaagagactttgcctggttacccagggaattatccctcatcttaccgaagtctagcaagtctgtgtatgtaggaggatctaagagctgcagcattcctaggcttaggaatctaagcctaggaatggttctgaaatggcttctgcaatgttctgaaatggctgcaatgttctgaaatggctgcaataattgcaggcttaggccaaaacactcaatctcttttggattcgtggaaagcccactctagaaggaagaatacaaacaagccaagactgcaaaaattataatacctaactcttcattgctcagataccgatgagcatccacaagcacgaagaacatccagaaaaacatgacttatcagatgaactaaataaggcaccagtgtgaccaatcctagagtgacggagatatgtgacatttcacacaaggaattcaaagtattaattgctgttttggggaagctcaacaaatttcaagacaacagaaggaattcagaatcccatcagaaatttgacaaagattgaaataattttttaaaagtcatgtagaaattctggagttgaaaaatcccattgaaaaactgacaaatgcatcactctctcaaaagcagaactgatcaatcagaagaatccatgagcttggagaaaggctatatgaaaatacacactcagaggtgaaaaaaaagaatgaaacatgcctacaagatctttaaaacagtcttaaaggggcaaatctaagagttactggtctcaaagaggatgtactaagagagatgagagtagaaagtttattcaaagacataataacagagaactttccaaacccacagaaagatatgactatccaggtacaagaaggtcaaagaacacccagcagattcaagacaaataagactacttcaggacatacaataatcaaagtctcaaaggtcaaggataaaggatcttaaaagcagcaagagaagagaagcaaataatatgtaaaagcaaaattgtctttcaaacatagaggagaaatgaaaactttcacagaaaaaaaaaagcttatgaattttgtcaacaccgaacctgtcttacaagaaatgttaaagggagttcttcaattcaaaagaaaaggatgtttattagtaacaagaaatcatctgaagatataaaactcactggcaatagtaagtacacagacaaatacagaatattctaactctgtttagactcctttaattgtaatggtggtgtataaaccactaatacctttcatcagaagactagaagacagacttaccaaaaattataaatactacaacttttgaagagatagacaatataaaatatatgtaaatagagacaacaaatcaaaaagcaggggagatgaagttaaagttggagttttaaattctctttgcttatttttctttataatcagagttaagttgtcatcagtttaaaacaattggtcatagtatttgcaagcctcatggtaaccacaaaaacaaaaacctataatagatacaaaaaaacctgaaaagccaagaaattaaaatatactacaagagaaagtcacttttacacaaaggaagacagaaaggaaggaagagaggaccaacaatacaaccccagaaaaaaagtaacaaaatggcagtagtgagtcctttcctattactaataacattaaatgtaactggactaaattctccaataaaaaaaagagtagctgaatggataaaaaataagacctaatcatatgctgcctacgagaaactcatttcatctataaagacacccaaagactgaaaatacaggaatggaaaaagacagtccatgcaaacagaaaccccaaaagagcaagagtagctatacttacaccagataaaatagatttcaagacaaaaattgtaaagagagtcaaaaatgttattatataatgataaaggggtcaatcccacaagaggatataagaattgtagatatatatgtactcaatgctggaacatccagataatataaagcaaatattagaactaaagataaagttagacaccaataaaataacagctgagaacttcaacacccctctttcagaattggacagataatctacatagaataccaacaaagaaacatcagattaaatttgtactatagactacattgacctaataaacatttacagaatatttcatccaacaggtgaaaaatatatgtttttcttctcagtatattaaacagtctcaaggacagaacatatattaggccataaaacaagtccccaaaattcaaacaagctgaaatcatataaagtatcttttctgactacaaaggaataaaactaaaattcagtaacaagaggaacttgaaaaccacacaaacaaggaaattaaacaatacgctcctaaatgaccattgggtcaattaaccaatttagaaggaaatttaaaaatttgttgagacaaataaaaatagaaacacaatgtatcacaacctatagatacagcaaaagcagtactaaaagtgaagtttatagcaatagatacctccatcaaaaagtagaaaaacttcaaataaacaacctaaggatatatcttaaagaactggaaaagcaagagaaaaccaaactcaacattagtataagaaataataaagagcagagcagaaataaataaaattcagactaaaaaatacaaaagataagtgaaaaaaagttgtttttttaagacaaacaaaatcaataaacctttagccaatccaaaaaaaaatacagaagactcaggtaaataaaatgagatgaaggagatattacaactgaaaccacaaaaattcaaaatatcataagaaactattatgagcaactatatgccaataaattagaaaatctagaagaaatgaataaattcctagaaacatccaacctaccaagatttaaccatgaagaaatacaaaacttgaatagaccaataacaaacaaggagatagaagtggcaataaaaaaatctcccatcaaagaaaagactaggacttgatgtcttcattgctggattctgttgaacatttaaagaagaaataataccaatcctactctaactattccaaaaaattgtgaaaggaatacttccaaacttattctatgaagtcagtatcaccctgctaccaaaaccagacaaagacacaacaaaataaggaaagctataggccaacatctctgatgaacacagatgcaaaaatcctcaacaaaatattaggaaactcaattcaacaacacattaaagagatcattcttcatgatcaagtgggattcatcccagggatgcatggatggttcaacatgtgaaaatcaataaatgtgatgtatcaacaaaagacaaaaaccatatgataatttcaattgatgctgaaaaagtatttgataaaattcaacatctctttgtgataaaaactctaaagaaaacctgggtataggagaaacatatctcaacaaagtaaaagtcatgtatgacaaacccacgggtaatatcatactgaatggggaaaaactgaaagcctttctgctaatatctggaacaagacaaggatacctactttcaccactgttattcaacacagtatgaggagtcctagccaaaacagtcagacaagggaaagaaatgaagggagcccaaattggaaaggaagaagtcaaattatccttgtttgcagatgacatgatcttatatttagaaaaacctaaagattcaaccaacaaaactattagattggataaattaagttgccacatacaagatcaacgaacaaaaatcagtattatttccatatgccaactgaacagtctgaaaaaaaaaacaagaaagtaatcccatttacaatagctacaaataaaacaaaatactcaggaacaaaaaaccaaagaagtaaaataactctaaaagaaaactataaaactctgatgaaagaaattgaagatgacacaaaacaatggaaagatattccatgttcatgaatcagaagaatcaacattgttaaaatatccatagtacccaaagcaatcaaatctatagattaaatgcaatcaaaataccaatgacattctttacagaaatagaaaaaaaatcctaaaatttaaagggaaccaaacaagacacagaatagccaaagcaatcctgagcaaagagaacaaagctagaggcatcacattaactgacttcaaattatactacaaatgtatagtaaccaaaacagaatggtactggcataaaaacagacacagatgaactgaacagagaacccagaaataaatcaatgcatttatagtcaacgcattttcaacccctatctcttgccatataccaaaatcaaatcaaactgtatcaaagactaaatctaagacctgaaactatgaaactactagaagaaaatgttggggaaacactccagacattcatctgggtaaagatttcttgaggaggacttcaaaagtacaggcaaccaaagcaaaaatgtacatatgggatcgtatcaagctaaaaagcttctggacagcaaaggaaacaataagtaaataaaaaaacccacagaatggaagaaaatatttgtaaactacccactggacaagggattaataaccagaattggaatatataaggagctaaaacaactcgagaggaagaaaaagaacaaataatgggcaaaatacctgaatagtaattttgcaaaagaagacatacaaataaatggacaataggtatatgaaaaaatgctcagatgatttgtgggttccccattcgtggattcaaccaattgcagattgaaaatattttttaaaacaataaaaaataaaaatttttaaacaatacagtatataatctatttgcatttacattatactaggtattataagttatcagattatttaaaatatatgggaagatgtgcataggctatatacaaatactttgtcattttatataaaggacttgaacatctgtgtatttaaaggtctgactgtatatcacagttatctcctaataatcttgatttcagtttcttcccatcctaacagatcatatacacaagaagatattggcagaagcttaacaaaaggaaggcaaaaaaacacccatggggaaaattatagcatcatcagctcccctgaagaaaaataattaacaatgaaataatgaaactcatttttgaaaatacctaagtttttttcggagttgttcgattatcacactttgttcagttactgttttcagaaactgttggttagtctgccacaagaaaaaaaaagaatcagtattagaatatttaataactgtatctttaaagatgacacatcagacatacaagtagaaaaaaagtttagtgagatttatgataaagattagattttttgagggtaaaacataaccttggccttctttccttgcctttactacttcattggatacctgcttcacttgaaactacctacacctgcattcctgtcttatggctttctttggctatctgaatctcttttgctcatctatccacctgggcataaagctataagtgttatagaactaatgttccaccctgttctgagcagcctgacatgtctgaagggaactggtatataaaaaacccaaactcccttcttgcatgggtgaaataattctgaggcttgtgttctacactgtctttcagaattcattaagttttagttactcacagtgttaacttgcttaattttaaaaagccctttattggctgtcttctcttctcttgataccacttccccaccttcttactggtgctccctggtattacctactaaataaatgacacgttttggaactttttcctgaaggtcagcttctggagaaatccacagtaagatatgaagtagtcttctagatgtagaaaaacttttcctaagggaattgattttcttccataactgctggttttatccatgatgatacaaattccttatcccttttctttatatattatggttgctcccgattgatcttaatagttttgatttaatcctgtcccaacataccatgcttaaatttctccaactaaagtccctgagatagctttcattgtgcttctctcatgctctgagctcactgacttcatatttttaacatactatcgtattttcctctgcccaggatgtcctcattctgtctgcattcattcctcaataccatgtgtggtttactcattctcaggtagaattaactgtttcctttctgtactttgataaaacttaatacatgcctttacagtgcacattatatttaaatattaaagtgtaggtattcctgactaaaatatgagcctttttaaaggatcagcttttcccagaactcctagtgcctggcacatgattgagtacatcacaggcacaactagtgttttattatatatactgccttggcactagcataattaatgcttgtgtttttgaccatttgggaacacctcaaagatagaattacatagagcaattaacagaagtataagctaaaattctgcattttaagaatctagtgctggaaaccaaggtgcttaacttgctagcaagcctagtaagagctccgcaactgcatctgaatatggcattgttgttctatatttatgaccataaagaaaattatgtactatattaatattttagaattaggagactcgagaaggtgcagggaagcatccttttcaaccatcatctatttagcacctttttcactgattatttcatatgtcagcctgttttaccacggagacagagattttatggttgatgcatttttgcaacttagagaacctatactttcatgcaggatagttagtatgcaattaaatatttttgagtaaattatagagatgagcaaatcttaaaaaacatttcagtaaagcaaacctatgggaaatgtaaaattataatctatctacagcataataaatagaaatatatacttttatgtaccattcatgtcagagcatatctattgcatattactaatttgcattggtaaagaaagatatttatttgtatcaatttgtagtaagaatacttacatgagttatgcacttttaaaacatgtttaagtgtacaatacgttattgctgactacaggtacaatattgcacagatctctagaggttattcatcttgtttgaccgaaacttcatgtgtgttgattagtaagtccccatttcttctcaccaaaggccctggaagtcaccattccaatctctgtttctataaatctgtctactatagatacttcgtataagtaaaatcatacagtgtttagtctttctgtgactggcttatttcatttaatgctctcaaagtttattcatgttatcacatattgcataatttccttctttttaaaggctgaatagcattccactgtatgtttatacattttaatccactcctctttgatggacatctaaggttgttttcgtatcttggctaatgtgaatatgctgcaataagcacaggaatgctaatatctcttcaagatcttaatttcaatacgttgggataaatattcagaagtgggatttctggatcatatggtagttatatttttatttttttgaggaaactctatactgtgttccatggcagatgcaccgttttgcaatcccaccaaaaatgttcaaggtttccaatttttccacatcctcttcaacacgtgttgtcttttttgttttgataataatccctctgacacgtgtgaggtgatacatcattgtagttttagtatttatgtttccctaatgtttagtgacatcgagcattgggcatttcttcacatacccattgccttggaaaaatacctatttaagtacttagctcatttaaaaatcaacttattaggtttttttgtgtgtcttttgttttttactgctgagttatagaaattccttaaatactttggagattattcccttattggatatacggtctgcaaatattttgtcccattccataggttgccttttcactctgctggtttcgtttgctgtgcaaaaactttttggtttgatgcagtcccacttgattacttttttcctgctgtctgtacttttggtgtcatatccatgaaatcgttgccaagaccgatgccatggagattttcccctaggttttcttctaagaactttataagtaagaggtgttagatttaagtctttaatccattttgggttgatatttgtgtgttgtgtaagataagagtccaaaatcatgttttgaatacgaatatctagatttcccaactccatttttaattccgttattgtgttctttaggtccataatttgtgtgctactttttaatattttttctctgttgcaactctcactttgttcatacattgttcttttaactgtggtgagcatcttcatgagagttatttttaattccctatcaggtaattcataacttcttttcattaggattggtttctggagatttatcttatttctttgtatggaacatctttagctggttcttcatttttccttgactttgtgctcacgtccgtacattagagaaagcaggcacctctcccagtcttcacagattagtgtcatacaagagaagacccccacaaatcagctggccagagattcagcaggcctctaccaactctttccctccccagggagatgctggcagctgtggctttgtctgcttgctctgtgatgagctggggggtagggaactatagcatgtatcagcccaatctgctgtctctgttcttccctaggtgtctagaccatgctggacctattagagcttcgtgagacagatgctatttctctgggctgccctagagaagctgcagtgctggatcaacttttcccctccctaggggaaagttgagaactgaattttcatctacttactctgtgctgagaagagcacaggaccaatgccaactatcagtccaaaccaatgcctccattctcccttggttggccagactatgctggatctgtgagctccgagactggcaagatagaggccagtattctggggaccaccctcagaaaatttggggtgatgaatgcacatacctaatcccttccctcccctgggtgaagctgggagctaaggggtctttttttgatcacatggcacggcactggggacagggtgcctagcaagagagggtctcaaatctccctgctagctttggtgagtctggttttccaatcccccaggaagtgagaacatttccattcatttctgatttattgcaaaggaaatttgtccatgaattgttgctgaattggtgtatctgtggggagaaggagtgtccaggatgtcctactctgccatgttagtcaaattatattgaaagacagtttatttactcactgcatactcatcaatttattctacatctataaaaatctattcatttaatgagtttattcgtgtaatcagaaaattttttgttggaaacttcttgatttttaaagggcacttttcttcaagtttgatcttgactcatacttgcccccataactatgttctgaatgctctttgaactgtacaagatcttatcactttgcttgctccctttatacttatcagtcttgtttgctattcattatatacattaagaacaacttaaattttaaaatttctttcaaccatttacttttatcttaaccacctatatagtcttttctatatttttataaaactctcttttattcatcatgccatttctttatcagttttctcgtatccagtttattcttagctctgacctggaaccatgaatacttctgccttagaaatttttaacatattcccttggaatatacaacatccttttcccatgactttctttcatcaaaatcataataaaataggggctctgtgatatgatatatcaaagaatgatacaattccaattctaggagacatattgaagaagtaatgaataattatgatgctaggttaaagtactaattccatatagaaatatattaaattaaaaaatgcctttcttaattatagaaatcagtaaccattttgttctggagtactagtattttaaaactctaagaagtataatatagtatcaaaaactgtatgtaattagacacttcaaatgttaacagaataggtacagattggtttaataattttttacatggttaaaaaagaaaaatttttaaagtagaataaaattggatacttacttttgatagcacaaatccattgttatacaaagacatttttattaggtactaacaagaattagcagagtaactaagcaagaatgaagaagggaaagagagaggaattacctgaagtgtcataattctattactcaacaatgaggtaaaaataacattccaagaaagtaaagaaaacaaaagtgagagaataagaaggtaaagagcagaactggaaagactaattctatttattttaggagaaacttatagggaaatttaggagtaccataccaacacatggtccttagtttcctaaaactttttaggcaatgggctattaattcattaaacaattacactattcttattaaatacctggcagtgtgtcaggtgaaataaaaaaaattaagcatgtactctactcttgaggaactcactgtctagattagtctaaggagaccttactaagaatcctaagaggatttccagattaagatatatttcagagagatgttagatctccaaaaggtactgtaaactgtgtcatgctattgaatgagaaagcaaaagcaaaagaaaaaacagtattatctaatttcgtgcagcatgcttattgttgatttatattaacataaataaatatgattatttatagggacaatttctagtttatataaataagtatacttaccacttccatgttctcattagtaacatgaagttgtttggtcagttgttgaaaatcaaatagctgatcctacagtgggaaggtaaggggagtatataaatagcattttgttgtttataacccatatttaaaattaaactaaaatcaagtctaaaatcattatgcctaagtttagataaaattagtagtgtttcttattactattgtgtgaattagtagttgaaaaactaagaaattttttaaatgattaaaaaattaaagtggcaatgctgaaattaatgtggctgtttattttatgtcaaataattatttctagaaatcatttattaaatattattttaaaacttgaagaaagagatcataaaaaattataagtgattagaaattctaaatgctagagagaccttgtccaatattggaacgtcactttcaaacctactcaaaacctataatacaaaccatggcacaggagttactgcccaccttttttaaaaacattctcatgccccacattttaaaaattgtttgattagctgttatgattctattaaacattatttgtacagacgacacaaagttgggagaggctgtaaatatactgaaagacagaattaaatagataaccagggaaaaaagaatgaagtgctatttgtaaagtcttgtataaggacccatcaaactatgtagctatagtaaaagaatgatattattcaggtgaaaacaaaacaaaaacccaaccttgtgggcttagttgattgacctaaatgaggaaacagtcctcaaagaacttaatatgaaaaatggtttttaaatctcagaggtaaaagtccaacaaatcagattgattacatgtggactttttttcaagccagggcatgtaaagaaaaatcattttgtaaactgtaaagcatcacataagtatttttacaatttctttaggtagatatttctaattataattacaataataggaatattcattaaccagaatttgaaaagtctgtaaatgagagctgaagagaggtatgaaaaccaacttatttaaagagcttcctctcaaaatacatagaaaagaggtcagaattagaattcctccatagtgctcaatgcacctagcaataaaagaaccaacagaagaataaaagaggtagatttccaaatggaatagatggccttgtgagataatgagttcttgtcaatagacgtgtaaagcaaaagctaaagctagatgtccactttgaaagagtgtagaatgattcttgctttgggtagaaaaaagtcttttaataaccattaagataccttcctgttgtaaaattctattctgattaatttatgatagacaaaattgacacctattttagtaacaggtcacatttaagggtattaacatttgattttacatagtgtttccactgtatttgagcaggtttcttcactggccataaactaataaacaattttgttttgttttgttttaaaagtcaggtaggaaatcaagcaaataaaaactttgaaggtttatttatacaaaataatgttaaagttgctctttagcactaaattcagctttcattgctgacaacattatagaaccaaatgatcactgtccagttctctaattagtttacctgttcaatagtgtaaccatcaaagatctatatattattaacataaataataaagtgattagaaattctaaatgctatagggtagagtcttaagcgttcccctctaaaacagtttcttcagagtgcaatttcttattgatatacaagaaaatgatgaaatccaagattaccttttgtttttgactttcaaatacatgaatctgggcctcagtcatatgttcctggtaaagcttgtgtagtctgtccaactcctgagaaacagtctgccagagttccacagcctgagttttttcctattaaaaaagtttgataactcattaaattatcagcaggctatttattgtatagtacaaatggatcattttcttttatagaataagttcttataaagtcataaaataaaatagaactgtgtaaagatggtattatagttatatttttgatatgaagttttattattaataatttagagagtaaacttgaagacataaagttccttattttgaaattgtggttttactcagatttagctaaaattaaaatccttaacagagatgtagatttaaaccatgttctttgttccacaagaaagtataagccctagaaactgatgaagaagaaaactgcctcctggtaaagtacaatatttttttcctgatcataaaagtaataaattttcattgtggaaaattaggaaaatacagagaaaaacaggagaaaatcagaatcacctataattttactacctgataataaatattgctaatatctagataaatcatctttttaaatgttgatgcattcatgtttataaatgtgattctgggtgagaattttgtaattattttaacaaaattagggacaatatagtgggctatttttacttgccattttataatgattttataattataattttctcaggtcactattgtttgcatacagtattatctaagtgtggtacagaaacttttaaactttgaaaggtcctagaagtcaaatttatcttcagaataatatgttaacatttttcgcctttttactctcatcctctcacaaatgtacagtgaagttttctaaagtttatatgatgtgatgccatccttgctctaagggctaatggactacatgcttatgctcctactttttttttaagtctcagttttaatttgtaatacaataaatactgatagatatgtaacccacaaaaaacataaggcaccttggagtacactgaggtataccatgcattcagaaaatgaacaaattgtacatttttataaagcaagtgcgcttatgtaaccagcacccagttcaagagaaagaacattaccatcacctagaagctggacgaccctcttgtgatctcttccagttactatactcttctcctaaataaccatttcctcgtgttcctaacaccatagattagttttgtctaaaacttaaaaaaaaaaacaaaaactgtaggctaattaaaaattttaaaagcggttttaaaatttgtagataaacacagaatatggagccagaagatatgggtgtgatctctaattcctggctaaatagtcctggataattcacttcatttccttaagactcaagttttcttttcagtaaaatggtcgtaaaaatgcctcatacctcaaaatgtcccactgtttctccagacctgtctgacgacaaaaatcacctagactagtagttacacaacccagattctcctagagcagtggttcttaaaggatcagcatcatcagcaacacctcagaactgttagagatgtaaattattgagctctttcccagacttcttgaatcagaaactggggtggtgggggggtggggaggcacagcagaaatccatgtttcaaaaagccctcaagtgattatgatgtacactatataatttttaaaaatggtacaacttactatttggacaaactacaatttaactgattccatatttaagatttttaaactatgtcaaatgtttcattacgataaatattataatgaatatatttattcaaaaatttttatattcagttctttagaacaaattcataaaatctatgtggtgtcatcatctaattactggatcaaataatgcaaacatttctaaggctcttcttccaaactgacttctagaaagatttctacaaatcatactgtaacagaaaaaatattttaaactgaaaatattaagctaggtacttagcattgtgctattgctattggctcctaaagcaacatatatacactacacagcaccttttgtacataattttaattcttatttgtgagtcttgctgttcaataatgataataatgataaataggcaaatttattaacgtacatatgtgctagacatataagcctaaattaatttctatttaatcccatgaaatcaattataaatctttcctagtctagaacaaacagcatgctttcctcattatttctttctttcatcatatttaaaaattctttccattcatacattaaaaaaaattagtgttaaatacatgttccttatcaagctaaatatagcctttctgacttacctaaaatatcactttcataattatagaattttaaaaccaaattttcaggaaataaaaccgaattttcagataattatcaaatcaaaattgtaatttagaatttgtagcccccatttataaatgaggaaactgaggcacaagagtttttttctatgatcacacacctggaaagtagaagaatggggatttaaacccatacaagatatgaaacatttgggatataacactgtaaatttaaatacaattcccttatgaataaaattcacaaaaaattagttgaaaaacaggatatatttaacatagctgctcaaagattctaattactatgagagaaaaagaaaaagtataattctagaagaaatataatgttagaaaaatatagtactcttaatattctgaaaacaatatcagaaaaaagaacactgaaaaatacaaatttagagaaataatggattttttcctttaaaaattttcattgacattaaaatattctctctacaaagaacttaaacaaatttacaagaaaaaaacaaacccatcaagaagtgggcaaaggaaatgaacagacacttctcaaaagaagatatttatgcaggcaacaaacatatgaaaaaaagctcattattactggtcattagaggaatgcaaatcaaaatgacaatagaataccatctcatgccagttagaatggtgatcattaaaaagtcaggaaacaacaggtgctggagaggacgtggagaaataggaacacttttacactgttggtgggagtgtaaattagctcaaccattgtggaagacagagtggcaattcttcagggatctagaactagaaataccatttgatccagcaatcccattactgggtatatacccaaaggattataaatcattctcctataaagacacatgcacatgtatgtttattgcagtactattcacaatagcaaagacttggaaccaacccaaatgtccatcaatgataaactggataaagaaaatgtggcacatatacaccatggaatactatgcagccataaaaaaggatgagatcatgtccttttcagggacatggatgaagctggaaactatcattctcagcaaactaacacaggaacagaaaaccaaacactgcatgttctcactcataagtgggagttaaacaatgagaacacatggacacagggaggggaacatcacacaccagggcctgttgtggggttgagggctaggggagggatagcattaggagaaatacctaacatagatgatgggttgatgggtgcagcaaaccaccatggcatgtgatacctatataacaaacctgcacgttctgcacatgtatcctagaacttaaagtataattaaaaaaaaaaaaaagaaaaagaaaaaaaagaaagaaaaaatattctcataagaaaaaaactcacgtcaaaatctttatgattttaattaaacacatttgtaacaaccagtgagggtatttggcaagtacgtttctaacagtgagggtatttattacaagtgttgctacctgtaacgattcttataaactgtaaaaaatcataatgttacaattttattattttgttatccataaataatgattaacatgaatttttaaaaaggtatgttaattcagaatataatttttaaaaatacatgtcactcacttgattggctagctgcaattgttcttgaaggtttctgactgtttcatcatctgcatatatgtcagttcctacctctgtgcccaggggaaaggcctccaattttttttcaacagcatcttttaattcactgtgcaacctttgaaacaaatagttaacatgatagcctcaagtcattttcgtaacagtaattactgtttcgaggtcaattaaacatttgggtcaacaataactctttaaacaaaatcatttttaagtagacttcaaataaaaaattagaagtgtttaattaccattaaatactgtgctataagaatcaaaagattatataacaatttcaatgcattaaatcgatcacaattaactgaagcatgattcagtttgtcctagagaggtttcaatttttcaaaaattttcaaaagagtaaaattcagatattatctcttattaaatgataaaataagccattcagaaaaattctaaaatatctatgtatatctagtcaattaaatgaaaattatatattaaatcctgtagaattatttgctattttcttcagcgtgtttcaccaaactcactggacttcttactaattccagttaacaagcaaagagaagaaaatggtcgctggctataaaaccaagacatcagaagctttatttttcagcacatccttatataagatcaacaataatactgaaaggcttaaaattgactttaatcttaacattaaggtaaattacagatatttcatgccttaactacaaaaaaaagcaaggaaggtacaacttaaaagaatgattgttttaatttaaaataatacatacttaagagaaaaaaagtacattttcagaaaacactcttatttcatataatcataagcagaaaatatttatagtaaatacattacaaagtgaaaataacaaaataaactacatccatctacctaaaacatttagaggtgaatgatttactaatattacaaatctcctttgaaacaagaaaacttaaatcttgatgtcaaaacatatttattgaaaacaaaattcatcaaatacaataaaactgagaaggtaaacactttagaaacaaaaaaattaattactctgaagaaaggacagagcttgaaaattattctctaattaaaaaacttacaagtattggttaagacagtttttatttttaaatatctaacagtgtttttaaaaacttttatttttcctatatgaaatgtttacctaatagagaaaatgatcagtatagaaatataacaagttttagaaaagataccccaagtcctatgaaaaaaaccattattaattctgtaatatattttctagcagaatttttactttccattaaaaatagaccaatgacatactgtattgctaatactataatctgtctttttaaccgtagtattcagacatatgcattctctcacattctaaaaagttttctgcaaatattttaaagatgacataatattccatcattttcatcatatggttatctgcatcataacttatcaattatcctaatcctttaaattgattgtaaaatgaaatgaaaaaatagtaaaattaatatttagtacactgtactttaaaatatcagaaacactgagaattaaagtgtcttatttctttgttacgcagccaaaagacacatgaaaaaatgctcatcatcactggccatcagagaaatgcaaatcaaaaccacaatgagatatcatctcacaccagttagaatggcaatcattaaaaagccaggaaacaacaggtgctggagaggatgtggagaaataggaacacctttacactgttggtgggactgtaaactagttcaactattgtggaagtcagtgtggcaattcctcagggatctagaactagaaataccatttgacccagccattgcattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcactctcagtaaactatcgcaaggacaaaaaaccaaacaccgcatattctcactcacagatgggaactgaacaatgagaacacatggacacaggaaggggaacatcacactctggggactgttgtggggtggggggaggggggagggatagcattaggagatatacctaatgctaaatgacaagttaatgggtgcagcacaccagcatggcacaggtatacatatgtaactaacctgcacattgtgcacatgtaccctaaaacttaaagtataataaaaaaaattcatttaataaaaaaatgtagttataacaagcagtataattataactgacagtaagacagtttttagggtcttaaaatttttagccaggttcggtggctcacacctgtaatcccagcattttggtaggccgaagtgggtggatcacgaggtcaggagttcgagaccagcctggccaatgtggtgaaaccccgtctctactaaaaatacaaaaattagccgggcatggtggcgtgtgcctgtagtcccagctactcaggaggctgaggcagaagaattgcttgaacccaggaggcggaggttgcagtgagtcaagatcaagccactgtactccagcctgggcgacagagcaagactctgtctcaaaaaaaaaaaaaaaaaatttaaaggtcacagaaatatcgtaattgtcccccattgattattaagataattttgtacagtttcagcttgcaaggtcatttttttaatcttacacttcatacaaaggaaggactacctatacatagtttaattttgtttgcttcag

SEQ ID NO: 1251 - DNA, 1568 bp, Homo sapiens
aaacatttgcccaattttaaattacaggccaaattaggctaactaaatccatgtcctcttattactgtgattctgaggtcatattacaaagctctgcccttcccatacccaagggtagacgtgggcatggtttttattcctgtggtacactgcacagagctccctcaaagggcaccaggcagggctggtgaaccaatgccattgaatgatctgtagtatgagatattggaggcattacatataaaccttatgaacttcacttttgccattgaatgatctgtagtatgagatattggaggcattacatataaaccttatgaatttcacttttttgagacatatgatgcacataggatcactatgtgatcctagttcacaccactgcactccagcttggtgacagagccagactgactctcaaaaaataattaaaaataaaaataaaagttagttatgtttgttttttattaattggctgagttatttgatattgtcagttgctaacatagtaaaagcataaagtcagaataaattaattttgtacacagagatgaagcagatgtcatttaaaacccgggtaagccatcatccttggaaagaccaccttctggggtatggctcatgttgctacaccagagccttggctactgtagtggttcttaacctttattgagtgtcaaagtcatctggagggccggttaaacctagctgggagtcactctccaccaccctttcaggagagtttctaacagtaggtctggggcaggccctgagaattagcatttttaacaagtttccaggtaatgctgaagttactagtgtagggactgtcctttgagaacccctggtctggtgtttccttttggcgagcaaccaagatatgggctctcaaccaccgttcgtaactgctgtgagaatgtgaacgtgaacacagagaaggaaaaccatgcctatatcattggtattgtcatttgataagtcaaatcattgctttgtaccaagccaggtttcaaatagcattgaaaatttccaaagtattgtccaaggcctttgactagaacaatagctttataaaccagtgtcatctacatagccagaaataaaattatacttaaatacaattcaactctgatgaggctttcttaaaagtctggctacagaattatggcacaggataaacgtaactggggaaaaaatatcacagtaacactatttagacatcctttattttgcccaggaatgcctttcacaagtgtattgctcctcagatcattagtaccaagcattaagatataccaaatgagatactttgtgtctcttgacgtggatatttggctgactttcaagctttgatgtaatcatatattaagtacacagtggacagctgttgtcataaagagctaaatgaaaaagcaattaagaaaaaagtttcccacaccaaaacaactcccttgattgaaattttgctgagaatcaagtagatttaaaaatatacataatgatatatatcatttttatctattttggtttgttgataagctaagtagcagcaaataactctttgattt

SEQ ID NO: 1252 - DNA, 2676 bp, Homo sapiens
ttcaaaataatagcgtgaacagaccagaactcttcttcaaagttcaagaatgtcctcatggatccagcatccgtctggtttctgtttctgcattctcagtacatagcctcacttctctttctccaattttggaggatgtgtaaaaaattttattcttaaccaaacattagtcaggctccggaacgttctcttaactccatccatgcactttcttgtaaaatgcagttttaacaagaacactgctaagttagtttagcaagacccccacaccttagacatctgatcaccttctatatcttatcaggttcctcatcctccaccatcccttaagtgatcatcccagcttgtcttcagcaagaatcctattagatcaatttagccagaatccctcttgcccctgatgttaattcttagtaattttccaaccactagtccccaccctgttccttggctataaattgccacttgcccatgctgtacttagagttacttagagttgagtctcactctctcccacactgcaaggccccattacggcggtccctaaatctattgcagtggtcccgaataaagtcttccttactatgcattaacacgtatcattgaatatgactttttctttaacagatactttgacgaaggtaattgggactcccatcaagtctccacacagctagcagccacgtggggcacttctccaggtaaggattgtccctgttccacttatgttcctgtcagtaaaatggtaggttcagtgtcaggctttaccattttcttcagggagagacccatctgatatttagtcagccatcagatgggtccagccatagcacacattagctgtgacatgacgtcgtttatgacaatgactttgagcagagttgcacacctaaaaagggactcaattaaaattatcattcattttagttatttctcagatgcatttattatttccattttccaaaactcctaatgttacatttcttcttcacatgttagatatgaacaaagtaagactaactgtggccacatcctctttacttaggaccctacccaaagtggcaggaatgggatgtaaagtgacataatcagacacagtcaaactggcttttaatcgttaagtatcattgtcatctcaaagcacttggcatagttactgaccccttaaatgtcctttctccatcttatcttctcctttgttctctgtatcatcttccggtcctatagaaatatatccccacgagcacacactgaggtctttttttttttttttttttgagacggagtcttgctctgttgcccagactggagtgcagtggcatgatctcagctcactgcaacctctgcctctcgagttcaagcgattctcctgcctcaggctcccatgtagctgggattacaggcatgcgccaccatgcctggctaatttttgtatttttagtagagacaaggtttcaccatgttggccaggctgctctcaaactcctgacctcaggttatcctccggcctcggcctcccaaagtgctgggattaccagcatgagccatcgcacctggcctcactgaggtcttaatgctgagttgaactttgtctctggccatgagcatcagtccatgtattataataggtttgggttgggtgtggtggctcacacctgtaatcccagcactttgggaggccgaggcaggctcacaggtaaacaatttagacaaagttttcacattctctgagatttgtatacattggagattcagaaaaatgtaaccgaaaattaaactataggtggaatagctgcctttgggggctgagaagacaggcatcagacctgggatagacaagggaggcctcttgttccttgaaatgataccccagcccatgaggtctgcatgccaggaagccaaatgagtgaggatggtctgtgtccgctggggaggtccctggatgttgccaagagggatagggtctgggaaagagtgaggatggagtcaggcagagaggaccccccaggctcatggatggactgacctgaggacttatattaagtcataggacagtagagaaagtaagagccaagcataatgtaatcctaacaatgtaaaaagtattaatcattttattattagttaatgtcactgaactgtacacttaaaatggctaaaaaggtaaattttaggttacatatattttaccgtaatataaaatgacaaatatattagaaatgacttttttttttttttgagatgtagtcttgctctgttgcccgggctagaatgcagtggcacaatctcggctcaccacaacctccgcctcccaggttcaagtgattctcctgcctcagcctcccaaatagctgggattacaggtgtccgccaccatgtccaactaatttttgtatttttagtagagacaggtttcactgtcttggccaggctggtctcgaactccagacctcgtgatccacccacctcgggttcccaaagtgctgagattacaggcgtgacccaccacgcctggccaggaatgactgtcaactatattttcttaacatatgtattcctacacaacatcagttttgtaatagtttatttttgttttgttttgcaatttttttcttttattgtaaggaaagaagtacattttttcagcgtgtaagaatgcaaaagtaattatcagat

SEQ ID NO: 1253 - DNA, 4656 bp, Homo sapiens
acaccccatcttgtcaataaacttataggaattggattgaaattgtaagagatgaacgtttaacggccgagtgctaaaccaagccattcagaaagcttgaagctcccagaagcttgctggcgctggagagtaatggggaagggaggggacagggagggtggttctctgggagactggaacagaacggtggctctgcggcctacttagatagacaaaaccacacaggcattgaaaagctgcctgtgtgaccttgggcaagtcacttcctgtctctaggcctctacgttcactgtgggaatatgaggcaatggctgcttgatcaggaagtggtacagagaagtttcctaatgcagatggtgaaaatgatgctgataatacctggcattaagcaagtgctcaataaatattacctattattagggctagtggtttattgaatacctactacgtgctggcactaagctgaaagctctatatgcatcatctcatttaatccccaggacaacctgtgggggagggcctgttatgcctttttagatgggggcactcaggttccagaaatgaagtgacttagccaaggtcacactgctaggaaggagccccgctgggcttggaatccaggtagcaggcctctagggtccccactcctgatcacataatgaaagtctcctccttaatcccagcattttgggaggccgagatgggtcgattgcttgagaccaggagttcaagaccagcctgggcaatagagtgaaaccccatctgtacaaaaaatgcaaaaatcagctgagtgtggtggcacatgcctgtattcccagctactcaggaagtgaggcaggaggctggcttgagcccaggaggcagaggctgcagtgaactgagactgagccattgtactccagcctggacaacacagcaagacccccatccaaaaaaaaaaagtctccttccaacaaatcataataatgacaattttcctttattaatcactagctacaccctaggaccatgctagccccttcaagccccaagaggtgtggattataatctcattcatgaatgaggcaactgaggcccagacaggtgccatgaggggccccagctcacacacataggaagggcagagcaggcctcagggtacctggggctcaggtctgccaggaaagcctgtcttcatgctgccgtgctagctgtcccaaacaccagcccaccaggaaactggaccacacgctcctcggcctgcctccccagccacactctgacccaaatggtaagcccctttggtgggctgtatgtgtgtgtatatgtgtgggtgttcatgttttcccccctctctctcaccccctccactccatggggggcaaaccagctaatggttcccttcacttcatcaccttgtcagcctcagctcagggccatggctgcccacccatgccctcctctgcccacccatcatctagcacatgagaagtgttcggccatcctggatgggtcaacacgaccccacattccagtcccagctctgccacgtggctcagtctgtgactcagccacttgccctctctgggcctcagtttccccatgtgggaagctgcagtggcaggaccagttgatctctaaaggcctctctggttctaatatccagtgatcagatgagaagatgcccaaaataacgcttttttaaaaaatgtaaatattggtctcgccatgttgcccaggttggtctcaaactcctgagctcaagtgatcctcccacctctgcctcctgcagtgctgggattacagtcgagagccaccgcaccaagccggcaatgctttctatctacctgtcacagacacatgtgcagtgtcaggccagggagaccaacgggcagcacagtccctctgggacgggaaagcatgctcactgagcaccacctgggcaggcccctccctgaccctctcaccctaagaagcaggtcacagcacccccatctcacctccgagagcgggatacccagcctggggacagcactgagcatcaggaccagctatctctgcatttctgtgcctggggaggctgtccggggacagagttaagagctggctctggagtcagatgtcagggcttacatccagtcgctactgcttcctaattttctcactcagtgatactggcatttctggccttgttttcctgctatgaaaactgggataataacagtgttcaggccaggcgtggtggctcacgcccataatcccaacactttgggaggctgaggagggtggatagtgaggtcaggagttagagaccagcctggccaacacagtgaaaccctgtctctactaaaaatacaaaaattagctgggcatagtggcgtgtgcctgtagtcccagctactcagaaggctgaggcagaagaattgcttgaacccaggaggcagaggttgcagtaagcagagatcgcaccactgcaccccagcctgggtgacagagcaagactccatctgaaaaagaaaaaaaaaattgccgggtgtggtggcgcatgcctgtaatcccagctactcgggaggctgaggcaggacaatcacttgaatccaggaggcgaaggttgcagtgagccgagatcgaaccactgctctccagcctgggtgacagagcaagactccctctcaaaaaaagcaaaaacaacaacaacaaaaaagaaccagctgtgcagagcccccactgcccagggatggcattggggtgagggggcacacattctacctacttcacagtcctgtccccacaggcatgtgcctgaggccatgttcccagacagaggctggccttcaacaagatgacctcgctcagatgtaaaattctagagctcctgaaccaaatgcctcccgctctgatgcctttgcccacattaggataaggttcaacttgcagaatcctctggacacatgcagcgccctgccagacacacaacttggcaagcagaatgccggctggagttcagctccagctcacccctcagccaggtgtccttgcacaaggtgcaacctgcaccaccgtacttggcagccgaggaggggtcagggacaggggaggaaggggacagctggagtgtctctaaatggcgcccagataccatcatggggtgctgactaagctggccccctctgctgtgattcatccccatcctctgagggtggcacacgcagcagagtgtgagcgaggtcccgtctggaacacagaaccatccggccccacgccctgccagaaacacaggtggtgccatccacccactcccagggaccaggtgcacggctgcaaaggcatctgctggatccctggagcaccagcaggtgagagtgctggcttctcttggccaaggggcagcgggcaaggctagtgggacaacctctgggtcacatgggtcacatctgaattccagctctgctgcttatgagctgggtgacccctgggaagtcatttcatctcccttgatctattcttagctataaaatatggatcccacagctgctgaggtttaccgaggcagtagtacattaaggtgcctagtagccagctgcaatggctcaggcctgtaatcccaacatgttgggaggccgaggtgggaggatcactggagcccaggagctcgagaccagcctggacaacatgggcagaccccatttctacagaaagaaagaaaaaaattaggcaggcatggtggtacatacctgtagtcccagctatttgagaggctgaggtgggaggatagcttgagcccaaggaggtcaaggctccagccagctgagattgcgccactacactccagcctgggtgacagagaccctgtctcaaacaaagaaaaaaatgtgcctagcatatagttcctgctcaataacggaggctgttactgttgttactattatcatccgggctgcccaccccctcaccctctaagtgaacacactctgaaccccactttaaaatcgcagtcaaggccgggcacggtggctcatgtctgtaatcccagcactttgggaggccaaggtgggtggatcacttgaggtcaggagtttgagaccagcctgaccaacatggtgaaaccccgtttctactaaaaatacaaaattagccaggcgtggtggcacacgcctataatcccagctgctcaggaggctgaggcaggagaattgctcaaacccaggcagcggaggttgcagtgagcagagattgtgccactatgctccaggctgggcaacaaagtgagaccttgtcaaaaaagaagaaagaaagaaagaaaaaaagaaaggagagagagagagagggagggagggagggagggagggagggggagagagagagagagaaagaaagaaaaagaaaagaaagaaaagaaaggaaagaaagaaagaaaggaaacaaagagaaagaaagaagaaaactagtcaaggcactgtggggtggcagagaggagaaaagaggctggggatggtgggtgaggggtgacagcttcagatttgattcccgcttgcttggcacttcgctttcattcccttatttaatcctcctagagacactctgagtagatatcaatatcaagtgtccattttacagaccagaaaacagttttgggaaaactcggtcctaatttgttcacagccatggccagaaaga

SEQ ID NO: 1254 - DNA, 8504 bp, Homo sapiens
ctagagagttgtcgagaaaagcaaatgacgaactatgaaaagcaccagcatgtagcaggcatgcgatccatgctcattccttgtttgtgaactctcagtttcaggccttttttgaggcggggtctcacaatgctgcccaggctgctcttgaacttctgggctcaaacaatcttcccacctcagtgtcccaaagtgctaggattacaggggaaagccaccacacctagccccaaccagggaactctctctccacctctcctcccttcttggctgctggatttggttccttcttcggaggccctgtcccagaatcctgctcaccaacctacagggcatcggccccactctggctcattccaggagctcctggcccaccctcgccccaccgccaagtgcccatatctctcaacctggctcctgccagtcaccctctggaacctccctggctgttcctcagtgtgaatgtccagtgacagccgtgcaacagcacaactcccctctctgggcacctcccgggaaacaggccctgtgctaggcacttccgaccttagctcattcaccccaattgttcttgctctgagaggcctttcccagaagagcctgccttccttctgcaactgggttattcacccgtgcctgcagccagtcattcaactgccactgaccgcacccaactgctccccacgaagcagtctgcgctgtcaaggcaggtctggccacggcagctaaagcccttcaaaggctgctctctgcccttggaacagggacccccccacctccgccccctgcttatgatggcctccacaggcttggaagatccctgccccagagccagcttgagccctaccattctcccctggcctgctccgcccagccacaccctctccctcctgctccgagagccctggtgctggactcagggctgcctgcttctcttcacaccctccacccagaactgcatggctagctttcccctattttagctgttggctcaaacatcacctccttctagggccttcctcctgtccacagagccttcagtcagcgttgttggggaaagagctcacctaccagcctgctcctctgagggcccagtggctcaggcctccctctcttttgatcctcaaagagcccagacctagactgtcactgacccacaggagtctttgatgataagaaagatcagagagcagggctccaggagcctggcccccagccagcggcacccacctcggaacatgtcgtaccagaccttcttggccttgaggtgctgcagcccgttcaggtgcttcttgcggttgtggaggttgtcctggaaggagcggtcgcagtagtcacagaagtatcgcttccccatggccactcagagcaggtgctttgctgcctgggaagccacaaagagctcagattagaccattggagaaaacacatccctcaccagcccactgaatgcttcctgagggccaggcctgagcccaggctttactcatatgcaccccgccccattaggagtgtcaagctgatgagtatggcctaagaggcctcattccagagggatctgttaaccattctgatgcccagcctgcaacttaggccagttaaagtagaacctcagtgggtgaggcctgggcactgttttttcttgagagggtgttgctctgtcacccaggctggagtgcagtgttgcaaacacagctcactgcagcccccacctcctgggttcaagcaatcttcctgtctcagcctctcaaagtgctgggattacaggcatgagccactgtgcctggctgctgtttggtagtttttaaagtctatcaggtgattctaacatgtaagtaggctgaactgccaccttataccctgtggctggcctcccttgtctcctaccacatagggttttatttttttgagacagagtctcgctctgtcacccagggtggagtgcagtggtgtgatcacggcttactgtagctttaaccttctgggctcaagtgatcctcccacctcagtctcccaagtagctgagactacaggtgcgtgtcatcattcctaacttaaaaaaacaatttttttgtagagatggggtctcgctatgttgcagaggctggtctcctgggctcaagtgtcctcccgccttggccccccaaagtgctgggattacaggtacgagccaccgccccatcccctaccatacctctgacctccacatttgcatcatataggccacaccggcctcccctttgctcctcacacatgccaggcacatggccacctcccggcctttgcacccaaggctccccagggaggggtatgccctcctgcaaactcccgcctcacttcccctcctgaccccttccatctttgctccaatgctactttatccaagatggcagaatcttccacttagcttcctccactccctgctttattttccctcatagcatgtatcaccctttgatatggtgaggctttgtatccccacccaaatctcatctcgaattgtaatccccataatccccaggtgtccagggagagaccaggtgggggtaactgacatgggggtggtttcccccatgctgttctcatgatagtgaagagttctcacaggatctgatggttttataaggggctcttcgtgctttgctcagcacttctctctcctgctgccttgtgaagaaggtgcctgcctcccctttcccttctgccatgattgtaagtttcctgaggccttcccagccatgcagaactgtgagtcacttaaacctctttcctttgtaaattacccagtcttgggtatttccttatagcaatgtgagaacggactaatacacccttcatgcaataagttacttgttatgtttactgtctttctcccacaatgagaatataaacccatgagggcaggtttgtgttttgtttactgctggagccccagcacctaaaatagtgcacagtacagagtaggcattgaagtacttgttaaatgtatcaattctcattttccctttgggacaactgaggttcagagagggagtgtgatttgcccaaggtcacacagctgataagcagaaggcaaacccagtcccctaacgttacattgccaggtgtcctctcttccacagccagttcaaggcttagagaagccagagggcgcaggcagtgaatgctgacagcttcccaaggagatcactaaattatcaggtggcaggtccgaatccagtcacagagggaaatgaaaacattttggggtcttaagacccctcagccatggtgaccacagccaccactcctgacccaggagatctgcagcccaaggtgggtggcaattcagtgactctcatggccagcccttgggtccatgagtatggtgctgcaaaacaggaggacagacaggtccactttgggccaccaagggggatctgccaaggctgagcccagaccaactgctcaccctgtggtcagacccctcacttcacagaaaaggttcctgaggcccagatgaggaagagaaatgatttcccccaggtcacaaggtagctatccgggctagcagccaaagccctggactcccaggacctgatcaccacagtggaccaatgggggaacacagctcaggaggaggagactggggagagacacagagacagtcccaacagccaagcaggttgatggagaaagccattcttgcagcagacagggacagcagccattaagtcaggggctgtaatgggatcaggaacagacagtcattcaaaatgaaaacatataaaacctctcttctcccattactgcagagggaccgtgtcccagacacgcacacttgatatattaaatttggcagctctaatacaccccatcttgtcaataaacttataggaattggattgaaattgtaagagatgaacgtttaacggccgagtgctaaaccaagccattcagaaagcttgaagctcccagaagcttgctggcgctggagagtaatggggaagggaggggacagggagggtggttctctgggagactggaacagaacggtggctctgcggcctacttagatagacaaaaccacacaggcattgaaaagctgcctgtgtgaccttgggcaagtcacttcctgtctctaggcctctacgttcactgtgggaatatgaggcaatggctgcttgatcaggaagtggtacagagaagtttcctaatgcagatggtgaaaatgatgctgataatacctggcattaagcaagtgctcaataaatattacctattattagggctagtggtttattgaatacctactacgtgctggcactaagctgaaagctctatatgcatcatctcatttaatccccaggacaacctgtgggggagggcctgttatgcctttttagatgggggcactcaggttccagaaatgaagtgacttagccaaggtcacactgctaggaaggagccccgctgggcttggaatccaggtagcaggcctctagggtccccactcctgatcacataatgaaagtctcctccttaatcccagcattttgggaggccgagatgggtcgattgcttgagaccaggagttcaagaccagcctgggcaatagagtgaaaccccatctgtacaaaaaatgcaaaaatcagctgagtgtggtggcacatgcctgtattcccagctactcaggaagtgaggcaggaggctggcttgagcccaggaggcagaggctgcagtgaactgagactgagccattgtactccagcctggacaacacagcaagacccccatccaaaaaaaaaaagtctccttccaacaaatcataataatgacaattttcctttattaatcactagctacaccctaggaccatgctagccccttcaagccccaagaggtgtggattataatctcattcatgaatgaggcaactgaggcccagacaggtgccatgaggggccccagctcacacacataggaagggcagagcaggcctcagggtacctggggctcaggtctgccaggaaagcctgtcttcatgctgccgtgctagctgtcccaaacaccagcccaccaggaaactggaccacacgctcctcggcctgcctccccagccacactctgacccaaatggtaagcccctttggtgggctgtatgtgtgtgtatatgtgtgggtgttcatgttttcccccctctctctcaccccctccactccatggggggcaaaccagctaatggttcccttcacttcatcaccttgtcagcctcagctcagggccatggctgcccacccatgccctcctctgcccacccatcatctagcacatgagaagtgttcggccatcctggatgggtcaacacgaccccacattccagtcccagctctgccacgtggctcagtctgtgactcagccacttgccctctctgggcctcagtttccccatgtgggaagctgcagtggcaggaccagttgatctctaaaggcctctctggttctaatatccagtgatcagatgagaagatgcccaaaataacgcttttttaaaaaatgtaaatattggtctcgccatgttgcccaggttggtctcaaactcctgagctcaagtgatcctcccacctctgcctcctgcagtgctgggattacagtcgagagccaccgcaccaagccggcaatgctttctatctacctgtcacagacacatgtgcagtgtcaggccagggagaccaacgggcagcacagtccctctgggacgggaaagcatgctcactgagcaccacctgggcaggcccctccctgaccctctcaccctaagaagcaggtcacagcacccccatctcacctccgagagcgggatacccagcctggggacagcactgagcatcaggaccagctatctctgcatttctgtgcctggggaggctgtccggggacagagttaagagctggctctggagtcagatgtcagggcttacatccagtcgctactgcttcctaattttctcactcagtgatactggcatttctggccttgttttcctgctatgaaaactgggataataacagtgttcaggccaggcgtggtggctcacgcccataatcccaacactttgggaggctgaggagggtggatagtgaggtcaggagttagagaccagcctggccaacacagtgaaaccctgtctctactaaaaatacaaaaattagctgggcatagtggcgtgtgcctgtagtcccagctactcagaaggctgaggcagaagaattgcttgaacccaggaggcagaggttgcagtaagcagagatcgcaccactgcaccccagcctgggtgacagagcaagactccatctgaaaaagaaaaaaaaaattgccgggtgtggtggcgcatgcctgtaatcccagctactcgggaggctgaggcaggacaatcacttgaatccaggaggcgaaggttgcagtgagccgagatcgaaccactgctctccagcctgggtgacagagcaagactccctctcaaaaaaagcaaaaacaacaacaacaaaaaagaaccagctgtgcagagcccccactgcccagggatggcattggggtgagggggcacacattctacctacttcacagtcctgtccccacaggcatgtgcctgaggccatgttcccagacagaggctggccttcaacaagatgacctcgctcagatgtaaaattctagagctcctgaaccaaatgcctcccgctctgatgcctttgcccacattaggataaggttcaacttgcagaatcctctggacacatgcagcgccctgccagacacacaacttggcaagcagaatgccggctggagttcagctccagctcacccctcagccaggtgtccttgcacaaggtgcaacctgcaccaccgtacttggcagccgaggaggggtcagggacaggggaggaaggggacagctggagtgtctctaaatggcgcccagataccatcatggggtgctgactaagctggccccctctgctgtgattcatccccatcctctgagggtggcacacgcagcagagtgtgagcgaggtcccgtctggaacacagaaccatccggccccacgccctgccagaaacacaggtggtgccatccacccactcccagggaccaggtgcacggctgcaaaggcatctgctggatccctggagcaccagcaggtgagagtgctggcttctcttggccaaggggcagcgggcaaggctagtgggacaacctctgggtcacatgggtcacatctgaattccagctctgctgcttatgagctgggtgacccctgggaagtcatttcatctcccttgatctattcttagctataaaatatggatcccacagctgctgaggtttaccgaggcagtagtacattaaggtgcctagtagccagctgcaatggctcaggcctgtaatcccaacatgttgggaggccgaggtgggaggatcactggagcccaggagctcgagaccagcctggacaacatgggcagaccccatttctacagaaagaaagaaaaaaattaggcaggcatggtggtacatacctgtagtcccagctatttgagaggctgaggtgggaggatagcttgagcccaaggaggtcaaggctccagccagctgagattgcgccactacactccagcctgggtgacagagaccctgtctcaaacaaagaaaaaaatgtgcctagcatatagttcctgctcaataacggaggctgttactgttgttactattatcatccgggctgcccaccccctcaccctctaagtgaacacactctgaaccccactttaaaatcgcagtcaaggccgggcacggtggctcatgtctgtaatcccagcactttgggaggccaaggtgggtggatcacttgaggtcaggagtttgagaccagcctgaccaacatggtgaaaccccgtttctactaaaaatacaaaattagccaggcgtggtggcacacgcctataatcccagctgctcaggaggctgaggcaggagaattgctcaaacccaggcagcggaggttgcagtgagcagagattgtgccactatgctccaggctgggcaacaaagtgagaccttgtcaaaaaagaagaaagaaagaaagaaaaaaagaaaggagagagagagagagggagggagggagggagggagggagggggagagagagagagagaaagaaagaaaaagaaaagaaagaaaagaaaggaaagaaagaaagaaaggaaacaaagagaaagaaagaagaaaactagtcaaggcactgtggggtggcagagaggagaaaagaggctggggatggtgggtgaggggtgacagcttcagatttgattcccgcttgcttggcacttcgctttcattcccttatttaatcctcctagagacactctgagtagatatcaatatcaagtgtccattttacagaccagaaaacagttttgggaaaactcggtcctaatttgttcacagccatggccagaaaga

SEQ ID NO: 1255 - DNA, 31090 bp, Homo sapiens
gaaaatgatgaacagcaaagccttgttatgatcctgatccaatttgcttttgacagattatacatctttgaaaaaaatgtgatcagtgccaccaaggtcacaacactcaccaaatgtcatcaaggtcagcagaaatacagattattccactatatcttcactacttgaggtcattttggcaatccccaaagagatcagaagtctgaaaaataggtgtctattccttgcctgggagcactcctgctatgtccagcaaacaacaggcacttgataagtatttgttacctgacttaatgacttctttcactttgatttaccttcagagaaaaaaggacttaaatgatttcttgaaactgaaatgaaaatgagtatcagtaaaagcggtaagacatgagtacagacacatgtgggtttactcaccttatctcaaagttgcaatcgcatatggctttcctgtgactttttctatcccatcacacgtgttgctacacccatttttctgtcaacccttgagtatccctgcctcctttctctgcactcaagacacacacagtcatatatctcaccctaataatacgctaaatgtttctttcttaaactttggtcacagaggggtcaagattccttttttttatatccagctccttttcccagcaataggttaaacttgctaccctatagtctgcccaggacttgattacatattagcctatttaaaagtctgcttccagaattcccctgcataaagtcttcttttggggtggacatagtctcagttcagagtctctgagctgtttctcttttttttttgccttttatagtctctcactaaatctctcttattattgcctgttcaataatcttctgttttctccacctactctttttctaaaaactttttggtttctttacaattaaggattcatgaccttatatcccaccccaagtagtgtgcacatcttgtttatacactatttatactaacatcaggacaaaatttagcacatttaaaatcaaatgacatatttgtttttagtttacttttggttgctgtgagttactcctaatccacacatatactgccacaaaaaaagaaaggaaatggctgtgcaaataatgcctgcaaaatgagccatttggcttcaagattatagccaaattatgcgacagcttgcaatagtgaattagatgagaaattgttttcagtatttacaacattttgtagcaaaagaaaaagatgtttagttctagatttgcaacgaagccactgaagcccgtttcacaatcatttacactttttggatctcagtttccaaaaatgctaaaactgagttcaacagtcactggctttgagtactttcttatggaatcaaccacttagagactacagaaaagacaagatgtaagttacccttttatgaaggaaatgtgctttcataggaacggcacaggttttagagcctaacttcccagggctagatctcctttataccctctaccagatgatctagagtgaagttacttaacttctttcagtcttgattctgcatctgtaagacagtaataataatatttgcttcacagaatttttctgaggattgcctgaacaatcctaagaatatataaatagcacgacacagtaaggtgctcaaataaatggtagttattcttaaagctgttgttctacttattgatttaaagaagggacagtattttgacttggtgacttgaaggaggatccagtgctataaaaaatttagtgtctgctagattattttaaaatgtcaaacacagagtgtttaaagggaaagggaaaattcccctcactttccttccagttccagtgtccatgtacacatctgttcaaattttttctatatgtgaaataaaagtacataaatataattgattttatcaaaaacagttcatgttacatatgctgttagataaaaatatttgggtggtaagtggaaaggaacaataaatattttcttggttcaataagaaaatattaggtctgaaggaaaaaaattagctgtgaccaaagtggaaagaaggcatctgcatgccactgcaattctttttacagaaattctctaggtgttaattttattagacattaatcacaatattttaaaataaataattaaagctttactggtaaaatcattacttaaatattcatgttggttgggtgaaataaaatcacatatacattgcctaatttgcatgaagtttgatgggtgtgtagatcacaaatgaataagaatgtaactctctcctggatgctactagatctttttctgcagagctacttacttgcagcagcctaaggaggttttgcaaacacagaggatggttggaaaaggatacagattctccacagttatttgttactccaagtgcaaactgacctagttatggttaccatggatactataattttgaatttaatcatattctgaaaaggagtagcaatacagctctatgaaacactgagatcaatctgaagctcagccttaaaaggtgaagaaactgagtcagggagggtaagtggtttatcctatatcaagagagaaattggaagattcacagaaaaatctcaaattttataaagctaagttctatgattagttcagtagccaatgtacttttcaaagtcactcaagccataaaaaatgcttcttagcttaattgatttacatgagactttgctgcacttattaaaaatacactttttctcctagtcatctataactactgtttttcaacttgaagttaaaaaagcacaaatatatatttggagtcaatataccaagctgtcatgatgaacaggtttctgcacaaatgaaaaccaagtgaaataaaaatgaaaatgcctgggaagtggaagaacaaaggatcatttgttttaacttgagcttctaggatcatttgatggccatattttatgagtctgcaacatataatcctgcatataaaacatgatattactataacatgtacatttaaacattcaaccataatattaagattttcttttaaataaatatttctgaattcaaatacttagaataaaagaaacaggaagctggctgcttataattaaaataaaatttacctgtagttctgtctcaaaagtgatctaaaatcaagtaggtgcaaattttaggacataaagatgagagaaattatacagaaggagcaaaagaattaattctgaattctccctggaaaataagaatagttcatctcctgtattggttgctttaatacaagttgctgttctgctgagtaactcttaaatggattctctaagatcataaactattggaaattgaagccagtgatctgacttagaccctggcaacattatataagcagttttcaaagattccagtggtatcttttcttgcttatgtagctggttttgatcatagccaggccacctcatgcacttgcaaagattcttccccttccctatataaatttccccccaacaaccttgaaaatcttgtaatggatgattcattacagctgagacaaaggcccaagtactatcatatgtcattgctaaaattacttcagtcaagaggatgaaaacattagaaggtttacctcctttcaatcctcagctcccatccattgttggctgacaggattattatgctgctgcttggtcagtgcattagcagaaattgttgctttcaggaagcacagcagtgaatataaaaacagagctacaagatagcagggccagtatgaacaatttatagttgaatagagagctctcaaagctggctttatggtcgtctcacaaatacattaatgatctcatctttgaggaaataatattccctgaatttctctttgcttccaaatctatattttttctttccaggagagagggtactgatcatagagaggggaaaaaaaattagcagcttgcatctaagcctctccccatacattggtaggctgcacatgatcttaagctgctatgcctgacttccaacaacagcaaacatttattgatctcatattgctagtcatgataagagtttcaaaggcaaattccttgaagaactcataatgtaactagagtcacataatgtacagagctccctctactatgatggaggtatgctgatttgtgatttcagaagagggagggagtgattgtgctcaaggagcaggagggaaatgtcacagaggaggggacattaagttgtatcatgaaaggtgtgtcatatttcatgaggatagagaaggcaatttcatgtataataaacagcttaaacaaaatcaatccccaaagaaaatagaatacatggtatgtaatgactatgtgagtgtattaatcagggttctctagagggacagaactaataggagatatatatatatacatagctcatatatatatgagttcgacgttcaagggcaggaagtacccagcatggcagaaagatgtaggctgggaggctaggccagtcttgccttttcacgtttttctgcctgctttatattctagctgcgctagcagctgatcaggtggtgcccacccagactaagtgtgggtctacctttcccagcccctagactaaaacattaatctcctttagccacaccctcacagacacacccaggatcaatacctttgtatcctcaatccaatcaagttgacattcagtattaaccatcacagtgagtcagaatgcatttttccaaatagccacagcaatttctcccattccatatgctcttcttataatgtgactttgatactcctctcattgagaagagagattctgtgctcattgagaaagtaggctttgcaacaacagtggaagtaatgctatgtgacttcatagaataggtcataaagatgatagattttctgcctggctctcataggaaaaccctttggaaacttgagctaccatatcaatgtctgacttccctcaagctgctatgcagggaaagaaacccaaactaggtcccatggagagatcaaaaggaaaggccctgaaactatcaagagaggaggatgcctgatcaacccatagctgtcctagctacttgccattttagcttcagccaatatctgccaacaaccacatgaaagatctgagttagaactacttagctgagcctttcccaaattcctggcccacagaaactgtgagagctaatacaatgataagcattgttttaagcaactaagtgctggaagtgatttgttattcagcaattaaaactagaacagtaagcaactggaaatgaaattagacagtctaattgaggcctacataatatttggattttctcctacatgaatgggaaacaatccaataagcttttttaatctgaagaatgacacgatccaatttatagtttaaaaggacactcaagagacattaggcaagatgaacaggagtagagagacactggagacaaggagaatgcttgcaggaattctcaaagttgaactgtgcataaaaatcacttgaggtgtcataaaatttcacatcccttgaactcatcccaaaaaataaaggaaaggtaatgaggaattgtttctagatacctttagtggagaaaagtacatttgttgtatgcttgctgtatgtcgggcagtttgctaggcacttggtatacagcagagtggctaagatcacagactttcctgtaagaggggcctgaatttgagttactccatcatttactagctatttgatcttgggaaaattatttaacttccctgaaactgttcccatattttaaaaatataaatattatcctacctttctcactattttacttaggtataatccttacatatagtaattgcccaataataataaatgactgcataaaaacacatgcacacatatgttcattgcagcactattcacaatagcaaagacatggaatcaacctagatgcccatcagtggtagattggagaaagtaaatgaggtacatatgcaccatggaatactatgcagccacaaagaaaagaatgagattatgtcctttgcagcaatatggatgcggctggaggccatattcctaagtgaactaacacagaaacagaaaaccaaatactgcatgttcttacttataagtgagagttaaacactgagtacacatggatgcaaagaagggaacagcaggcactggggcctagttgagtgttttggatgggaggagggtgaggattgaaaaactacctctagggtactatgcttataacctgggtgatgaaataatctgtacatcaaacccacataacatgcaatttacctataaaacaaacctgctcatgtacctcctgaaactaaaataagagaaataataataataaatgattgcaaatgttctcagcagtgttattcccacgtttcaatgttcttatctcctttagcaaaattccttctattcctgctttttcctctacatattaccaaaactcctttggaaaaacttataaataatcaacattgtgtcaaattaaaaggaattattttcatttcatttggtttcctggcaggctatcctttcattttggaaaaacttgcttctagacttctatgatgccacattccactgtttttctcctacctcaatggttgctctcctactttctttgatgcattttcctccaaaaccattctaaactcagagtccttcagggtttgattttgatccttttcctcttcacatattttcttcttaaatgacctcatcaatctatgacttaacataacatgtatattttgatgactccagtttttatctaaaatctaaatagtgactctaaattcataaatctgaaggctacttgacatttctcttttatctcttataagcatcttaacactaatgtatcctaaattgaattcttgataatctcaccaaacttactcttcctctgtgctttttccctcctataatagtgcacagcacaaaatatcttcccagttattcaatctaaaacctagaattcatctttcattcaattttttactcatccacttaaatcaaatcatctacaggttgtgtcagttcaactcttaaaaggtatttcgaattcatcaacttttcttcattcctattcctactattgtagtccaagcatttcttgcctggactgctacaataagctcctaactttttctctttccttcctccaatttagtttattcatgacatcattcaagagatgtgacttctgttttggaattatgagtgttataatctagaatcaccttggattatttcagaatcctgagatcacataatgctagacgtgaagagatttatgtatcaagtaatccacatccaacattaataagaatagtttaggttatgctaagtctaggtaataaaaaaagccccaaatctcagtagactaaagcaacaaaggattctttcatgatcaaactatacaatcatcatggggtgtctgggggttttgttctgagtcatctacattccaggactcatcctgatggagcagccactgcctggaatcttgccagtaccaagaatgacagaaaaacagctatagcaaaaacacccactgtgttattaaaacattcgctaaaagtgacatccttcacattcaatcaatttctttggccaaggcaagttgcttggccaagtctaaatcaaaaaggtgtagggaagtgaaatacctccatgtgcctaaagagagaactgaaaatattcagtgaatagcactaatgatgaattctcccttatattttacaaatgaagaaattgggacctagggagactatgtgaaccgtaagatcaagaagctgatttacatcacagtcaagactaaaactgagtcttgaactcactgtccagtgcttttcctaataatgaaccgggaattgtttgttccttattcaagcaaaatacatttaaatgtcttaatatcaatattttatttatttaagtaatatcaaccttctgtattaaagcatttttatacctttgcttagaggccttgcttctccagtctcattgatgctctagaaagatgccccagtgttaaagcactcaaaatctctttgacctggctgttctcatttctagcaaaactaagtcattaagtcatgttttatgctagggattctaaacacactggcttaagaaatgtcaaggagataagcaagagaactgtgaatctgtatgtaaattaagcaccatctgttaaatccactagaactgtattcgcaacaagaactccaattaacaatagcttagggaggggagatttatttgaccctcataacaagtctaaaggtgaatgactactgatgttggttccataggtcaatggtatcagagcccatggatctcttggtcttttctcatggacacaggagggctgtgactgctccgtgcattacccctgtgatcagtctagaagaagggggaaggttgaagccagatgagactgccccttttattggagaaccaaaagctttcccaggatcaataatccaccccttattctttcagactattataaaggtcctatttgccaggaccggggttacatggccaaccctaagagaaagggagatagaaaaaaaataggaaaaaagattatcgttgattggctaagactaatgctgccttgaacaagagaagggttctgttggcaaagaatagcatgggggtaggaggcggtaaaaatgaagaccaagtaagcaaccaacagtgtctgcctgattccctgattgaatagaagattgttctgagagaatttatctatcattcttaaattttacattcaaaataatgtgaataaataaaatatgtatttaccactgaactcatagtagctgttatgtatcttaataactggtgaaaataaaaaacatagtcaggtgctgtataatgatgtttcagtcaaagatggactacatatacaatagtggtctcataatattataataccatacttttactgtacttttctatgtttaaatacgtttagagatacaaatacttaccattgcattacaatagcctatggtactcagtacagtaacaggtttatagcccaggagcaataggcggtaccatatagcctagacatgtagtaggctataccatttaggtgtgcgtaaatgcatttcatgatgttcacacaatgacaaaattgcctaataatgctttcctcagaatgtatccttgttgttaaacaatacaggatggtataatgaagctacgtttaaagaaaatatattccataatgttcacacaatgacaaaattgtctaatgatgcttttcttagaatgtatccttgttgttaaacaatacagggttgtataatgaagctattacaataagttctgctataacacttgttttgaaaatacaaatttgttccaacaagattgacatattagggaattgtttgaacataacacaatttcgcatttgtttgtgtgtgattttgtctacttgaaacactagtcgaatgcagaaaactacccagatgacctgagccacataagaatacacaaaactcacacaggtacaatcctcaaaccttaccagtgacctcagttcactgcctgagttatgagccacacccatccacatctggtgtaataaatttcccccgatttcaaataatgcttcttctgccatttcacaacccttaagctgtgacctttctgaggcccatttccacaagcaaatgccgtgtctttttcaagataaagggttatatttgctgtagtatttatgcatttcttaagcatttatcatgtgtaaattcttgctaccatttttattaggtcttgatctgatttttatggtccattgacaaagtttctgagtgctctgtcctaaacctcatgttacccattaagtcctgtagttttaattgaactttttttttcagtgataccgtatctaaataaatccctggtggttaccaggtgaatataaataagtgtgtatatgcatacatacattcatacatatataatattcgaacacaattgaggcattttgacataaatccaaaaaattccttttatattttagaggtaaataagcctttaaaagtatttattaaatgtacttgggaggatttattcaaaaaagactatcaattatattaaataaaagccattcaatacgccaagctatatatagatgtctccatagtgggtgaagatgtgtcatttatcttttaagataattatgcaaactatattgagcacacacatcctgagctgggaaatgacttttacatctttctcctcatttataaatcttttccaacagaagttatgcaagattcagactggtcagcacagagctggattttggtggtccctttacaataggagagaatccattttcctccttagggtctttcttttctttaacgaaggcatacagagcactcagcacattcccagagcttcttagaatttttcccttgagagatctcaggaaatatgaggaaaaacaacttcaaaaaaattaatgaaaggcctatcactgtctgcctttctctcttttaatccctgccctatcctttctactttctagaagtgtagtgccccttcagtttcaaacatttttcctctccttaaattcccaaggtgggatgcccttttctggcactccgtctatgaaagggacagggaaaagatcttatagaaactgaaccctgacacggggcttattttcctaaggaccaaaacataaaaggacagggtgggaccatggaaggattaatttcaggcaagggcagcctgtggagagtgagaaatctgaaaaggctctaggcttctatgggcattcccctccacttcttctgcctgctgccagatgactctcacatgtgaatccttatttcctcaggaatgcggatcagggtttggcaagtatgttttcagtaaataattgctgaatgttcaacgcttaaaggcagaagcataactttgagtgtgcacagtaatcactgaaaatgattctgtactcaccgttttgatgcaaatgcaaattctcatagcccctgcactgactccgtgggtcacctgtgagtaactctagccaaaagccacgcacaagccctggtctgcctccaggcagcagaccacaacacagtgccctgagtgcacctgcacacacccatgggcacacattaaacccataaacggcgggttatgctaacgtgtacttccttcctcactgcctcaccttgttcattttcctttttccccacccctcaccccatacaataggatttttgtttgcttcagtagcatgtgacagcacagtccctgctttgcctagctctgtgctgcaagtctctcaggtaacaggtggcagcttcccctgttggattctaggtttaaaaaagaatgacctcatgtgggtggagctctgggacttcgtagaggtggtggcagtcacagccaggtaaccctggagtgaagcggtttagttagaagggagcagataaactcgtcactctagtagctttaaccctcaccctgaggcaccttagcaatcagccattgcctgcaagcctccaaagcttgtctttgcctaatatggagcccaaagaagccactgggaaagaaaacatggtcaccaagaaaaagaatctggccttcttgaggtctagactctatatgctggagagaaggaagactgacactgtggttgagagcagtgtttctggggaccactctggcaccttgaggaggagccaatctgacaggactgaatacaaccagaaattacaaggtaaccaaaaagaaatcaattgtcccagttactgcactcccagctccatttctgctacgtttccaattgcaaagaaaacacacaaggcagaggggaaaattgaataccacctctccttcccacaaaataagaagatgaaagtaaatgtgacctataaattatagggaaaaaaatttattacgtgattcaatgttaaagagtcaattccgaattactcttaatattgctgtgtttttcttttttttttcctggtgagggtaatcatttttcttctaacttcctcttttcttctcccttctctacccaacttaagaagtgggaaacactggaaagcaaatgagttagaaacctacaaaagattgtttatctcaatgggtagatatgtgatattacaccatgagatatatctaggtaatggtactgaactatgattgtggttatcttaaataggggcatgaaactataatcgtgtctgtgacaaagaaggaatgttatagtcagagagacggtataaaaagatttgctgaaattcacttaggtgattatttcctttgagtaaattgaataatactcaaatatggtaagaaatgtttagcatgcttattttgaatgacatttgaggaaataacttcagtttattttgtgatggtacaaagataatttggcacagttatgatagcacatcatttgtttcagggccttaatctatatcctgtcctatctatcctttctttctctcctgtttcctgaaggtcatttgttctagtaaaatttcattttgatgttgatattgggcagcattttaagtcttttcttcggtacttgttatgtggtcctccagaacttgcctctcctgcttttagcacaaggtgtgtctgaactctcatcatcccactgtgagctgtcgttttggatttaaaaactgtgatgaggtcagaaagaccgataggacatgcttatatttaacaaatctctttccacaaatatgagcttagatttagttatgcaaattaattaagttaaataagttaaattaaatgcatttaaattaaatctaaaaattattactataagttaatgtgtaaaaataaaaaaaaaattaccagtagttcagcactaaagcacagcatcaatcttatcctcaaatactttttttttaaaatgagggagagcattgtttaatctttgaaattaatttttctccaagcaatagatacattggaaagaatggatgtcttaaaatttcaacttttattttagattcagggggtatatatgtgtgtttgttacttgcgtattttgtgtgatgctgcgatttggggtacaaatgatctcatcacctgggtactgagcatagtacccagtaggtggtttttcagcccttgcctctgtccgtttctcgccactccagtagtctccagtatctattgttgccacctttatgtccatgtatgtctaatgtttagctctcactcataagtgagaacatgcagtatttggtttgctgttccagcattaatttgcttaggataatggcctccggttgtatccatgttgctgtaaaggacatgattttgttctttcttctggctgtgtagtattccatgatgaatatgtaccatgagaatttaaaatcatacacatttagtttctaaacctggttcttcaacttactaccaattagaacttgagcaaattacttgaaatatctgagcctcaattttcctgtctgtgaaagtgggactaatgatacttgccacatagtgttgttgggagattgaaattagataattacaaaacatctagtatactggctgataaattttaggaataatgggtaccataatgataaaacagaacttgcccaatattaatcgaagtttgtataccttatttctctttttcaattcttttttgtcctttgataaagagaccacatctagaaattcaggaaaagcccattgctttatccctaatgacatgttttttctgtctgagtttcactaattcagcatctatcagagtctccattagcaaaataaaaacagaaaataatttttgctattcacaaatttttgcttactaaattttcctaaaaaaataagtctatgaccacacaagagagcagacatgggttggttactttgcagaagacctcagacttcttacgcacttcatttgatttgtggctttcctgtgctctgttggattctttgaaggtggaaggcaaaactcagcagttaatacatgcttctagtctgtgcttgagaaaaatcaccaagaagtatagaggagcacataagccataaagataggctggcctcctgagaagtaacatcttaaaaacgtaacccttaaaagaatccaagtctgattatcgaacgcctaatagagcttttagcatggttcgactagaacagggaaggcgacaagggaaggcattttctcattaatgttcaaagcaatcagttctgtgcgtttgttctctggcctgtacgatacccattattatgcagatgagtcctaaatcaccttaagaagctctttattattcaaatgccgagagattttcctctccctttcttggaactggtggtccctgggaggcactgaataaacacctggactggttagagccctcagatagatggcctaaagctcttgtgaggtcaaagagtgctttcaaatactggaatttctggcaacaccacattcctcaaattatttagctggttatttaattagttatttaattggttgtccttcaatgctatattacctgagtaaaattcactgctctaactctctggggaagcaagttctctgggttccgtaaaatgtaagatttttctttggtgctcttgagcttgtcttttaactcatgatacctagtctatctgttcaattcaatttctcacatcactttagtagcatgaaacttaagttgtaataacaattttaaaaatggtacactggctgaattaaaacgatagaacatggctctaaccaggacatcctaaaacctttgcagaagattgtgatcacatcaacatagtcattcctactaagcctggagttgtataataatagaaaggccacccttaggctcccttactccttgaacagattaattcagttgactagcatttattgaatatgttataccttgttctttgaaattaatttttctcaaggcccttgatacattggaaagaatacaaattgtaaaatcatacacatttggtaaattgacatttattgaatgttttagatgctgtgtcttgagggttacaatgaacagcaaaaacagaatatgtgccaggaattacaactacaaaatcatcaagaaaacatgtctgacctttactccaaagaggctcaaagtctggttgggaaagataagacaggtaaacaaataaatacaataaagtggcatgatagaagtggaggtaggatcagtgggtccacaaaaggaggaaacggtctattcaggactgcatgaaggaggttgtcagaaaatggtgtctctaagaaatggtaagggtagggatgagggaaggtacaggtaagagaatggcattttaacctcttcactgtatttagctctgtctgaaatggtttttgtttccttgtttatcacctgttattgactgttgttcccctcccttttctctccctccccgctcatacaccatgaaagaaaccctatctgtcttgttaactgttgcatctcagcagcccagaatacagtaaacactcagtaactgttaaatagagtgaatgacttgaatgatcaggcccaagcaggaaactggtgtgaagaaagacaccatggcctgaaataagagccattgtatttatctaaatatgtgaggacacatgtttctatcagaaagatgattcttcagttaaatgaacatcagagattaaaatgtacagaatttatataataagtaattcttagtggaagcctgtttcattcccaactcgacctttcagagcacacaacaaccatatttcaaaaattcctcttctattagtgacaagagccatcttaacttccactagctcaattcctcatttccattctactgggagccatagaaattacctaaatacaagaaatttagtggttgagttgtaaaaactcagaaagggtttcataaatacttatatacatgatctctacatttgaaatatgcctaatttaaatagttatacagaactgtgtctgtgcatatgcagatatatatgtgtatatatatgtgtgtatatatatatatctccagtatgtagatatagatatacatgtatgtacttgtatgtgttcgtgtgtgtacttgagacacttttttgcaatgattagactttttattgaaagttactataaaatttgaagaacaaaaagaacaaaagtttactaacattcaggagtcttttctgaaaaccatatatgaattatatcactgacattataggtttcctctcagtatgggtactatggactgaatgtttgtattcctctaaaattcctatgtgaaacctaatccccaatgtgacagtattaggaggtggggtctttgggaggtaattaggtattgagggtgaagctttggtgaatgggattagtgacccttaaaaaaaaaaaaaaaaggcaagagagagcttgcttctctctgctctcagccatgtcaggatacaagaaggtggccatgtgcaaaccagggagtgggctctcagcaggaataagatcttccgcattaggaataagatcaacttgattctggattttctagcctgcagaactgtgaaaaataaatttttggtaaacttaagccacctaatctctaatatatttgttatagcagcccaaaccaaccaagacgggtcgattacctttatcctctatggccacactaaacttctggttaattttctggccagtgcatatttttgtttatccaacaccaggtgaaaaggtgagaatacatgggtaaaatgctattacccattaccactgccggtaacacaaggcaaaaattacgtctccatttcttagtgtgtctgtggtaccttctatttttgcaaaggctattgtatcattctaattaagaaaggttatctttatgagacccaaagttgtcttaatatggtgcgaaagatgaaccaccctactgtatgaactttatacaaaataacagattgtgccatgtggggacaagtggctcaaataataaattagacttggtaagactatgagggcatttaatttaaaatgttttttaagaatatagacagtctgtcagggagcagaaattaacactggaagacttggtgagttttgttcaaggccaaatgaagaatggagtaaaacaaattgtccagcttcctgtgcatgtttctatcccagtgctacaaaccctttttgttcgtgtctgttctttgattagtgagtagctccttcccctttatctgccttcatacactctacagtgaaatgggaagtatttgaatcagtaatgtgacaccagtacaaacaggtgtgtgtcatagtttgaagggcaaatctttctaaaaggcaagacgctttaaaaactcagtaacttttgtcttactgcatatatagaaaccagtgtaaaacacggtattttactttcctatttttttcagtagagacatcttgcagtttttagaaggaccatttgtgtcaaataatgtgtgagtcacagaaattgagactgtttgagctattctactactaccatattgtgatgggcaaatttattcctatgtttgaccgatatgactttaggtataactttcttaaaagtagcaaacacaatttctagttgtgctttttttttttgtttataaaaattatgggtttatcaaaatgagacatcaagaggaagaaggaatgaaagaaaggaaggagagagagaaggggaggggagagacagacagaaaccaagcaagcagcaagaatgaatagaaatataccttaaaatagtaataaagttggagaaatgatgggagagagaaaagcacccaagccacattcatctttgtttctgttgacacaggaaaagaaaaaaaaaaacctctgtttacagaattactttttcttgatgccataatcatattagcatcagtacctttatgaatattgatttcctgataaaagtagaattattgcaagagttgctaaatttataagcagtatcgttcttagaaccagtcaagactcaaagttatggcttatttgggagtcctaccttcacttctagactgtttctgagactgtggaattttctgttcaacaggcctcagtactggctccaacatttgcttggaccgcttcttatcccatgctctcaagggcagactgtggttgctggtgtgcatgctcttaggcctaaggcacaattgatgatgggggtgtttctggagcttgatcatgctggagtgttcagatcatgtctaccaggttcctctgggtgggaaagctggtagagagaagagtagggattcaagcctcaagattaggtaggagtgcgtgtgtcccatggtcccctgccaaattttggcataaaactctgagggatatgagaaatctaaattagaagttggcctttcagattgttataaaatatatttatcaagacagaaggaaatatcacattttatttaatagtttgccagcttcatttataacttttaaatatgtagatctggtatgctggcctccatctgtatccttgctccaggtcccacaaaggaggcagctatgtgtggtttttgactgtaatctatttcaggatataacccttcttctatactaggttgtgaaagtaagagggaaggggagggaaggaagagattgagtattagtgttatgttatctgctaggagctatgctagccagatgctgtcacacacactgttactgaatcccaacttctcttctgttcagttctgattttatcattgagaaaaataggtggtaggccttgggtttgagatgtcacatgcttgaaatatttgcaaaatggaatgaatttaactagttgactcagtaggtattttatacatatgatttactaagaagtcaaagccatttgatggttgcagcacatgttttgtaatgtgatgacatttctctgctaccataataaagcttaacttgctgtttttcactttggaatatattttctttcttttgacttatagtggcatgtccctgccagactgtcactgtttaataaatactttttttgtttagttgtcggggaacaaaattacaaaggtaggttaagcaaaactgtcttatagtaatagcttaatgatctccatttcctgcttcattgcgtatcttgacactgaaactcatctttctttaattttatgcctgttgtcatttatttgcatctcaataaaacttaatatatatcagaataactgagagtcctattctacagcaatgagaggagggaatacatttgcaaatgaaaagaatggaattatgtgtgggaaacaagcaactttttatctggataggtgatatttcagtagaattgtatgaagtcagcttaaattgtgagtcataacttaaatgcagcaggaacacagagtgctatgatttaagactttgtccaaggttttctgaacaatgtttttcttgattaatgaatcagagaataaatgaatagtctaagatacctgcactgaagccctcgatagaggatgcaatcttagactgacatacaattcttacttaaagaagaaaacttaaaggtcatgtcatctagctactactctaagtattgtgagtcattatagcacttcacagaaactgtttttcctgaatgcttcttaatgttaggtctccagtgtcactacaaaaagccatcacagatttctccttctgtgtttgttgtgaaatggttgatgaagacattgtttacctctctcagattttattcaatggaaagctgactctccttaagaataaaaacacatcccctcccagataaaaacaagcaatttactatatttagctgctaggagcttagggtcaaatttgtttttgttccctggcctttatattaactattttgtctgtctaaaagtttctttcccatagaggcagggtgtggtggctcatgcctgtaatcccagcactttgggtggccaaggtgggtctatcgcttgagcccaggagtttgagaccagtctgtgcaacatggtgagaccctgtctctactaagaaaacaaaacaaaacaaaacaaaaaattagctggttggtggtgcatgcctgtaatcccagctacttgggaggctgaggcacaagaatcactcaaacctgggaggcagaagttacagtaagctgagatcatgccactgcactccagcctggagtctcaaaaatagagtagaataatagaatagaatagaatagaatggaatagaatagaatagaatagaatggaatagaatagaatagaatagaatagaatagaatagaatagaatagaatagaatagaatagaatagaatagaatagaatagaatagaatagaaaagtttctttccccagatctctgcaagagcagatttttatcactgaagtctctgttcgtcttttttgggagtccctccctgaccatccgacctaaagtgatgtaggtaagggaatacctttcctctaccctcttaaattctgtgactaggacctgtgaattgtatagacaaaagacatactaacaaaagaaaaagcatacacattttacttgaggttaacatttttatgtgtcgtaggaggctttgtaggaagaaagaagtaaaaacctcaaagaagcagttagacctaggggtttacataacattttaacaaaggtcataaattgtggagatatgacaaagccaaagtaaaagagtttagggttggggaaagaaattgtggaaaagtgactaggaaatacatgggagaagctaatggaagataagggttatttttgtaagatttgtttgtgtagattcatctctgtgtcaactccctgtctctgatgatgagaatattcccttcttggtgatacagggagggcacttttctcatggtaaatttacactctgcttttaagtaaaaaaggaaaaggcagagagcccttcctgcatctgctattgagcatctccagctcaaaataatcagtatcccaaagtggcatatttagggatggtgtgttctgatccccctcagtggctttcataccatctattactctatgaaattatactacttcattctatttttggcttttgctgtcatttgaatataattctccttggggaaaaagacttagcatttaagcaatgcctggtatacagttattctgctcaatgactatttattgaatgactttaaaatatccagtgaataattacaactatattgatccttatgacatacttgcttttacaattctgtcattttcacttacccactatgtaatggtagttaactttcagttaatttctttacattctttttctgtaaagaaagattataaataaataaatttaattaaagaagagactagaaagagtttcctggccaagaaaaataggatctctttttaaatgaatttattcaacaaatatttgctaggtattcgtatgtgccaggtatgactaggtcctaagaatgttttttaaaatatcagaagcacacccagcccactgagtgagacaggttgtgaacaaattattgcagtaatgtaacaagggcctgaagtatactgcaaattgggtttccgacttgcaaattctgaaatagagattcgggtggaggggaattattaggcaacattctgtgaccaccacctggggaagaaaagggaaggacataagcctgggcacagggagaggccgagctgtgatgtggtctcattggaagctttagccaactctgagggaagttctgaagacagatgattttttggagttgtctccagtgttgtgaaggacctgggcccttgtatcacactttacgtttggggatgtggctatcttgggaaaaggcatggcctgagaggtgctttcatctgagataattcctaaagagggcatatctgctggttgcactcccggcagctgaaataataatttatcccttcctttaaggggaacgggtgctaacatggcatccaccacatattaagtggttattattattagagacacaaataaagcaatataggagctatgataagaaagagcttaattgcacctctgaaatgccaaaagaaaatacactgaaatctgaatcttgaaatccaattaggacttttaggggcagaagccattccaggcagagggattatgctggtcctcatacatggaacaaggtaataatactaatttttgtatttggggatttctaaatggaagagcaggtacaaacaccaactgaacatctgtagtaggcacttaggtgcagtacgtcatttcatgctcttagcaactttgcaaataagttattgccatatatttatagatgataaaacagaggttaagagaggtataagcattctcccagtggtcacatagctattaatagcaactggtgaagtcagagttttcctgaggtttgcttggctccaaagtcagggctttttcaaccatcatgcagttttcctgttctaaccttagtttttagtagtagtacctgttttatggtttgctcttaagaaatcaactgattttaataaacttttgaacaatactcacaagcatcaagagaactgtaagttctgccaatacattcatcggcaatcttgaagtgaacagtgaccaacaagtatttttcagtagctgtgttattttatgcctctcaacaaaatgttctatgtgcttggaaattagaaagatatgtacttgcattgaataaggtccatacttcacagaaacactagaatattctgctctaaaaatacaaaactgattatctgaattatctagtctttgaaaactccttgtcatcactaactacagagtacttacctggattagggtactcagtgaaaaactgggtcagaatgtcaaactacatggctcctttgcttaacactcctcattgcttttcatttttctatagctagcagcagtacccaaagaggggaatatataaaccccaggagattttacagacaatctattgtgcaaagaaaaaaataggtttgtttttcagtattgctctttgaaaatatttattgttgtgcatgcttcataatatgtatgatacattaatatgatacgtatattagaggtgtatacacagaacagtttaactgacacaataaaaacatttgcagtaaaattctgacacgctactacatggatgatcatcaaagatattgtgctaactaaaataagctagtcacaaaaggacaaacgctatatgattctacttatatgagagtagtcaaattcatagggacaaaaagtagaatggtggtttccaggggctgggggaaggaggaaatggggaattattgtttaatgggtagagtttcaatttgggaagatgaaaaagttgtaatgattgcataataatgtgaatgtatttaatgatactgaactgtttacttaaaaatagttaacattgtaaattttatgtcctgaatattttaccacaataaaaaatgataaaaaagtttggcggcccttggtttacaatattaaaatggaatgtaaggcttttcccaatttgactctatctcatctctggcctggaggacagtgttacttttgtcaatgaaaagagtcaaactctgtgaaatatttgaagatatttattctgagccaaatatgagtggccaatggcctgtgacacagccctctggagatcccgagaacatctgcccaaggtggtcagccagcaacttggttttatacattttaagcttgggtcaggaaaggtgggacactcatcttctgctaaagactttaaataaaaacattttctgaagtacccatttatttaactcctcattgctctgtctgtgctatgctgatcactgtcggagcctgtaaattcaaaccaataccacttcagtatttttcaagacaggtaagctttgtttaattcctttttgaaatccactaatctactttctatgccaattagcagtcagaggaaataaatcacatgcccttccaatgaagataaaatattcccagccccagtatttgagctttcaaattcagagtctcagagggtctgttcctccacattttcacttaatacctcactggctcccctccaaaccctgtctgacatgcaattattttcaacctatttcacagaagtctgctccattcatctttctgtgggtcagatttccattgaaactgattttaaacgataaaagattttactgtgtgaaacgtatgttggtagggctcgacgcaatgctaagccaagatttttttgggtttattggggcagatatgaaattggcagcatggagagggatgaaagaacatttataatcatatctgggggtttcgtaatgatctgtctggaataaaactgtatattgaattatgggtgggtgtttgcactatacgggtagaaagggaatcggactgatagaggcagggagggagtgttggtcagaagttctgaactcaatttctggctttgttacttaaggtagaagacttactctctctagaaattagcttcctttttttatataatgagatagagctgagcagaacttatcaccttatctcctctacctgctcttttcctgttgttccctatttctttaaatggcaccatgacccagttaacaagtcagaaatctgagagtcagctttgacttctcctttaccctctgcattgattactcaccagttcatgctaatttcacctcttgaatttcccttgatctgctctgttctttctatcttcttggcaattagactaagcttaactccctccttctttcccctagtgactggactgtccatgcgaagagccacttcactacccacaggcttcctcctcaccctcccctctcaaatctagttcagtggaggccaaagtgatcttgctaagagaatctaatcatgtccctcatttattaaaaaattcctcattgtcgagatctgtctcctgagaatttctctagacttgtccccttttcacaacctctatcacttgtacttcagctgcactaagttgttttcgcatctttttttgccaccaagcctttaaatatactatttcttttgctcatgacacttttgcatttctcttcaccttgtgctacctgtttcagatttcaactgtgtcacttctccataggactgatgtccaggctgtgctatgcttgcatgggtcacaggttatcataattctatttatactaactacagttttaatttttttatttttaatttttgtgggtacataataggtgcatatatttatgggttacatgagatattctgatacaggcatgcaatgcatagtaattccatcaggaaaaatagagtatcaatcacctcaagcatttatcctttgtgttacaaataacccagttatactctcttagatattttgaaatgtacaattaaattatttttttattatagtcaccctattgtgttagcaaatactgggacttacttattatttctaactatgtttttgtacccgttaatcatccccctttcctccactacatcctccagactacccttcccagcctctggcagccatcttttttttttttttttaagagacggagttttgctcttgttgcccaggctggagtgcaatggcacgatcttggctcaccgcaacctccacctcccaggttcaagcgattctcctgcctcagcctcccgagtagctgggattacaggcatgcaccaccacgcccagctaattttgtatttttagtagagacaagatttctccatgttggtcaggctggtcttgaactcctgatcttaggtgatcctcctgccttggcctctgaaagtgctgagattacacacctcgcctgccatccttttactatctatcttcatgagttcagttgttttaatttttagcacccacagataagtgagaacatgcaaagtttgtctttctgtgcctgacttttttcacttaacataatggcctccagttccatccatgttgttgcaaatgatgggatattattctttttatggctgaatagtaagtactccatttacaccagtttttaaatactgaccaatattttaaaatgcaaagtgatttgtttgcagaatctttctggaataattcttaatcttttaaatttgtctcattcaactcctaatataacagcagtgctttggcaacttgactttataaaattatgtcaaaacattaaagcagttttcacagaaacatacacatggtattttaccctcatatttcattaattatgtaagtttcgttaaagtaatataattacaaagaagtacaactgacataatgaagtcagctgttgaacacaattaagtcttgaaaaatatgccccttgattgttaagtggagaagtacatagacatcagtttgtgtatttaagggagataatggaaaatgttgatttatctcatgacttcaataccctgtctttacttctagattatacatatcttgatggtaagagctgttgtttattcatttaatatacacaacacaaagcacaatatcaactcaatatccaatatgtaatttaaaaaattaatattaaattagatataaggtttttttttcttttattattatactttaagttttagggtacatgtgcacattgtgcaagttagttacatacgtatacatgtgccacgctggtgcgctgcacccactaactcgtcatctagcattaggtatatttcccagtgctatccctccccccctccccccaccccacaacagtccccagagtgtgatgttccccttcctgtgtccatgtgatctcattgttcaattctcacctatgagtgagaatatgcggtgtttggttttttgttcttgcgatagtttactgagaatgatgatttccaatttcatccatgtccctacaaaggacacgaactcatcattttttatggctgcatagtattccatggtgtatatgtgccacattttcttaatccagtccatcacatgaacagacacttctcaaaagaagacatttatgcagccaaaaaacatatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggtctataaatcatgctgctataaagatataaagttttttaactccaaagactatggaatttgtaaaattgttaacttaccttcaaattctaatattctttgatttgtatgtaattataaacatatttgtgttgtgatgaaattatatattagttaatggccagattcttgtgttgtattatctttgtgttctccacagtcaaatgactgtgaaagttgctcaataagtaagtatcaaatggtgtatgtgtgcctgcctggttggttgttgggagtatgagaatgttccaacattcttgaagtatgtctttgttagcagcatgagaacaaacgaatacatactgcattttgtttataaaagtgcatattcctgaaaattatttttagggtgagggcaagtgctgttaagtaaggcattaaacaaaaccttaagcttggtatatgaaattattcactacaactattctttactaagagatcagtaagatttcaatacaattaagaaaatctaaattcaggattatttattggtagctattgaaaaacaatatcagaggggaaccttaatctaaataaacaatgacttagaattttacaagtaataataagctgtgtactttagcaggacacagctgtttaatcatctccttgcccattaaacttgtttgagaagcacattctcagtgactgctcagaaacttatttgcattggtgatttagctttggggtaaatgattcagatttttaaaattcagatgttattatattatgctaaacaacatgccagggctatatccctagctcatttgaatttagcctgaataatagcagtgcacattaggcctggtgttgaaccgactttgtagcagtctttgctgtttttgctttttccagccaaggagggcaatttcctgatagatggtcaatctcccctcttgcccttggaacatttccaaggaaaagaaaaagagggaaagcaggtgtagccattcacaaccagatacagaataatggcaagtaaatcatggtcgtaaaaacaatgactgacattttttgagaggtttctggtatgtcagacattgaattaagcaattttcatgctttatctcaattctcacaacctcctagcagtgagcagtggttaacatgcaggttcaggagccagactggcttaggtttgaatcctggccctccactttcagtggtgtgaccttgggcaaactgcttaacctctgtgtgtgtcagcttctgcatgcgtaaaaggaagggaatatatatacatcttattgtgtttttgtgaagattgaagagaaaatgcaaaacaaactcagtatttgcactaaaaaatgttagcttttattatcatttaatattactattattctttttctctttctacagtgaatcaatttagtgaatccaaatgactttgtccaggtcacagaggaagtgggtgtcattgccagaactgaactctatgcctccctgtccagcaaaattccactacatagaacatgatgtaccatgatcacgacagttccagtcagggagtgaagggagagagcccaggcttcggagctaagcacataaagtttgaatccagctcttctgcatattctatgaatcactgaatatatttacatacattcactgtattcagtttcatctctaaaattagcataatatcccatttttagagttgtgagaaagataataaataatgcatattttaaaaactggtaaataaaaagttcttgaaagtggttgctcttattataggcttatcacaatacattataatcaaatataattgcagtaatagtgtataatgctttaatatcaaaaataatttgggggaacatacacgtttataaacaaaatgcagtatgtattagtctgttctcatgctgctgataaagacatacctgagactgggtaatttataaaggaaagagatttaattgactcagagttccacagggctggggaggcctcaggaaactcacaatcatggcagaagaggaagcaaacacatccttctcatggcaacatgagaaggggaactatgagtgaagagtggggaaaaggcccttgtaaaactgtcaaatcttgtgagaattcactgtccaaaaacagcagcctaggggtaaccatccttgtaaccatccttatgattcaattacctcccaccaggtccctcccatgacacgtagggattatgggatctacaattcaagatgagatttgggtggggacacagccaatccatatcatggtatatatacacaatggagcatcatcagccttaaaaggaaaggaaattctgataacatgatataacatcaatgaaccttgaggaaacatgatacaacacagatgaaccttgattacattccgctaactgaaataagccagacacaaaaggacaaatactgtatgacgctacttatatgaagtacatactagtcatattcatagagacaaaaagcagaatgatggttgccaggggctggagggaggaagaaatgcataagtattgtttaataggtataaaatttgcttagaaagatgaaaacattctggagacgtttggtggtaatggttgtccaacaatgtgaatgcatttaatgccgctgaactgcacacttaaaaatagttaccattatacattttatgtcatgtatattttactacaatgaaaaagttggagaaaaaagaatatatccatctacgggaggaaaaatttgttattaaaattattgaaataagaattgcagtcctaaaattaactcatacctcatcctttttttttctttttctttttttttttttttttttgagacggagtctcactctgtcacccaggctggagtgcaatggcgcaatcttggctcactgcaagctccacctcccaggttctcgccattctcctgcctcagcctccggagtagctgggattacaggcgcccaccaccatgcccagctaattttttgtatttttagtaaagacgggtttcactgtgttggccaggctggtctcaaactcctgacctcaggtgatccgcccgcctcagcctcctaaagtgctgggattacaggcgtgagccaccgcgccctgcctgctcatgcctcttcaggaagatttttgatattttgcgttgaattcctctaagaagtcatttcagtctttatatttcacagtagtgagaaggagtgcatgactgttcttacccacacatatgttccttttcgaattggcagatgagtattcatcaatgtagattctaacaatactgtcagaggagaaataatattgttgtgacaccaagagaacatttttattgtacacattaccttggaataacatttttgccaggaaatttgatgcagcatacatatggtgcctgatagaaagaagccaggcgaaagtacattagtcctgtgtgttgtacatgatatatagtcaaacagcctgtgagatagaaggatatcattaactatgaaggtcattccatcatcagtataatgtttggaacaaagatatattcagttatgctgtttactctatttatacttcaactctgcatctttataaacctacctttctatgtgatttttaaaactcacagaagacttttttttaagaagagaagatctgttttgtttaaattgccttgcactccaaataaaaactattatgaattttaaaacatgacttcttctgacattgaaactcttctttttttt

SEQ ID NO: 1256 - DNA, 44992 bp, Homo sapiens
gtgactaaaacatgtttcaaaataagcacaatttatcaaaaatctgtccctgcgattggctaatgatcaatataaaaaacagtaaaaaacacgcccagttgcagtggctcacacctgtaatcccagcactttggaaagatcagcacaaccaggaggattgcttgaggccaggagttcgagaccagcctgggcagcatagggagacctcatccctatttaaaaaaaaacagccaagtgtagtggcttgcttctgtagtccaggctactcaggaggctgaggtgggaggatcacttgagcccaggaggttgaggctgcagtgagccatgatcacgccactgtactgcagcctgagagacagagcaagaccctgtctccagaagaaacaaataaacagacagacaaaaacatcaaatatacaagaaaagtctttctttgaattcttagtccacatttgtatcaaatggactaagtttaccttatatgaaaatgttgccaatttaaataatctgctacattggtgagtcaaactagccccgctaaaatgaatgtcattgatagctgtattcttatatattttctccaattcttttttgtgcttttactttttgttatttttctttacttgtttttggcttcctatgaaactcttataagcagttctcagaattggtgtcttagaccatgccaggtaaaacttttccattatggtaacatttatggtcgtttatttggcacatttggcttttgctctcaatactgtgaattacaattctcaaaattctaactcacattttctaggttgttttatttgaattgtttataggttgttgatttttcacactttgaccttgttatttagctatctttcaatgctgtctgctctctgccttcctcattgtggactttaatttcattctattagttctctccactaaggtaatagcaattctcttaaggttctcagaattctcatgtcagatctgcctttttcccacttctcaaaacttttaacctttgattaagtaaataaatgttcgggtactcatatgactcttatcagcgtttatatgagtgctgaggtagttagttgacaccaccagttcattcagttcactaccttttcaatgttcgttagttctttcctgttctcacttcccttctggacatttaactaccagtgtctttgagcacaaaccacctgtcatcactgtcaaaatgtgtagattaacacatacagttttcagataactatagcaataatctgtaaaccaagcttagctaaacctggggcaacataaatattttacaactacaggttaagctaggagagaatttgggtatcatcggattcatcatcttttctctatacaaaatcaaactcagaccactcccagtaaaaacaaaacaaaacaagtcattttatttaagtgaaaattggatgaaggaagttgaaaactgaggaaagtaccagaagttcctggcttaactgagtcaccttgtatgagtgaatcagtgtacaaatgagtgattagatctagcccttgactgacaactgttctgtgacaatcgtgctgtaaactttaatcttaacttcaaggcttttctatgtcagacctttaccgaactgataatacatcaaactcagcagttacacatcttctttaatagcagcactgtgagaggttttgcaaagaaggcaaacgttatccacatcagttagtgttgaaacatttagtgggaaaacaggttctagttatttattatccaaacagggcagtgagagatactctatgtttttggctataagtcaaagtaaatcaaactagagtagactaatctaacaatggaaagggcaaaaagtgattgaaaggaatagctggaggaatttgagtactgtacttatttttatttttctttgttttttaattattttcagttgctaaaattcacatagtgcaaatctaccaaagatctcaagggggctatagaattcctcagctactcggtttcctcccctagaggcaaactccattaccagcatctttttacccatccaatgatatttcaagtgtatgtgtttgaatgcacacttggtagattttatttctataacaagaaagttatgtgtatttattttgaatttactcatatttggtttaatcatgtgccttatgctcaaaaatttgtgttttctaaaaaatggtttaaaatatatataattttgtattgacaggaattcagttggaattttctgttaaaattttgatatactatatggcaacattatataaataattttcactagaaaaaatatatagaggaaaataatcacctgtagtcttgccacttagaaataagcacaataattattttggcttattgtttatacaaacatactgaaatattttctggaataggaattataccatacacagttgtccctcagtatctacggggcactggctccaggatccaccaagaataccaaaatacatggaagcttaagtgtctgacgtaaaatgcaatggttacatttacacataacctacacacatcctactgtatactttaaatcatctctagattatttatggtacctaatacaatgtaaatgccatctaaattgttgttatactatattgtttagggaataatgataagaaagagagtctgttcaatacagatgcattttaaaaaatattcttgatccacagaggactgattccatagacatggaactcaaggattcagagggttgactgtatgccattatggaatattttcccctgatgacaactatatatttacacattttattttcagccacaaataacaaatatgaaattgaaaatttaaaaaaacttattaaaataagggaccataaatttgatgttcatgctctctctcaattcagagtccttgaatgtaaaatggtgcctattaccagtgttatcagtcatacctaggttagcagtgggctgtttcaatgtcaggatggtggggagtatattgagcaatggttctgtgtgacatcctacaaaatctctccctcagggtccaaagtgggtgaggaaagccctgggatagggaaacacaaaagagagggagttagggagggaaaattcttagctggccgctttttcaaaggagcaagggagggaaggcactccagggctcaggcattcagcttcctgcttgtgccccccaccccaaaccaagttgctgtagcgtcagccatcataccaaccctgtcagagaaggctgcgtgtgaggagggctcaccaactccctgagaacacagtatagatccaagtatccctgaaaggagacagggaggaggggaatatagatgtactataataataaaaatactgttcaaagaccataatacaatgaaaatttatatataataaagagatagccaaagtcccattgacttcctatgcattttaagctatatttactgctaaagtattcagtgaaacttgtatatccctttgctgtgtttttcatggctcttccttcaccagagtgagcccattgccgtcctatacaacaggaactgcagcttcagcacgtcatgggaatcttcctgagttccatatcctgccctctcttccgatgtttttagctggttgggcatccctggtgaccgtcatgacacctcaaagctaggttctacctctatatccagcccctggctgccttgctgtggaacagcactcccagaaattatacagtgcatagcggctctgcagcagccctgatgcactgcttactcggctctaaattttagtgtcactgcctagatgcactctctgagatgaccctcagttctatctgaatactctcaccacccttctctcccagcccagctcctcagacccccaacttgtccataacaggaattcagacaatgaaatgtaatgaaattttgctactttcattgagcagaggacagaattactgttacagtagctcactgaaatacaagataaaaggaccaaggcaaaaatattttatctagtaattatcaaaatatagccagttttcctagatagataggtggatagatagataaatgaagcttctcaaagttatttgctaaaattttgcccacataacaaatagaagaaaccagatgtaagcaaatatctttgggaatgaattttcgatggtcacagaggactcttgtcaaaattgttttctccagctgtcaccttcactaaaagacatttactgtttccaggaagaatggtctttcatttttgcttaataggcaaccatggaattctctctctctttctttttaaatcacccagctacccttcccatctctgttcacttccagaattttctgattgtagtctgggcctgaaaacacatttcatcttggctcactgaccacaactttcttaaagttggctactctctaaaactctgtctcttccatgaaattgccctgaactcagtggagttaaggtattgatttctcacagacatgtcttatttatgcaaacaattgccttatgccatttataatatgttctaccccacaacatcaaaatccaatgcacacattctattgttttgcaggatgttagccttgggggaaacttggtaaagggtacatggatctctctgtttcaattttttttacaactgcatgtgaatctacagttaattcaaaataagaactttaattaaaaacataatgcccttattttctctatcttcctccctttctctctttaaattatccttttaaatacacatgtaaaattttacatgtaaggataaaatttttcctctgatcctttaccttgtttactctcccaaactttccaattttttttttaatatattgtgttttcagaggggtagagactacgtttaagaataagggtacacattcggttgtttggaagaaattttatgatgtataaaacaacctcctatgtatcttggctgtttctcacgctatgcttgaaacaccagaaatccatgtaaactgtaaaacaaactgatgaaaaagccaagtccctttctccacttccatctcctattcgatccagccccacccactgtagagtaaggcagttcctgaggtcaaactcctcagtcacaagacctcacagactttagtgagtacagatatccaaaccaggctgataattccaaagtaaaagatgccctaaaagccagagaaaaacagggattttgttcactacattaaataaaaatctgagaaaaccagagcaattcctgccaagtataattaagatgctgggagaaatgactcaaaagaaatatacctgcctttctcattctactttgtattggcctttctgaactaaggtgctgacttgaaaatgttatactcttgctggaagtctgctttaactatcaatacaaatattcttcaatcctttacaaataccgattttcatgaagaataagatacattacaacaaaaaatcctgtaatctgtatgaccaggttagaactccattttttttttaatcaaagacttgattttcacactttctgtggaatcctagcatttattatatagtctgggccattgtttctccataataaggccagatacctgaggtctcataaagtcagaaaaaaaaaactcaataaaatttttcttgattttatgtaagtgtgttaataagggcagttcctatgtgttggaggttaaaaatgtgaaatgttaaatttaaaaataaaagtcacagtgttgccagccacaatgtgactgtgttaatacataatatctaactggcctctttctcaagtactgacactgagtcatcacacttcacttactttcccattttcccctggagggacgtttctgttttgtcaacctggaaaacacatagtttgctgtcatattggattcagatttagttgggtatgaaagtgatacatcaatattctagtatgtgaattttctttttatgggaaggaaatctcttatctttgcttgttcagaaagtctcaactcaaaaaaatgaggcattcatttttatccttgtactgtagttttatgatagaaactgtcctccttgttgttacatttataagcacctcctaagctcctttttaggacagcttcagtgctctctaatttttataatctatagtccagatcgatcagaatctgctggaccaagtgaggataaaaatgaatgcatttcccaattcagtgcaggatttgggatgcccagaattgaaaaacatagatgtgttaagcggatctgttttaatatccagaaaagtcatccctcagcctgggcaagatgatcttgtgctcattactttacttcccagaatggagatgatgcataaaccacaattttaatttgcttttttttgtgcatgtgtagaataagcgacaaaatttcagcggctgtgattattataatattgccataaacctctctaatgaaatgccagcaatgttgagacagctttattcaggcataggtcaaaatagccatgcatatcagtacagggcgataaatcctggactccaaacaataacactgggccagaaaggaagcagatattaaggaaacaattattttattaatatgcacttatgtaaggcactttagacacaggcaaggtagatgattacatgagttaattaactaattaattttaggtcatttagagtatgtaaggacatatgaaacacatttttgtgtcatcaaaaaactaagaatcccttgtgagaggcctcttatagctatgagaagataacttgtaatgcaaagtgataattgataagtgtagacaataagtgcaattggagttcagagaagggacagatcacttccagacagattaactgagctatatttcatgaagaatgtgatattttagttgaatatgcaaattaaaagattaaatgtttgtcaagtgcctattgcatgcagtgcctgctcctgagctctgcgtgggtatcaagaaaatttatgtcacagtcttgccctagtaaagtctataatgtggccaagaaaatgactcataaacatataaaacacaaataacaatcaaagatctatttcaaggcaacgctagaagtgatcatgacagaaggcagtcatgattagttgtgctcattagttatgcaaacaattaattgctttagacattagcaaaaggaggcactcacttccctgacctgttggcagcatttgacaaaaacagtgccttctgtcttccaggactctacacactctttgttctccccctaccactctggctgctgcttttcagtctcctatgctggttaatcctcatctataaacactaaagtaattgagggctccgcctgtggtcctcttctctcttttgtccacattagctctgttgcaaatctgatgtagttcatggctttaaatcccatctacatgctggtgattggcaaatttttatctccagcctagacattttccctgaagtcctcctttgtttctccaattccccactcaaatctctacttaattgtctacaagccatctccaatttaacatgttcaaaactgagttcctaatttcctctttaaaactttctcccttgtattctatctcatctcagaaaatggcagctctaccttccagttgctcaggcaaaaatccctggagtcatccttaactttttctttctcttaattcccatatcagatcgatcagcaaattctttagttctgccttcaaaatttatccagaattagaccatgtctcatctcctttcttacttccactctggttcaagaacctatcaataacctcctggatttttacaactgtcttgtgacccatctttcttcctctaccctgtttcaaccaagcagccagagtgatccttttaaaatatcagtcaaattatgtcactcttctactcaaaaccctccaatgacttcccctctcactctgattaaaacctaatatactcatgatgacctacaaggtcctacaggggctggccctcattctcactgatgtcatctatttttaccttctgacctcttcactctttcttgaacaaaccaggagcactgctgtttcaagctctttgttcttgctgttttctttgccttgaatgctcttccccaaaataacttcatagcttgctacttcatgtccgtcaagactttactcagtaaatccttccttcaccacctcaatctatcttagactggattcctcagaagcagagcctgataaaaggattttagatggtattgatttgggagatgataccctgaaatagcagtaagggaacagggaaatgagacagagaaagaagacaatatagggtacattaatgagtgggttaactctgtggccaaatagggctcatttcccactgggagcttggggaggctgtacagaacacattgtcctatgggaggagtatttaccctcctcaattcctgttagacattggctaagggatgctcctgggggtgttaattcctggcacttctaaccttgcctgtgtgtaggcagagcaggcatcagcggtcagagaaagcctttaggtagaaaatcagagatgcttacaccagaaggcccttcacatgtccaagaatattcagaatcaaggagatataagtaaggcattgccagtgctgcagcctccccaaaattccgtatcttccttttgctgtttttgttttatccctataacatttaaccctatatttaatacaatatattttccttacttatcttgtttacttttttcctttatgaatcatgaattttgtctcatttgttcactgctatatccccagcacctaatacagtgctttatacatgagcagcaataaatacttatggattgaaaaagaaatgagtggatgaacaacttcaggatgggtaagtgatccaggaagtcttagagaagggatgggatttgcactgagtaaacattggttaggtggaggcagggtcaggagagcagcccagcagtggagaaccacaggagcaagagtaggtgagctaacatagggtaagtttaaaaatgagttaattccttttgatagtagcagatggtccttataaaaataaaaataactggagtaagacgagataggtcttgtccaggcaaactgtcagactgaggaatttgagatcttttctgtaggcaactgggaagaaacaaatgttttaaaacagaggaatttaaactgtgttttaaacccaattaaacacgttttaggaagactaatctgaagttattagtaagctgatttggggaaataggaaataaaaatgagtgtagaagctttttcagaggcagaaactggggcctgatagagttttacaaagtgactaagaaaaggctaattgaatgttggagatagtgtggttaagctatcaagatcagggttagggatgacagaggggagagcctgcattgaccctaaggtctagagtctggaatttagtggtacagctaatagatgatgcacccaaagaccagtccccactccagggctcacgcttgtttccatcatcctgggcatacccagcaaaatccaaactcggctgagttttgagaatcttctggaactcaggtgacctaacattgatttgggcaccttggatttttgacaaaggtagttgttcaaaaaaaagagacaagtgagaaatttttagcaatttaaaaatgttcccagaactggctctgcttcctaaaatcagcactcactcctgctcccttccttatccttattgtctgtggttcttgggattcatactgcagcttaatgctgtggggagcatcagtctacctagtagtgcaaagatcccgccctgtctccagataaggactctggcagtcccatcattttacagatcaatgaacatctgaagcacttgtctagtttgggaactgcctttagcagctagcagtttggtcaaaattcattccacagttttcctaaaaacaacaataatagctacaatatattgagtacttattaggagccaagcattattctaaacaacttgtttatattagttaatataatcctcccagcaacttatgaagcaggtttaagtgttcctagttgactaatgaggaaaccaaggaacaaagaggttaagtaacttatccaaagtcacacagctggaatgtggctcctccttgacacctgctcaccagccagctcctgaccctcgggaggatgggtgaggagaggtaagggagggggaaggtgtacttgaactggtaccatcatagactagctttacattctttggattttctagatataataatgtggcactcttacaggtactttcctggcctttttcaggctattcccatgatggtggtgttggggagattctctcttgaaagccactagatccaattgcatctgtcccagttggtgatttgcaactctttcctgagccccgaggcatccagagtgtaccttcatattctgccattcagccttgcaggcagagtcatagatatgtttatactagcttccacacctcacagtgtctgcagctggtccataggaagcattcaagcatccctgacccccaagaactgtgggagtacagattcatcccaacatagccatcactttcctactgccacagctcctttaggtttctcaggtatgagctcaacagaggtgactttgaaacagttcactgaactttcctttgcaagttctgcatatggcaaaccatctcccgctcactttggtatctgatagctaagaaattgatgcctcaactgaaattcaggcaggaggtgtttgttttttaacctttttggtatgtttactatcttcatgggattccatggagacatcctggggaagaaaacatgatatggactagcatagtatgggccatgaaatcaaacagctcctggagtgccatgcggcaggaggcaaagcagaaaagaggtgcaaaggcaaggccacgaagagccccatgccagaagaactgacttcatgtgtgtggggaagggaaaccattggaaatttaaacagtaatgcttaacttagatgtcatgatcaagtgacattccccaagggaaaaaatgtgggaattacagtggtcaagtgattaaatcctggaaacaccagaatttacaacacagatggacttcatggatatttgttctatgttgtaccagtttcgtccgtaattcctgtgttactactcaagtctactgtcacacatctgcccaccacatctttttgagccttctgtttcagccttcttttttcctttcatttatcatctctaggaaatttttcttttcctttcttttgcaaaagcatttcctcatttttcaaattattttcagtgagttctagtttttattgtattattgaagattagaactttgtaattgtgtcattaagtctggaaaaaaatgggtgttaatgctaagtcatccctgatatcagtaatttctttcagatattgggcctaaaggatatggatgcttgttgaaaaagttatgagtattgctataagctctcagtttgagtatgtacaggaagaagaaataaacacacatgtacacacattcacacacaccctcacacagtgagtactcaagtgatcaaagcaaaaaatgtttaccccattcatcatgcccagccacaagcctttaaatataattttttggctgacatggatacattaaaaaattataaatttttcctataatctcactgattgttccaaaaagtttccaaattactttctctatatttcaacaatataaatcatagtgtttagtctatgctttctaaacaatttctgaaaagattacaaaatatactagccctccagctcaaaagacctattttttagcaggactgtttgtctttggaacatttcatataaaattcaaagtaggaaaaggaaggcaagaccaccccaaacctctgctgagtaacttcttttctgcctgtccctgtgtcaaggcagagaagagaaacaaaggcagagacctttagtcaactatttaccttttactcaaggataccaatataataactttgcttttctattactagtcaaaacaaattttctgttggacttttttttaattttaattttgattttaagttccagggctgttggacttcttaactcagggacttctcgagtttgaacccagcctctttctctggctttgactgttgcctctgtccttcctcacacacatgctgagatttctgttccagaactcccactcccctttctgcaaagggactaacatctctgtggctaatgtaggtctgtccacattagtatcttctggcctggaatgttttctggcagttatcaggtaacttaagcatttatctgcaagattagttaaaagacttgctgtatagctgtgatattgattcaactcatagtttgactcaattagccagtttcaaatccagtttcacagcaggaaatttcacacatacaaatcagcacttttgagaagcctgatgaaataatggctagtttaccctgaaacgctttgtaatctagaagccaactgtctcagtaaatgccatagtaatgagttaattatcctagcccagtggttgctggggctttctgccaacatcctttttttccacttgctgcaatttctatctcacaagcagtcctcttctcaacttccttactaaaaaataaaacaaaacctactttatcctctcagaatgtccccagtgagtctccacttctcaaatgtttggtaacccatggcagctttcttccacttccaccttactgcagtctcaatatcattgggttttgatggcttcagcattaataatggatcaatctaatttagaggatgcatccaggcctcaccaaaatgttgtgtgtggaactgtcctacagaaggagtagagggcaccaaggttctattagaccaaatcagatgatggccaaggagaatttgccctatattaattctaatgtaattactacataagttcagagcccagaattggggccctatttgaacctggatttactgcaaaactacaccaaatccaaacactgaagacttttctagaaacaatttccagaggatgatttggttggtggcaatcaccgtgacccttgaaagcagtgctgtttattttctcccttcttctacaattgttgtattaaatatatatgtcatgcacatatatatggaatttttaagttgtgtgattttgaccatcaaattaagagcccaaaaatatagttccaaattgaggtcagaacagcaatatccaattgacaattttaaatccattggttgtcagaagaaaaaagcaatgtttatttgttaatactttttaaaatcctttaaaaaattaataactttagctcagtgataatcatgagtgtgaataagactttagctaagagctgattataataatgaaaagcgtgatctatctagatttcaaaaatttatgaatggttaagtacattacagtatttccacaaaatgttaaaaatggtgcaattgaggaaaattactgacatgaacagatgttcatgttatgttgttaaggcaaaaaaaatttaaactatttgaagtatataattttttgtatggatgtacacacagacacacagagaaaaataatctagaaaaacatatctgaaaacattattagtggctatttctgtgtggtagaattacaggtgactgtattttctttcttttactttcttttgtctactcatccttaattttctacagtgacatgaactacttttataataatagcctaatttattttttcaaacaatgtttgttcctagacttctttacagtgttacttttagagatgttagtggttgggggtctgcaggacacctaagaaagtttggtttttcctccctgtgatggggttcaggccgattcatccagtgctcattaaacagaagcctataaacaggcatgtcgcaggtgtaaactagaggaagattggcttctgtcagcaaattagccagttataccaatggccaaactaagcaccccagtgtgcctttgcagataaaattaaggataaaattataaaatatccatgtaattgttttgaacaactagattggtaattttttccctttaaaccacttttgatctttgcatgcttattattcagagcctagtgaattgattacaaagaatattcatttttgactcctacaagagtaaatagatcatgtgcattgtacagattcaattcagttcaaatttttaaacttttactgagtaactctgcacatccccagaaccgtgttagacacagtagagtactcataaaggcaattcttagaggaattcacagttttgtcatagagacagataaattagtaaatatttctgataaatagaatagaatgggcttccatataagcagggagtaatacaaagcaagagtcatggaagtgagggagaaagagaggttaattctaactaaggaacaggaaatgtttcctagagaaagtaacattttggctacaattaaaagtgtattaatcttctttgggtcatagataacagaaatcaagttcaaactagcttaaataaaaaagacagtttgtcggcttatggaataaggatttcttgtttaggcaaggctggatccaagagttaacaagactttgccaccaggcttagctttcctctttgtgactttttcacagacaagttctccacaaagatgactgccaaagatagaaacttacatactatttttgtccagttaggcttctatttaaaaaaaaatgccataaactgggtaacgtaggcaacagaaacttatttctcacagttctggaagctgggaagtcccagatcaagatgccagcagattcagtgtctgatgagggcccgctttctagacagccatcttttagctgtaacctttttaatttgttgagtaacctccatactattttccataatggctgtactaatttacattcctaccaacagtgtgcaagagttcactattctccacatcctcaccaatacttgttttccttcatctttttaacagtagtcattctaacaagtatgtggtcatatctcatttgattttaatttgcatttgtctgatgatagtgatattgagcattaaatacctattgaccacttttatgtcttcttttgagaaatgtctatttagatcctttgcccatttttgtaatttaatttatttttatttacttatttttaatttttataaatatataaaacttgtacatatatgcagggtacatgtaatattttgatacaaatatacaatgtgcaatgatcaaatcttagtaattgggatattcatcccctcaaacatttatcatttctttttaaaatttattttcaaggatggtttcagaacatttataattttgtttgtgttgggacattccaaatcttttcttctagctattttgaaacataacaataaattattgttaactatagtcaccctgtatcttctttctttttttttaacttttattttaagttcatgggtacatgtgcaggatgtgcaggtttgttatgtaggtaaacgtgtgtcatgggggtttgttgtacacattatttcatctctcaggtattaagcctagtatccattagttttgcccatgttttaatgggattatttgttttcttactgagtagagctccttatatattttgcatattaacaccccttatcagatgtgtggtttgcaaatgtattctcttgtttcacaagttgtctctcaactctgattattgttttctttgctgtgcagaagcttttaagtttgatggaataccatttgtctatttttggttttgtttcctgtgatttggggtcatatccaaaacataattgcacagaccaatgtcatggagcttttcgcctgtgttttcttctggtaactttacaatttcaggtcttacgtttaagtcttcattttgagttgatttagtgtgaggtaagggtctagtttcatttttctgcatgtggatagccagtttttctagaaccatgcattgaaaagactgtcctttcccattgtgtgttcttgacatctttgctgaaaatcaatcaactgtaaaagtgtggatttatttctgggctctctattctgttgcattggtgtatgtatctgttattatgctggtaccatgctgttttgattgctatagctttgtagtagattttgaagtcactgaaaactacttaacattgataaaagaatttgaagaagacatggataaatggaaagatatctggtgttaatggattggaagaattaatactgttaaaatatccattctacctaaagcaatctatagactaaatgcaattcctattaaaatttcaatgacgtgtttcatagaaatagaaagacaaccttaaaatttatatgcaaccacacaagaccctgaagcgccaaagcaaccttgagcaaaatgaacaacgctggaggcatcacattacctgattttaaaacctagtaattatttaaatgtaatgggaactggctatttgaagtatatcttgcgataagtacttttgtaaagcaataaattaaattgccagttgaaacactggcctttaatctagaaccagaaataccatttgacccagcaatccaattactgggtgtatacccaaaggaatattaatcattctactataaagacacatgcacacgtatgtttactgcagcactgtttacaatagcaaagacatagaatcaacccaaatgcccatccatgatagaccggataaagaaaatgtggtacatatacaccacggaatactatgcagccataaaaaggaattggatcatgtcctttgcagagacatagataaagctggaagctatcatcctctgcaaactaacaaagaaacagaaaaccaaatacggcatgttctcactcgtaagtgggagctgaacaatgagaactcatggacacagagaggggaacaacacacactagggctgattagggggtgggttgggagaggagggaacttagaggatgggttaataggtgcagcaaaccaccatggcacatgtatacctatgtgacaaacctgcatgttatgcacatgtatcccatttttttcagaagaaaattttaaaaaagaaacattagcctttaatttttatgttttgtaagtctgaattattatatattgacttgacttagaatagtgtgtactcagactgtctttttttaaaaaaatgaattttaatccatttaaaatgtaattcaacttaagcttttagaacattacctgtttccagtgaatgattaataaatataaatacatgcttccttgaatttatatcagtaatcataaaatcatctatcagttttaaaagtctacgtgtaccagacatttgtttgttccttggcatagcaatgattggatatgaattcattttatgattcacagaatccccatgggctcatagtgatatgggcgtttgaaatcaggccaattgatgttttaatcctttctgtccttcaggaagaagtggaattaaaatctatgtttttgttatttagtatttgtggcactaagctaagattacagataaaatgtagaattagatccttgccaaatggattcataatctaaattaaacagatatacaggaaactgacctcgggaaataaattgtaggagtgacaaattggtgaaaaactcaggaacaaaccaaaaaatctaaacagagatagtaaagtactctattattaatatttcctggtaaagaacgaaggcatagaacaaaaaggccaatttctgaatccagttctcccctgaacttcttgcataagtttgagcatggctcctttcttcaccctgcattattttctgtatcttcaagatggttcatcctttacaaagaagttggagtcatgtatgaaataataaacatgaaacacttcaagtttctcagaataaagtttccagagcaaaatgaaataataacagggatacactgtatgatttactgctgatagtttatcttataaagcaagtaaattaggggctgaaattttatatattagaaggatttatttcaaaaatgattttaagaaatatacaatcagtaaatttgaactaaaccaatttataaaactttgattcatacacaacttttggaaaacatcttgcattattcagagttattatacctttgtggatttaattaatacccaacacataaggcaattctttaggataagtaatgtgctaaatcagtggtactcagagatatattacatttgagccattgataataatgaagtattattaaatgacaacttcatgttaactacttaataataaattattaaataataacaaaaatccatgtaactgttatatgccttttaaatattttctgtgatattaaatatactttctaatatagaaattgaaaatcttgaacctctctagattacaagcaaaaaaccacatgtgccatctcctattaaagtgaatgatcagttaaggaatattttgtgacactggattaaagaccttaagaactaatagtggttacaatgtaataattagtatggaattatagacaatttcagaatacataaaactagttttttaaaagttgtctaatcctatattgaaataaaccactgcatataatcatatgaatttgattacaaatgaggctgtgggttatcttgaggacaggatgaatgatgggaaagtgaaaaatttcccaagatggttgaaagacttgtatacagcaagaccatattgcataaaaaataactgacatagtcaccacattttgaaaaggtgccatgtgaagtcatgcttccacattcaatgacagaatatccttaccaaaataatattggtatccaatatggagaacagtggatgggacaatgtcaaaaaggaatgggatcaaaagatgagcaggttgctttcttccttaccccttgaatagaccccacacacacctgaagaaactgagtctgaaataatggaaaaaagctgtagttgttggcctttgtctgcagaattcctccatgtctcccttttatatcccttgttcccaattcccctaatttctcggcacattttctttaattggattctctgtctctttcatttccctaactttgctgagctggttttaagccagcaactctgattttcacttgtgctactcctccatgaattgattattgatgaattaattatccacctatgacctcattcacagtaagtcatgagtaaaaggcacctactcctgttccctgatgtagcccagtagagcctgcaccaatacggctgtggcctgaccagtcactatatgattatgaaaggagatccaacttaaactaaagggaattattttgaacaagattcatcaaaatcagagcacatatctcaccatattcagacagctgaggatagttgtccatccctctactaaccaatcactacctataacacagtctggattctttcgtaattcttggtacatagaagcttctcagaaattatttgatgaaaggatggataaatgaataaataaattattataaacacttgctataagatctaagaataattacactggttgttaagggtgtgcatgaaataacaaaatataatgaatccttaattagtagaatatatttaatgatttccatttacatttatatcaagaaaaaaaaaggaaaaagcaacccagcacatctacttatcatcacttttcaaacatctgtggtttaaaaaacagctttgaaaatcgttacttgcctcgggtaaggtctgacttctgctgtataagcagtaaactattctaaatccttacacactagtacatatcctcatagagggcagttaataccaattaggcccaaatcttcccattctggttcttataggaatatatagatgtatgtttgatacaaaacatattcaaaatttttttaaaaagacagaagtaacagatgcatcatcccaatttcttggaaaaaaaaactgcactctagaattcctaaataagaatgttaacagaaatggttaatggagacagcatgcgctggcatttaaaatgcttactgtttaggaggagaaaacatcctaaatacagtgcttctccatcagctcaatgttttttgtttcttcagactgataggctggatgtggatagcttgtttagcaacattgagtccgtgcatcagatatcagccaagctgctgtcattgttggaagaggccacaacagacgtggaaccggccatgcaagtaattggtatgtttattctcttctcgagttctacaatacaacaggaaataattttttaataacctccctttgctttggttttttgttcctgactcaccatgcttcccaggagatatataaatgctaaacccatctttgggctcattgtgattatgcagactctgtgtttattttcaaatgggtttatatccatttgctgaagtccctcagtagcacaaaacataccatttgctttttaatttccaatctttcaatctctttgctttccagatgttctgtaattttttttaatggctaacacttacttgatccttaaagaattaattatttaaatattctaatagctttactgatttctcattacaatgttttttagatcttatgcccatcaatcaatttttttagattataaacttcttacctgaggaatgtaaaactattaaaggaatgtaagttattaaaaatttacacaagttctactttttttcatgctctctttttttctgtattatttaccttccaaatatgtttttactgtcaatcagatatatttattttcttactatggtaggattctcaaaaataacaacagaaaatataatttgaaaagtattgagccaaatttttatgctctccatttcttgggaatttccaagggaatatgtgctatgaattccttaaaggcagtttgcacttcgagacatcatacagtgtcatgtaggctaagagttttttaaaattatcgtttctctatttcacacttaatatacaataactcctcattacaaaagtactaaaacaattcaggagcacgtagagtaacggtaaaatttcctttcatatatccctccaatgccactgccttccccacaagtaaccgcttgtttgatgtagatctttactttgagatacacacacaaagactacacacaaacactttatgtctttactgattatgtctttgttaccttttatttgttagagttataaaaatgtcatggaactggtcttgtttaatatttatagagaaccaaagtttaatgaggaaagctgatcaaagacatgaaatatagtgaaagaaatgactgggtaataaggccagcccactcagaaagatttcttccacagataggtttaaattcaattgttctttgtgatgaaatgtccccaacaaattgtaaaaatatttcctaaaagaagaactctactcattaccacactaactcattagtgtgaattcattggctattcatttattaattcaatcaatgaatagttatgaagtagcagcatattcacaagatttggtactgtaccacattgcttggtatcaaaaggtgaaagggctcatttctctctttcaaaaacattcaatcaaacagcttcttgaattgaaggtgtgggtataatacaccatcaaagcagtttctacactactgcaaaccttggaggataaagaaaacatttctagatggaaactccaaggattcttgaagatgttatttgggcttaaagtatagattctatttcaacaatagggtccatgttgaggagaagattccaaatggaaatgacagcatgaaaaacaagtgtgaaacaaatgccaaatgccaagtgtgtttaggaaatgaagagtgatcaagctggagtgaaggacagatgtaagcaagaaatgagaaatgaacctgaaagtgcagagtagggactggcagcatttggaaatgaagtttggaatttactgtacaagtaataaagagccattaaaagatttctggcaagggtgtgatgagacacaaaagtttctggagagagaaagatatggtaggtctgaacagcatgcagaggaggaactgagtcctagactagtaaataggttgttataagtaatataggcatgtggtaataagcattgagactaagggagatacagtgaaaatttttaaaaatggggtcatttcaagagaaatgtagaagaaagcataaacaagttgttgattcatgtgctgaagtcaaaaacaattccagatttaaggtgaccatgtattgtggtttgtctagagcatactgattttagtgtattacgtaagcattcagtccactttagcatttgtcatggacttttcctttttaaaaattattattattattagttgcatcagaagaggttttataagacctttacatcatacttcaacttctgacacaatctcttttagtagagtgtaatgtgcagttaacggttctcactgtaacacatggtaaactctgaaacatagtccatctctcgtatgccaaccttttctagtctcaaggaaagttctatctttctttgaattgccacatgcagggaagtggctgattaaatgatgctgtttggatatgaacagctagaaactgctaactcctttctgtcctggtggttgtggatgtgttggatgctgcagaccccgccatctactgggtgtagcagctagttgtgtcatgacccatgctgggtggcccatgtcatgacctatgagaggcatgaagccatcgggatgccagtcagtggggttaatgggacacgtttttacagaatagatgtaaataaaatatgtatggaaaatagggcctgagaaatcatgctacagagtgtctagaggctcttgctatggtaatttggttacctattgcatgttatagattgacaactcttttacaaattttttggttatgtttcattctgaaataaaccttttcagaagcaagaatttaatatattcatgtttgtattagtcagttttcacactgctataaagaactacctgagactgggtaatttatgaagaaaagaggtttaattgactcacagttcttcaggcttaacaggaagcaagcctgggaggcctcaggaaacttacaatcatggcagaagacaaaggggaagcaaagaccttctccacactgtggcaggagagagagagcacgccaagggggaagtgcgatgcactttcaaacaaccagatctcatgagaactcactcactatcacaagaacagcaaggggaaagtccacccccatgattcaatcacctcccaccaggcccctcccccatcacctggggattacaattcaagatgagacttggcaggggggacacagagccaaaccatatcaatgttttagaaaaattttgattttctttatctcaagaaagttgctgagcctataacacacaaaataccatccatcaaagggtcctcaatgctatcattgaccatagacaatcagaagatggaaatatgctgaagcagcggcaacatctatgtcaaagtttagtcattatttttaaaagactgtgctctaagcaagtgattaaatgcatgcagctgcttaaggtgtgtttacatttcactgcatgcagcatggcttctcatttaggtcagacaacagttttcctagattaattacattcattttttaattctgagtttccttaggcctatgagaaatataaaacaatggttactaatgagttgacaccgttagcaaaagagtactgcaaacagttaaatgatgacagttttatatcaatgtgagcagatgaatcgaataatagtttcaatagcagttaaaattttaaaaattcaattcacagaaccaaagaaaagcttttagaagtttatcatgtcaatggtgaattgtctgaccttattataaatgctgtcactttaacttaaaaattaaacattgtgactgcaaatgataacataaatacaaatattagtggagcacagcatcatagtaaaacaatgattttattaaaataaaaatctatagagcagacgtgtagttgaaaatgattggtgtatatatgatgaagttgtggaatttattaattgaagtaaaaactgtagtgaaaatttgcatttatttttatatacacaaaattagagtgaataacactacctgaagaataaatttgatattgaattaaaaataatcttatgtatgaaactatacactctctttcctgctggtcattaatcagtctttggaaatgtttgattctttgaagcaccactttacaaatcaaccagagtgtcctaacatggcattggactatttttgtaaacaaggcctctgaaattgaattgcattttgttaaaaatcagttggaagtctttagttaaggtattcatcaaatggagaaaataacttcaatttttaatctttacaaataacaattattaaaaacaaaattgcaaataggaagacattgaaatgtatccctatgaaaacaaggagtaagtttaaaaaaaataagcaatgagagctcatgtataaaatatttaattttgaaagtccataatcatgctttggaaaatctgacttatgaagagaagcctttgatggagctcctctttagtaggataaagtaatattctgtaccagatttcacaatctacatttgggaaaatattccaaaattacaaatagaaacaacttacttggtgagttttattttgaaaaaaagagagagagaatgaaagaaaacaattcaaatggaagcaaaaagataatgcctataaaaatatttcagctcaaatatttacttgttttaatatgtatagtaatgagagtaaagcttctatttaccataatttcctctgagctcaatagatatttccttgcttataaagtattttctcagttttaaatattatggtttacaaatttcagtagtaaaataaatatgctgatattgaattataacccacagaaatatcaatgagttcttgctgatataaataaatgtggagaaaggacagctgtccattacagattttaattaataaatagagaaagaagaacggctgggcatggtggctcacacctgtaatcccagcactttgggaggctgatgtgggcggatcacgagaccagcctgaccaacatggtgaaaccctactctactaaaaatgcaaaaattagccgggcgtggtggcacgcacctgtagtcccagctactcaggaggctgaggcaggagaatcgcttgaacccaggaggtagaagttccagtgagctgagatcgtgccactgcactccagcctgggtgacagagcgagactccatctcaaaaaaaagaaaaaagaagaaaatagaaaatcaaattcacattacataaacaccacagtcaactattgcagacaaaatctactggttgatgctatgtttagtgggtgaaagttagaggagaaatatacttttcatagtctcaaaactttctccccaagtaattattaacctcaaagggaaaggtggtaactttacattgagaaacctagcagaggccagccacctttatctagagatctagagttaattttccttctctgacaatcgtattttgatatgtaagatgttaatattggtgaagctgggtaaagagtatttgaaaactatttgcactattttttcaacttttctgtaaatcaaaaattagttcaaaatgaaaaattgaaaactatgatttacagagaaaactcaattgaagatgttcatactttcagattcactaatcatagaattccaactttgaggaaaattacagaaaattttatttaaaaaattaagacaatggggccatatttgaaaaagaatcagttggagtctcattttaatatccttatcctttgtatctgggctggccttgcgacttgctttgatcaatgaaatgaggcaaaatgatgttctacaacagcattatcacttctgccttctgcttgtgaggggagaggcccaaactgcccagccattcaaagcaacacagccaaggcctcaggcttgagagtaaggtccttgtcagctggccagctggcccccagccagtccaccaactgacgggaaacatagaagtaaaccccatcaatgccagttaaatgctgcccaattgttgacccatacaattgtgagcaaacgaacagttattgtcttaagcttttaagttttggagtgattcttttttttcctgtggtaattgctaactaatacagattaacaggtgagagactaacttatttcaactcaaatggtgagggaaaacttgatttggaagtggtttttgagcttgcacttgaaagatttagaaaagtggagattgggtgcaaaaggctttctaaatgagaaatagggtaaaggcctcaaagcaagagtacaggaaattctgaaaaaggatagcagcagccctatgtgactggagcatagtgccgagaaggcctctctgagccaaacgttgtagacagaccaaaatgagttcactggcaatttccattactaaaccttttaccaaagcactttcattccataagataaactgattgttggtgagatgtttccaaaattatgttatcacaaatgaaaagcacaggtgtcccatttctttgtccttagatggcacaaataagagtttgtgattcacagctgtagtgccaaagggagaattttcctgatacctagataaactatgaagaaaattttactcaataataacactggagtttggataaggtttaagtttaaacacaggggcatatgcttgcagatctgagagctctgaggaagttgtctgtactgtcatgccaagatacaaagtggattttaaaatcttgacttaagcacagtgtctagataggaaatgggttttcaatctttatagatgggagtatgaaatgtggctcttgtttccacttagatggcagtgtagagtttaagaacacatgggttttaatatcaggttgacttgggttacatctcgttttgtcctgttgctagatgtgcgatcttaggcaagttacaaaacctaattgaacttcagtttcttatctggaaactggaggcaatagtacctatcccatatggtttttatgaagatttgacaaaattatgtgtacagaatgatagcccagtgcctatccctaattaatatccaatagatgatgttataaattattatcccaagaatattagatttactcatctatttaaaatgcctgattttttctgtatgtaacaagtgaataaaatgtgactttttcttagaggtcctgatcatgtttttcaaacaagtcagatttgctggatgtgtgtgatttctagatgcttccaatatctatgcatcttaatgattcatggatctaatatggtgacatatttttttctgtgaagggagatttaacatatcaagtgtcattttcacatttggtagagtgaacagcaatggcagtaattagtctccaaagatggccctcaatggaccatgcctcctagttcacattgttatatgagtctagtgtcatattgactctggactggccctctgattcactattacaatgtggtgaaaatgacactgtatcagtaattgggcccaagccttagaaaagcctgacaatttctactttcataattttggaagcctgccatttaaaaagttgagataccttactggaagtatcatggagagagacagcagatgagactatgtagagtgagaaagtggcacagctatcccagaatcccagcagaggccagcctcccagctgttcctgccaaggcactagatttgtgaaattagtcatctcggacattaaaacccagataagtccttggatgactcagcctgagtggatgtcaagtgtagcaaaagaaccacagagttgagcccagtcaatctacaaaattgtgacagaaaataaaaatggctgttgtttcaagatactaagctttgggatggtttgttacatagcaataaataacccaatagcaatagtcctcttatatgtgtttgcatattataatgtttcaaagtattaaaacaagactgtcatgaacatgcttgagtctactttactggcttacctcatgcatagtgcgctgagaatcagactgaaagaagcttttgataaaggaattgtaatttcttgtatgcattttcctgagggtgactctctccttggagagaaataatttagagctttctgttctttgaaggtgtagtaggtgatgcactgttgttctatagcagtgctttgttttcctaaagcaatgtttcttgtaggtccctgaagtagaaatctgtgcctttagcagtgagtttgtgagaagagtactagttgctgacaattcatatcataatgctgtgtgggagatactacattggagctcacttaaatgaatttttcaggattattattgtgtgtaagtgtgtgcatgttttactcaggacacaaataggcttgacctggttaattttggccaactgggactggttgggagggtcctagacctgcatacttgaatgtatgaggtcagtgcggaggtttgggggacacccagatgcaacagttggaagatcagaatgcaaatgttagaagtaataggaaagctgtccgctttggagaaaatgacaatggggaaatggtattttcaggatcaaggatacaccaatcctcacaagaaagaaaaaatcagcaggaagcaggtaccaggctgtaacatgggggttggacttccagtctcctgagcggggtgaatatgggtcccagtgctgctaggacttatttcttacaataaaaataaaataaaggtggcttagtaaaaagtcttacagttctgatttctgaggaggatggtaagttctaggatgctatgctgatggagcctgccagtggaagtcagtggcttagctgtgccaggaggagtattggagagttgaggtcagatttgaatggacctgcgaaaagtcacatattgcgcaggatacacatagaaatacatttctaaatcccaggaaggaatgtaagagtctgtgagttcctgaacactttcccagcctccaggaagctaaaatgagaagtacatagaaagagtaacaaaccttgaagttgcccaatagcctggaaagagcatggcctttgaagtgaaacagatccaagtcttaatcctggctgtcatcactagtttgatggctgtgagcaagtcacttgagccagtgaggattcagtttgccttcctgtaataaaaagctggccaacagggtttgaccaaaaaggggtttatttttctcacgtcacaagaaatccgtaactcacaagtccaggactagtgcaactgcttgctgctccttcaacctcttcccttcacaatgctcagcatgtggcttttgatatcatcccttagatggctactccatttccaggcatcacttcctaaagacaatgaagcaaaatcacctcttcagaaggcttttgtcattttgggggaatataaccattttcccagtgacttctacatatatctcattctattttgcacacatgttatttcatttcacatacatacacacacaaacacacctttgcacacacacttggccatctaaataccagagatttggggaaaggtcaatatttttaactgggtgtgttaccagtccaaattctatgcctttggaagaaggaagaacagataagtaaatagcaatggattccacatgcatttgttcatcttttcaatggggacaacaagactcccatggcaggaaaatatcaaacactgggcataacccctccagaatgtacgctccatgagggaaggaattcttgtctgttttatgactgttgtgtcaccagcacccagaacagtgtctttaataactatttgctgaatggatgaaattagagataatagtaagcgtgcagtgcattggctggcacacagagggtccaggaggtgattgttgttactgtcgtcactgagtctgtctgtggtcagtgtcattgtcaaatgtcactttcaaaagtcaatgtcattgccagagattgctaagtaatatagagcaactagctacagcagaggcaagctttctcaagagaggtatttactaacgtgagttaaatggaaaatcatggattggtctaagacagggttttcctcagtgttgtcaaccttacattaaaaaaaagttatgtaccttttcctgatccagccagcaaaactttcactttctcagagaaccaatgttgccttaagatgtcagttgttaaagaatcctgacctggagttaaagtatctagaagtcaacaaggttcaggaagacatcgtgagctatcatcaaaatatgcagctgtatttttaaatgttagaactggactaatatttcaagagcatctattccattactgagacaaaaacagtaagagctgatttgcccaatttatattagtaactctggacactctcagaagggactctagctcttccaaatataggccagagctttttcctctccaaacattgaccctctccacagcccactagcaccccccagtttgtcctgctcagctgctagccacctcccatggccagatgtactgagtggatgccaccttagcttcagaacagccccttctttgagagccccaccacaattatgacattgtcttccctggcactggacacagagatgatcacgacaggttcccatcctccactctgctcttttcctttctctgtttctctctttagggtccagctcccttcattggtccctcttcttcatctctcattccctcctaaacccaaccctctaaaaatgctattactgcatcaccagggacctcagaattgtcaaatccaatggacacatattttttctgaacttatcttacgctagtgcttctgaaaaaaaatttttaccagaatattcccaatatcaagagagaaatatcataagcctcaggaagtgtggagttatgatctgaagctagagccacaggcgtgaaataatttggaagtcttattttgtcgtaagaattcatgtcagttttccagtctactcttctaggaaaccagagtttttttcttcaaatttcttaataaaatggatactcaagggatacacttgttttaatcccatggctgcatgtcccacctgctgcctgtatttggtttgaatattataaccctagccagggtctcttgggtatccacagcagcagttttatcccctaggctaggtggaagctaaatgagactgaaggcaagggagtgtggcttctttaagcagcatatactctttcagtttctttcttctcacttcctctccttgttttatgctcccttggagaacagaatgaggctaggaaagaaagggagaaagtattcagatgatctggcatttgggctggcgaatctactgccttgtttagtcatggcagctgggctcccatccaaggaggataagaagaccgcggggagcaacccttgaacttggggtgaaagctgccaggaaagctctttcactggagatggcataccatggagctttcgctcagctgtgtgtgtcactcagggaaatgacagtcagaggcctgtattgttgcacccagatctcagaccttctttccagagagtgggccatctctaccctctgttcatcacacccccttctctgtattctaaatactctgccttgaccacaagttttatttagaaccacagataacttccttttgggatatatctcaggccataatttatacatgagattttaactaaaattatttttgtaaacattatcttagttggtttttagaattgaacttactgcatagtttttcttgttaatacaagcaacatccaactttatatcctccataactaacagttcatgtcatattttcatataatttttaaatgaaatgtaaaaatgggtagtatagagggggccttaactcatcaggatttctcccaaaatattttcctgtcaaagagaaaacagaacaaaacacagtgagtagattagaattaagttcagctgggagaaacagaaacaaaaacaaaacattactagcataataagacagatgttgatttctctatgtgtaaaagtctgaaggggatgtgttctagagctgtacggcagctctgctccacaaggtgctctgggatgcaacctccttccagctcacagctccactcaccaagaggtggctgttatcttcatggacaaggtaaaggtattaatagtatccaaatcctaggtagcagatggagacaaggatgaagacagtgtaaaggctgagccagctgcctcttcaggaaaattcctggacattgtcatgggacactttcatttatatcccactgtgggctttaattacatggccataccaattggatgggagggtgggaaatgtcattttgatttggggcagccaaaacttccatttctttagaagcagattatgaccatggggagacagctagcaagctctgtcacccaccccaccaacttagtcaatcttggcagtatttctcattattttgttcttgtccttcctcatgctgatccttctttgtggctatgccttctcaggcttctctgcagtctctttttcttctataccatcctcaatgttagtgtttgccaccatctggtcctcaggcactcttttcttctcactctgtgaacactctcgcatggccacataaattcatgtcttatactacccaatttttacaaacctacatctttgtccaagatattattttcttaaatcctagattaatatatccaatttcctaaagggcttcactgcttgaatatacaataagcaactcaaactcaatacatctgaaattaaactcgtcatctttctcattaaactctgttatgccatcagtgtctacacccacatggtcacttaaaccacaattctgggatatgcctggaatcatctctcacacatgttcaatgtccatttttttcctttcctctgcatcctccttgcttttgctttgctttagttatagctaacatctattgagcatttgcatgtgccagcccctgatgcaaatatattacatattttaactcatttaatctgcaaacaaccctactattattatctgcattttacagatgaggaaattaaggaacagataagtaactttcccaactgtcacacatcgagtaaatggtaaaaccagaatttgaacccaggaagtcgactccagtgcactctctcttaactgcaataactttctgttttagcccctcattgtttatttaccttattattatagaagactttcagtttgtttatcttcttcaatctcaccaactcctccccgaaattccatctttcatacgaataactaccagaatagcttttctaaaacacaatctggtcagttacctaaaaatccatcggtgcttcaccatcactttcaggtgaaagtttcacctccttaatgttgcacaaggcccttcatgatctggccccagcacacctctacagtcccttctggaacttcctcacagacatggtcccatccagccacactagatcattccaagtttctgaacagatcttactctccacacctatctccttgctttttgcactcactcagaggtcctatgtcaaaagtacactgttatgagtgttgctcaaagctccccaagggctgaataggtaaccctctgtactttatttacttttcacatagtatggtaaacggaagttcagtcttctctctctcccttggtgtcctgtataatttccttgaaggaagagttggttctttgtatctacagtacctaccaaagtgtttggtgcatgatgatcatcgagtaattttcaaaaagggatgaactaaggaacacaactgcttcttcccttttatggcattttcctaaacaaaacccgggacaaggagatcccttgaaaatcactgactttacccttgtttacttacctgcaggagaaattcatcttggagcaggatcacaatactataaaggccacctggtttggtgtggcacatgttggggctgcacgtgagagtatggaaatagaaagagtagcatatgtttattcacatcagtaaagggaacaaattgaaacataggagtcatggtatccagacataatatcaatattttgggaagttatttttaatgaagataactaaggggacttaaaagggtgcattttttttctcctttgcatggcgattgctttttggggatgccaatgcagaaattcttgggttgtagaatttttaaaaagaagagcacactagttttatttattttacaggattctggtgcctttgtgacaggcaaccacaagtgaaattaccttcaatggtcttggcttagtccctcctctgctcctaatcatcccctcaaacccacatacattagacagagcggttgtccttcaccactaaagaaatgcagccgagagttatgttaccgtggaaacagaatcactttttgctgcaagacacactgcttcatctgcactattatgaagcagaatacattggtagggctgggaggggaataaaatattctgcctgccagtgttgtacttggcctttgggggaataaatgactttcaattagagtacttaaatatcttttaactttaataattattattagagcctcaacagaattttacttggaaaagagtaaaaaaaaaaaagattcttctgttaaagtaagagctataaattctttcaaactacaccactcctgttaaagaaaatgcaagagaatttacaattaatgggttcattgtgtataaagataagtgttttagctcttctttgttttttgactttctaatttgatcaccttgtggatttgtgagattgtccttacctctttccttttttggtctctgcttttagcttctttgtagtaagcacacttatttacagcttcatcttgtgttgggctgtgtgtatgcaggtccactgttgttgacttgctgctgagcgtccagctaagtctgtgatctaagcctgtcaccagtcccacttctgggccctcccagccaaagccactagttcccatttgctacctggttctgctactgggaggctcccttccctaaattcagtcacggttctattttgttttctttcctctacttgatagctcttactgtttgtgttgttatcagtgttgaagaacaaatccatatgacctacactagttgaaggatgaactctataggatatcagaaacaaaacaagaatcctgtgtccttcagctccaaagatgctcacagttattgagttttcttataggcccccagaaagcactactaaaacaaacaaacaaaaatcttaaaacacacacacacatgcacacaaacacacacacactcacatgtgtgcacattatctcacattacctcagagtctaactataagcatataatcacaggaaaatcccacatcatgaaaaggaaaaatattttattggctgtaaataaattagaaaagaatgtgatactttaaaagtgttagtgttttaattctagaggtagcaaagcaaccttaagagacaaatgacaattcttgagcaactagtcagtggcgggcactttttatatctatcaccccatttcattctcaaatgaatctcaatggctactattatttttattttgcaaataaaatgaaggcactaagactcaaataatttattttaaaaaaaatcattctccgattgtataattcatccatgtaaccaaaaacgactagtaccctaaaagctactaaaattttaaaaagtcattctcaaattccccacacaaaccctaaattgtttctgatttcaagtttagtgttctttccaagtgcatcacctcatacagtgctcagcaaagctctgaattgggtggctggggaggggtatgtgctaaaatccagggaaaaaataagaatacagcctctaattctgcctttccacctctagacaggacttcgggaaaatcatttatttgtttcaaattcagatttattcatcctgaattaatatggataaataaccttttatctcttcatgcaagtaggaagttaatgtgtgaaaaacatgttgaaaatactaagggcacttttatttctgtggaaagaatgacttactcctgttaactataataggtccagattaataggtccagatcactgtcaatctattcagccatcccaattaattcagccaccaaatcattattagtctcaaatctgcaatgttttgagagctgaccctgtcacatattgcttggatatctgccaaataatttctatagtgttgggttgagtagtggatgcataatacttatctttaagtaatgaagtgtggatcaaatcaaactatcgtccaatatctaatttagtcaccagttatagaccctatttcatcataataccaaaaaggattcattaaatgcctggatacaattagtctaagttgctttacgaagatacagtcataacctttgttcatggtattaaactgatttttaaaataatgatctattttattatcacatagaaggaaatattttatttctctaaactccattgcttgcctttcagagagcctcaggaaatattagtggagtaaatattgaaaaatacttacccagcacttgaaatttcaccttctgtgtctcttataaattaacaaaaaattgcttcattttgagtatttcatatgtatttactatactatgaactttacaaataccacctcttttactttttacaatgactctctaaaattgaatctattggtgtcatcaggtttaaagagtaaaaataacttgctcaagtcaaagtgccagtctgtagcacagcctgactcaaatccgtgcacaccaactctaaactgcaactcttttttttttttttttgagatagagtcttgctctgtcacccaggctggagtgcagtggtgcaatctcagctcgctgcaacctctgcctcccgggttcaagcgattctcctgcctcagcctcccgagtagctggggctacaggtcgcctgacaccaagctgatttttgtatttttagtagagacggggtttcaccatattggccaggctggtctcaaactcctgacctcgtgatccacccacctcagcctcccaaagtgctgggattataggcgtgagccactgcacctggccacactgcaactcttaaccgcaattctgcacatcaaccttgtgtgtaaagttgcctttgagaaaaccagctttcttttgctgcccatctctgataacttgttcatcctttgttttataaaagaaaaaaaagaaaagacagaaaaagagaaggagcaaagaaggaaagcagggagagaaggaaaaaggaaagaaaaggaaaaaaaaatcactcaatgttttccaccctccctgaataacctggggataaagtagatcccatccaagtttttgacacgagtcgacattgttgaaaataatcatgtgaagtgccagctttgtctgatgatgtcattttgcctttgttttgcatttatcaggagaagtattcttgcagattaaagggccactggaagatatttataaaatctactgctatcaccatgatgaagcacatagtatactggagtcctatgaaaaggaagaagagctgaaggaacatttgagccactgtatccagtccttaaagtaaggccttttcaaatgatgattcccatctcctctcagttgcctagcagggaacattttaaatggatgtagatgaaaggtctcacataaatcctatgttttatgagacttgctgggagctctgctttgcattccctttataaaaagctgacatgccagaagccctgattgactttttttccccctgcgagaatgactaaaaataacatggaagaagatttagagctctgcagcgattgaaaaatgcaatatcaaaatataaaatgtggaagaaaagcctcttcttaaagctattgtaacttgcctggccccacgtagttcaaggattatgtgagataacacgtggccccatgaccactggagcacatgggttaatggagttaggggaatggcctacaactctgcatggccgtcttctttccccaaactcactgtggggagatgggtgaagacaagtcaggccttgttaaagttagtttcagaacaattactcatgccttcctttctcatccctaaaacattggtgggggagctacacaatgtactttttcttttctagaggaagtatctattcactgtgaaaatctgaaaaatataacaaagtatgtgtaagataaaaaccccttgctatttcactattagcccctttcttcttaataatcattttcttctgatattatttatatgtataaatgtgggtatgtgtttggattgattcttttaaatggaattggtatctttctgaatatgcagtttcctatcacatgaagcttaaagccaaaatcactaccatactccacatcttacccagtggctctcttacagactctcacttgtaagtagtatccactgtcaaataattttgattagaccaggaattaaacaaccacagagagctgtggtgtataagtcaatgtacacccgtctgatcctgtagcacacctcccccgtttactctgtgtgataggggaaagagggatccccaacggggatggggatggggatcctaacgtggtacaagaggtttttagctgcactaaattgaaatcatgatactactctggaggaggcgtttcccggctagaattgggtctgaaagtgagtttaaaatgagcccagtgaattttttttttaaataaataaaatttcaactttattgccgtctactggtcattaaattactgcagttttaaaccattcttcatgctatggaaaagaattcaagtcaccaaatcttaagcatttatttagtgtttgtgctgtgtcaagcgtagttctgggggctaagtatacaaaagtaaataagacttagattctgccctaaggaactcaatatgatcagttaagtcttaaatataagatgtaatgagcaagtagctctagttaattatttctattttcagtttaggttcagtgttagtatatcaattcagagaaacattcaaatttgaagttgtgttcattttaataaattcatatattagaagcacagtcctctaaatgttcagctgttttattctttgggaaaaaaaaggaaatggtgttatcctgggtttgaatgaacacctttcctaccttaaacaagtggcaagatctgatccaataaaagctggagccattttccttcttcgggttctagaactaagcgtgagaaatgtcacagaaagtgaacatttagcacctttgatcaaaccccacccaatgccagccctggggatggaggtccttgcctgaaaagaatgtggtgcctctactttaggcatgcgcttctaactgttcaccagaagtggagcagtctgttcagagaggaaagaacatcagtttactattcattaaacttttaacttttaagagaaagaaacagaccctgccagaagattccactaggcagtatagcccagtatcatatccccacaaagcagctaaaggcagaggtgattttagaacctcatgaagtctcagttactgaaaattattttcagacccaatggcttatttggtctttttctgcaagtttcaggtaattcccctggccatgccccaaattttgagtttagagctattctgattttaggtaacagttgcaggcactggaaggtgttaaggtttagaaagcaaaaaagccaaaagaagcagtattggcacaactatttcttaagggaaagaaaatcaaataaaatagctgaagttagagctattttcccaaaagttgcctttccatgaaaataaagttaatgatggattgtactggtctgcctgaaggctgagggcagtagaattattgacattactataatactgacctcaatcgagctaacctttaaattctgagaaacaggttttcaaacaggtttataggccaaagagagtctggaacaccctaagggcttggttttcctggccaagtaatcagtcaaagctattactgtcactctgccttttccttgtggctagataacacagcccaagtgcagttgccaatttctaatgaatactaggtgtggcctccattttatcctgtgcaaggggatattggaaatctttgttcgaagcaatatccacgagagaggtggcttcatgcctcagaagttaaggtggattttaaagcaatttaggctgctttttaaccaaaattacagtatgtttattgagggcctaataaatatttaataagagtgctaaataatgttgaaaatattttttaaaaatatataagcatagttcttgcctctcaggaacacaaaccctagttgaggagataaacaaaaccatgtggaaagtttaataacaatacaagaattaatttaaataacaccagaagctttcacagtggctgcagttcaagactaattcccaaaagagtagtagagatattacctggttctgtaaaagacccaagtttctaactttcaattattctttgaagccaattatctttcaaaagagagaataatgttgaatcctttcataacgtgagggcagtgtttttctgtgtggagttcccttgcgccagatccaccaggatggtgtattaaaagtacagattcctatgctctgcctcagaccaaaaaaaaatactatttctggtggtccagttcagggtctgctcttttaacaagccacctcaggtgattttccatacacactcaagttaagaactaaattagtgggagaaatcatacttgctgctttccctgaagcaggtgggttttttcatcaatatagatacaatctaagcagtaactacagagtttggagaccttcaaaaagaaaagattctaaggctctccaaaagcaaatacacatctgcatctatagcctacaaattggaaattagcaagtttttatttattcaacaaaaagttttgacagtcaaattagtgacccctaagattgtgtgaaatactgtattaaaatagtctccaaagttatggaagttatttgctaaagatcttattacttagccttcttggggttatttaaggtttctgatctgtatgaggaatgtgaaagatagcgtggctataaatgcaaatgtagctataattagaatagcctgtctgttgcctcctttttctgcttttccatttataaataccactaaagtccctgctgcatttcagaggccccagagatctgtttattttgtaatagaaagagaatgaaggggattttctaagtttttgatggatggaagacacatttctagcttcatgtctagttgttataaatgtatctgtatttttcttcttgctaatcaaggccatcatccccaggaggaaaacttctaacttctagtcatctgggcactttggctgctcacattactcctggagcttctccattcagggaggaagctaaaagctcatgcaatgcaaaatccaaaggaatacatttcaatttgttcaccacattttatactcattattctaatggagtgttccaagtaaaaattaaaatcacttttggaaagcccttcagttccttgttatatggcatcatgtttgaacaaagactataatccttaaggaatagtcacataaaaacttgttaattgtgagtcaaagtataatgtgttcatgagggtaggaggtatagtgataaatatattaaattactttatcccataaaagggtaaatggacacattttaaattcttccttcctgaattgcccttggttgggattagcttctgcaaagtttcagcctaaaagagatttttttaaaaatgatgaacaaataaaaagatgttataatatagtgccactactccacagattgttgttttatcctactggaaaatctctcagattccctttcataaagcgttatactacataaacacaatgtttaatttatgttatgatatttaggttttacttggctaaaataaatgaaatagaaaaaaaaaccccatgttttctgtaggagttaaaagaataaccttctctttcaacttcaatgtatgtgttttgattcctaaatgatcacattattcacttattggtttgcatgaaaaattgcatttttatttttattcattttcttccccagattttctgacctatgacgcacaaagcatatctggcaaataaaatttccctttagaagaggaaagaaggaagcatgtgagcttaaaggaaatgattggaaggaaatattgggcaggaggtggtggtggtatttctttcattgcaataggagagttctttaaacagtcgtgaataattgcctaaaattatagcagctgctgattttaaaaaaattataattctgtgcttgattcccatctaataggtcttagactaagcaaaacctagttatgttaggatgtctagcaattcactcatatagcatgtctggagattgaggaaacaattgcttcacacatgtcccccaccattttccacatatacaaagtactgagattaatggaaaaaaacttattaaatccattaaattttacaaaatgcagcttaggcacttattaaatttttcctcaatcactgaatgtaaaaagaccatctattattatggaatggatcttaaaatttttttatattgaaaacatttattgtactccaaatggttggaaaccaaagcccacagtgatcagataataaacacaggatattattttatttatccatagccacttgaggcttttagataaaaactttcatcttctttatttgttagggacatgattataaaataatgagactacttctataaggcattcatgaaaattacttattttattttacataagaaaatttaaaaggatttataatgtttgtatattaccttaaatatacagatttacatgaatttactttctttttcttctcttacaggaaaatatacatgcaagagtaagtactttttaaaataatataaatcaaatataaaaatcacgagaaaatgcagctgactgttcctgtccaaatcagaaattctgatttttctaatcatgagtattgcttttaataatccaggattgcaaaggcatttaccccattactggtgcatattttacttattaaattattatcacatatactttaccaaaccttttagaagaatcccaacatataatttactaagtttgctgatgccagaaagtctttgggaactgctcatcatacatatgtttgggaatcttaatgtgtccaaaaacacttctttctatgaaacatattagtctttaaaaaatctcagattaatatcataatgcatttgaagtttctatagattaatgcataagaaaagattattttatgaaaatattagatttcttctaatttcaagtcttgtatgatttatggagaaaaaaatcatacacattatagcatgaaaatgaaatattaaggtgaaatagttggttactaggacaatatagaaattattttagaaaaacagcgtatacaaacactctgaaagaggtccattattctagaagaaaatgtatccaggctgattaatgctgaaaggatgaaattgacttcaatacaaactccaatttatttaccaggcacatgtttggcttatgatgagcaactctttaaggtcccaagcttctagtgtgtgtttgcttgtgtgtgtgtatgtactttaaattcctaagagtttatatgaagaaataaagagcttacaaaatataaattatattaatgtaagcagcaaatatctgtcattcatattttggtgcagagcaacagtgagaacggaattctggaactgaagtgaaggagtcaggcatcatacagatctgtagaccagggctgtatatctcagtcaagttgagaagctgatttttgagacaccagacaggcaaccagttctctcactttatcagtcttttcttttcttttcctttcttttttcaaaaggaaaaactatccgacagtataaacagatatgagtagatttgtcttatgagtttccaattctaggctcatttgaattcaaagaggtgcatcggcctcctggcttctcttcaaagatagttgatgggggctgggaaatggctctgcctcattatacagcctgtgtccctggcattgtgccaaggactggagctttgcataactgagtggttagagaggaacttcatgtgctacaaattctgcttaggtttccttttctaaagcttgcattaggtctttggaaccaagaaacaagaagagaggagagagagattcagaggagaaaaagggagatattcttcttagtacaatttgcatgcacggacttctacatacagaatacttaaacagttcattgtattgaaacacgcttaaaaatggccctagcacttgctgcaatcctgctgtgtaggagttagccaggttgtgtctgctccctctagactattctatacatcaagaactaaaaaagaagagcaatcccagcatgtggctggatgcacatcaaagccaagtctgccatgaattattttccttcctgttcctttcattcaggtcatgaagcacacatactgctacaggaaagggcaaaaggcaatgtcaagtgctgtgtaattgttgggttctttagtggcaaaggccagcaatgttgcagccaaaagggcatttaagagtacaaga

SEQ ID NO: 1257 - DNA, 1058 bp, Homo sapiens
aaaaggtgcttataagcgtcttttagcattttcacagaagtctccttctactgcctttaataaaatctgtttcctcccaagcttcaattttcaacattaaaaaaaaaattcttcatttgtcctatattgcagacacttcaacttttttcttgaatttttatttgtttcttgtgctacttcctaacttgggccatttaaaaacctacagtttcataattctatttttataatttttttttttttgagaaggtgtctcactctgtcaccgacgctggagtgcagtggtgcaatcatggctcactgcagcctcaatgtccaagctcaagtgatcctcccaccttagcctccctcgtagctgggaccacagctgcatgccaccatgcctggctaattttttttactatttgtagagacagggttttgctatgttgctcaagctggtcttgaactcctggactcaactgatcctcttgccttggtgtcccaaagtgctgggattataggcgtgaaccactgtgcctggcctttcatacattaagtgaggtttggggcagggcacagtggctcatgcctgtaatctcagtgctttgggaggccaaggcaggaggatcgtttgaggtcaggagttcgagacctgcctgggtaatatagcaagacactcatctgtattatatatatgttatttttttaactgggcatggtggcatgtgcctgtagttctagctactctggaggctaaggcatgaagattgctgaagcctaggaattcgaggttgcagtgagcaccgatcacaccactgcactccagtctgggtgacagagcaagaccttgtctttaaaaaaaaccaaaataataacaaaaaaaactttgtttttaagcagtgaaacctgtttttcaaatcgtatcttacaaagaacttaaatatgtatcgtaaacataggagggattctctgactgaaacaagggttggggtctaccaattatatattgttatgaacctctatgtccttagtcttttttctttcttttttttttttttttttttttactaactata

SEQ ID NO: 1258 - DNA, 4301 bp, Homo sapiens
ggaaatatctgaaatattaaaatgagattttaaaaatcagtggtgaccctccccctctcacactgtcaatggagactgtgtacgttccaggaacctggactggcactgggggaatgatgtgtcctttcccctccttacaggagcagtgtcagcggaggcctactagttaggactttcaccaccaccttgcagtaccaaggccacccccctgcagtgtcagtagagactgtactcagagcagtaagaatccccacctctcccagagtgggggtatcatgggaaggctggtaaggagcctgaactcctgcccctgccaagcaataatgaggtatgcctacccaccagatgccaacaaagacttagtgggtaacccagacatccaaccccattgaacaagtaaagaggtagagcagtatcagacgacatctactagacagaaggtctcaaaaagatccatccaaaatttcatgaaataatagccaaagtgtctaaaatttgatgaaaaatgacttgtcataccaagaaccagaagcacctcaacttgaataagaaaagacagtcagcagggcttcgtggctcactcctgtaatcccagcactttgggaggctcaggtggccgggaggtcaggagttcaagaccagcctggccaacatggtgaaacctggtctctaataaaaattaaaagaaaaaaaaattagctggctgtggtggctggcacctgtagtcccagctactcaagaggctgaggcaggagaatcgcttgaatccaggaggcagaggttgcagtgagccgagatagcaccattgcactccagcctgggtgacagagtgaaactccgtctcaaaaaaaagaaaagacagtcaagagacactaacaccaagacacagatatcagaattttctgacaaggatttaaaatcagccatcataaaaatggtttagggccaggcacagtggctcacgcctgtaatcccagcactttggaaggccgaggtgggcagataacctaaggtctggagttcgagaccagcctgaccaacatggagaaaccctgtctctactaaaaatacaaaattagctgggtgtggtggcacatgcctgtaatcccaggtacttgggaggctgaggcaggagaaccgcttgaacccgggaggcggagattgcagtgagctgagatcatgccattgcactccagcctgggcaacaagagtgaaactccatttcaaaaaacataaacaaaaacaaaaaagctttaatgagcaataataaagaagcataaaacaaaagaaaaaatataaaacatcagtaagtagaagatgtaaaggatcaaatataaactttagaactaaacaatacaataactgaacaatacaaaagctcagtgatggactcaataatagaagagcgaaaacaaaagaatcagcgtacctgaatttctttaacagaacaacagaaattactcaatctgaacaacaaagagaaaaagtctaaaaacaatgaacagagcctcaggaacctgtgggaccataatcgaagatttcctttgtgtcactgaagtttcagagggaaaaaagaaagagggtgtggctgaaaacttcttctaagaaacaatggctgaaaatatcccaaatttggcaaaaagacataatgattgaagaagtttacagattgaagtttagagaacctcaaacatttgaaaaacccatggaaatccatgccaagatacaacataatgaaatttctgaaaaataaagacaaagaaaaagcttcaaagcagcagggcagaaagggacacctcacctaaagaagaataaaaattaaaatgacagcagattcctccccagaaaccacggaagccagaaggaaatgatgcaacattttcaagtgctgaaagaaaagatctgtcaagacagaatctgattctcagtgaaaatatccttcagaaatgaaggggcaattgagacatactcagacgaagggaaactcagagaatttgtcactggcagacctaccctaaagaaatggctacagaaagttatcaaaatggaagagaaatgataaaaagaagaaatactggaacactgggaataaggaaaattgaaaagagcaaaaatacgcgtaagtattattggggctcaggaaacaatgtcccaaagtatggtgctttggcatgctgagtgctttgaatcaaggtttctctgaccttctcctcaccctcctccagtcccctgctgcccctgtctctcatctcttgcccctctttccctcccaaagtgcaggaaggtgctttctctgaagttcccttatctgactaagggaagttcctccagaagaaatgcaattgctttgagcccccctctctataatcttatcaaacagagaagattagctcacaggaaaggagactaaaggtcaaaaccacctattctgaagattgctagctgagagactttatccgtataacaagacagcctctgctcatcacacatttttctcccctcaaacctctataacctgttaccacctcccaccagaaatcccagccccttatttctttctgtagctcaaaatgctatttaagcttccaccatcaggcccttttttgagtctcatattgtgtggggctcccgtctatatgcatgtaataaacgtgtgtgccttttctcctgttaatctgtatattgtcaactttattccagagactcaaattattgaaccttcaaaggatggagggaaagttcccttcacccctatgcccttctcctcttgagagatatcatgtttgatggtggaagaaaaaattacaacactgtctgatgtggttctcaatgttctcaaagaggagatataaagaagaataagtagaaatcgttgaactgaaaaatgtaataatgaaattaaaaactcaatggataggctcgacagcaggatggagaagtcaggtcagtgaacctgcagactgaaaaacaggaattacccaatctgaacaaccgaaagaaactagactgaaaaaataaaaaatatttaagacaattatattataaatgaggagggtaaagggatgtagagagagataataatttttacattggacttgaattagtaaaatgttgacacaaataggctgttaaagattatggatgtacagtgtaatacctaaaacgacactaaaaatctaaacagacacatttaaaaatattacagatatatggaaatgcaattataaacaaagttcaaataaccctcaggaaggcaggaaaaacaaaacagtgaaaggtaaagagacggttaagtcgaaaaagcaaaaaatgaaatggcagacttaagctctagactttcgaagatgggaaatacaggattgactctaaaggggtacgactttatcttgatcatggtggtgattacccaaatctacacatgtgaaaaaaaaaaaagacatggaactatatgtacacattataccgttggggctcagaaactgatacaccaaaatatggcgctttgatgtgcttaactgaagaagaagccttaggcctctctgaccttcctcctcccttccttctctcaatcctctgcgcctcccaaagcaaaagatgaagttattctctgaagttcccttatctgctgagagtctggacttgccaaagaagaaaacaatcacctctggtcccttccctgagttttcattaactgaactcatatcacaggaagaaagactgaagtctgtcaacacacctgagcaggtttttgtcacgaaccatcgtgtctgctctgctggcccaacagactttgtcctaggccggtgtatgttcttcaagcccactgaattcccctaaaaatcatttactactctcctaaaatcatccctacttccccatcaccctttcccctgagaagaagggtatataaccatcagcaccccactatgtggtggattaatcactctgggattcttccctgtgtgtgttaataaatttgtatgccttttctcctattaatctgccttttgtcagttgattttcagtgaaccttcagaaggcaaagagggaggcttgcccttggcccctacgatacaagtttcctggcttggttgttgtactatatggttttataaaatgcaaccatggagaaaactcggtgacgagtacacaggatctttctcagctatctttgtaacttcctgtgactctataattattccaaaataaaaatcaatggcagttatgtaacatgaagctacatgcaggtaatggtacttttgcagatttgtgaagaaaaccaaattcgtgagtaacatgta

SEQ ID NO: 1259 - DNA, 493273 bp, Homo sapiens
aaaatttaattgactgtctttggcttgtaatgctctgaagtgtaaacaggtgaaactgggaaaagaaaatgaattatccaggatttctagacagtaggatcctgttgaaagtcagcatgaccaaatattttgcacatcccctgtgcaccacacaaaacaagcaataaagctgtgcttatagaaagtttttgaaaaaaattacatcaagtcttgtcttaaccagtcggaaggcaattgtgaatggtgagattcctctctttattaattacttaaacttccataatgaaattcaggtgtgatccctaaggctctgcagcccagaacagttaaatgaactgcagaatatggtatttgccaaaggggaattaattatgttaagagatgtatactatgaataccaacaagcctaaatatgtgctgaatagtagaaaagggataaactagaattttacattataaaattccaccaacctcacaatcatggcccatcatctggttgaacatttttggttttgtttcatttttacttttgccattttgatctatgcttgcaccaactgccacatccaacctggccatctgcagcacacggggaactttttcttataccctcccctccccagtaatccatgggacctattatttaatcaaagaatcaaatactagccctcaggtcaaacaatgagaacaaactcactccctgtattttgcgctgaacattcccagaaaagagtcattactaatatgcatattaaagtgtacttatgccaatatcaaccagttagtaatagacagtatttctttctttcttttttttttgagacggagtcttgttttgtcacccaggctggagtgcagaggcgtgatcgtggctcactgcaagctccacctcctgggttcatgccattcattcttctgcctcagcctccctagtaggtgggattacaggcacccgccaccacgcccggctaatttttttgtatttttagtaaagacggggtttcaccatgttagccaggatggtcttgatctcctgaacttgtgatccgcctgtctcggcctcccaaaatgctgggattacaggcatgagccactgcacccggtgacaatatttctgttttggggtagcaatgataacttatataaatgatgaatcattccaagttccataactgcaatcggtcaaaagattaaattattttcaatctgccccacagccatatgtgttataattttatagtcctttcttaatacaaagtcccataacaacctcagagcctcaaaagctctttcactaatttgagcaaattttctcttttcccattcaaaattcacctccttaattcaccatcaagggggtggaccaggttgaggggaatcttctttttagtaaattaaaaaaaaaaaaaaaccacaactgaatgcaataacattttctaagtttctagcaaagtgttagtttccttagatttttaccaatatgtcaaaagttgatatttaataatctgttctacccaacacttaattggcagtctatccattgaaggcaaagagcagaaatgaatgtctctctctgaatacactaagtgtagtcaatcagaattactaacaattggccaggcatggtggctcatgcctgtaatcccagcattttgggaggccaaagtgggaggatcatttaagaccaggagtttaagatcagcaccatcaacatagcacgaccccatctctacaaataataatactactactaaaaattaaccaggtatggtggtatgcgcctatagtcccagctacttgggaagctgagatgggaggatggccttagcctaggaagtcaaggcttaaggcggcagtgagctatgaggactacattgcacccaagcctgggcaacagagtaaacctctgtctaaaaaaaaaaaaaattacgaagaattcatggtgtaattgagaaggctgcaaatagttgttttagattgcaggttcttgagtcagactctctgggttcgaatctcagctctgtcttttacttgccctataaccttgggcaacttccttaaggaattttctcagatgtaaaatggggatgattacagtaactacttcctcaggttgtcaggagtacatgagataatgtttgttaaatgcctctcacaatgtctggaaaatagttaatttataaaaacagttaccaccaccaccaccaccaccaccactaccaccaccaccaccaccaccaccaccaccaccaccaccaccactacacctagagaagcatgctaaagagaagacacaatacagctctcaaagagtttacaatctcaatttgcaagtattaaaaacccccactctctaaaaatatggtagacatattaagcatatgtaacatatgcaataaatacacacatcatactttcagtaaaatataaagtattcatattcaaaaggcttctgaaagtaggccgggcatggtgactcttgcctgtaatcttagaagtttgggaggccaaggttgcaggatctcttgaggccagcagtttgagactagcttgtgtaacacagaaagaccctgtctctataaaaaataaaaagaatggctgggcgcggtggctcacgcctgtaatctcagcacttcgggaggctgaggcgggcagatcacgaggtcaggagatcgagaccatcctgactaacacggtgaaactccgcctctactaaaaatacaaaaacaaaattagccgggcatagtggcgggtgcctgtagtcccagctactcaggaggctgaggcaggagaattacgtgaacctgggaggtagagcttgcagtgagcagagatagcgccactgcactccagcctgggtgacagagccagactccatctcaaataaataaataaataaaataaaaagaattagccaggtatggtagtgtgtgtctgtagtctcagctacttgggaggttaaggtgggaggatcacttgaacccaggagcttgaggctgccatgagctatgatcgtgccactgtattccagtctgggcaacagagcaacaccctgtttcaaaaaaggacttctgaaagtgagtcaggatataagtggaaaagtacctgctatacgacaagcaaagccaaagcagcagttatgtataagacacataagggcttcaacacagagtttttggaggggggataatattttaaaaaataaataaaaggttgtggactgctccatagaaataacacattactacatattgtaactatcatttcttaagagaaaggacattaatggaaatgttggaaggacataagatcagaatttaaaagtcttttcaattttatgtctttggatttttacattttgaacactgaaacagagagatgtgatagggagtgactgaggagtgtgagaaagctacctgagctgagagttgaagccagacatacaaagatctgaagcaaggtaattctgggaagcatcaccagctaattcaaaggtcccgaggcagcagtgagtttggcttgtgccaagaacagagagagaaccagtgggataaaataaaggcaggcaaacaagcagatgcaagattacataaactcttgagttgggtttgatgggtttcagcagagatgtgccatgatatcaagatgagaattagaaggaatctcctacctgctaaagggcaaagagcactaaaatggaaggaaaatcagttctaatattagagccacattaacgttgaaagtgccattcaagctaatgaaaaaactagaaagtaatgatggttgaaaagattaggatgatttaggtcaacatgttaaatttaagaagagaatgtgacacaaacaaggagccacctggaaaccactgtaaatgcaagtagcacatacttagagtctgcttatttctatacacgtggaagctactatgtacagatggtacatgtgtacaggttgggacaagataaactcccccaaaccagggggagtctaagatcatggttagaagactaaaagatttaagctttattattgaggcactcaaaatgagaaaaaagtttgtgccgacatagcattttttaatactaagacagacatttaagactatctagacaaaaattaatacctgtaagccactcttgtgcatcactttgggaaagataacttgatgctcagaccattaaagtaatgccatctagttcctggaactaccagctcaaatgtcatcttggccactcagtcaaagtagatgaatagacgacattctatttcatgatgggaagattctggaagaggtcttaaaggaaacattcaagttttatcttgtgcagaagaagtgtagatagaatacatggcacttatgagaaaagaggattgtcctattctagataacatttgcccagctgtagaggcactaccctggaggcaacagaccatgcgacctgttgcttcagtgatataattcacttgagaaataaagctgtgttatggaaagtttattcagagctgcatcatataatggcccacctgaatgtgccccattctaccaaaaaacaaattccaaaatataccaccattcatggcgagagtacttgacatgctcttgtctttgttgtctaaaaaataattgtccttcacccgagacttcgcaaaatgcaagaactaaatgcagtttccccatgacacagatcatctacatccttccacaatccccaacacacacacactagatttgtgatatcaatgacaaagtttttcttgggctcgttatatagaaaggaaaaaggatgtttggaaattttgtgaaacacctaattcctaagaaaaacatttgtatcatcatcattccaatcactggtcaggtatgattaaataatatataattggcatgattaaggtagagcagcctttctacttactaacagaaaatacattttccacctcatactgactacaggcaatcaagctctagaaactcctactctatccctctcaaggctgagaatggagcatgtgaggactttatcctcaaaagagagaaaatttagaagactcttctggcttttaaatttttcttaggtctaaatgacacatttgtttattcatgggtttttttattcttcttcttattttttttttgagacagagtctcactctgtcgcccaggctggagtgcagtggcgtgatctaggctcattgcaacctccgcctcctgggttcaagcaattctcctaccttaacctcccgagtagctgggattacacgcatctgctatcatgcctggactaatttttgtatttttagcacagacagggtttcatcatgttggccaggctggtctcaaactcctgacctcaagtgatccacaggtcttggcctcccaaagtgctgggattacaggcgtgagccactgcacccggcttgtttattcatgactccttttggtacatctatgttgagaacatattacatgccaggtacaatgacaaaaaaaaaaatgtgacaggcaagagaagaaatttctcacaatgcaaataagactatagggtaagagaagagactacttaagcatgggaattactgttgcacaaaactaaaacttaaggatagggatgtttggtattattatttcaatcatgcataaagctactcaacctcttgactcttattgtaaattagaattaaacataaaaagttctggttcctgacattttctgatggcccaaattttctattcttcttttattttaattgtaatctatttcctggattaacaggccaccttgaactaaaaatgttggttaatgttttacttgatccccatatttggagtcaggtaggtatgtctgtatatatgtacatatataagtatttttcatgcctgtggaagttggaatctacagctatataaggttaaaaaaaaaaaaaagactggctgggcatggtggtgcacgactgtactcctagcactttgggaggctgaggcgggtggatcacctgaggtcagcctgactaacatggtgaaaccctgtctctactaaatacaaaaaattcgctgggcgtggtggcgcatgactgtaatcccagctactcgggaggctgaggcaggagaatggcttgaacctgggaggtggaagttgcagtgagctgagatcacaccactgcactccagctggggtgacagagcaagactccgtctcaaaaaaaagactgtacagactgtaccagatagtgcttagaaaatgtttgcttaatctatcaaaataaatcactttagttgggcacagtggcccacgcctgtgatcccagcactttgggaggccgaggcgggtggatcatgaggtcaagagttcgagaccagcctgaccaacatggtgaaaccccatctctactaaaaaaaaatacaaaagttaactgggtgtggtggcgcacacctataatcctagctactcaggaggctgaggcaggagaattgcttgaacctgggaggtggaggttgcagtgatccgagatcgagccactgtattctagcctgggcaacagagcgagaattccatctcaaaaaaaaaaaaaaagaaagaaatcactttaaaatcttttagagttgttgaatattttgttaagaaaataccacagaaataatagtttgaaatggcactttaaattagacatcattaaaattttactgacaaatatttacaaggactgtcttttttattgagacagagtctcgctttgtcgcccaggctggagtgcagtggcctgatcttggctcactgcatgctccgcctcccgggttcacaccattctcctgcctcagcctcctgagtagctgggactacaggtgcccgccaccatgcccggctaattttttatatttttagtaaagacggggtttcaccgtgttagccaggatggtctcgatctcctgacttcgtgatccgcttgccttggcctcccaaagtgctgggattacaggcatgagccaccacgcccggcacaaggtctgtcttaggttgtcttgtcattattcccccagaatattttgaaaaaggaagagaaggtataactagtgtttgcttaagcattaagacgttcccattgttttcactaaaattgaaaaattaatccattttgttgtggattgatttgattcccaggatgagtgtaaggcaggactcatagaaactgcctgtttggcccttgctgaaataaataaatgacttacaaaaataatacccatactatggaccctaacattcttatcctctaagcttcaaccacatgaatcttgaaattgacaatagagccagaaagaacaaacagtaaactatttacagtcactcccttctactactgtgaataaaatgcattcaaatgctatttgttaaagtaaaggtggtcaccctaccaaattgctatgtaactacttctggaaatatttctacactgtaggcaggcataacaaatttctgaagtaaaacataatttggtgggtatgaaaagatactttgtaaacatcaactaataaagaaatacacttaaaaacaaaaaaaaagacagagagacagggtctcactctgttgcccaggctggagtgcagtggcacaatcatagctcactataacctcaacctcctgggctcaagcaatcttcgcacctcagcctcctgagtagctcagactacaaaagcacatgccgccacactcagctaaataactttttttttttttagagacggggggcggtctctcattgtgttgacaggccggtcttgaactcctggcctcaagcaatctacctgcctcggactcccaaagtgctgggattacaggtgtgagccaccacacctggcctaagaaatatactttttgaatgacttaatctaaaatattaaaattctaacaagtcaaaacacatgcaccctttgaaaacgacttctggctgagaacataggcaagacaaatatagcaaatgaaataggttaattaaaaaaaaacctgtcagttatttaaatttttaaaatactttttaagttcagagacatactgaatcatattcctcagttatcagcaagtgcttttgatagctttatgaaatcagctcacaagtttgttaaactcacattaagaactcaatcccagatgtagttatgatatcaaataaaggaactgtctggaggaagaaatgtacagacatagtaatcaaattctcatacaggattaatgaatgacatgtaggccaaaagatgattcatcttattttaaaagtaactttaaaaaaaactttgattattttagaataaaacacatatccttataggtttccttaggcagtgtcaaaattaattaaatgtatttatgatatattaatacttggtcatcagaaatgtaacagaaagggaaaacataactcttttgaagagtatacctcatcttttccaaatcaagatgagtcaaatgaaatttgcacaaattttccaaacaaaggaatatccaggaactagacatcattactaaattagcaaatctttaagaaatatcttaagataatgtaatgataaagcccacttttaaatatgagagctatttccaatgcagtgtctatttccaatacagagtctatttccgatacattttttgttttaatagagtcatatttgaactatgtttctttcaatagaaattgactattttttaaaacccaagtccattaaacagtgagttaagaaaaattacttgaaaaaattagctaaagtctcccaactacttacttataaagtgagaaaaataaaattaatattaggctgaggtgagaggatcacttgaggctaggacattgatatcagcctaggcaacatagcaagatcccatttctaaaaaaagaaaaactcagcatggtggtgcatgcctacagagtcccagctactcaggaagctgatgtgggaggatcacttgagcccaggggttcaaagttgcagttagctaagatcacaccaatgcactccagtctgggcaacagagtgagaccccgcttcgtaaaaaagaaaaaaaaaaagggattttgatcagatataagaaacattctgggaatcaaagaaaaacatcaaattattcaaaatgaaatatccctcatgtaaattacatgtttaaaagtgactacacattatttgcaatgtttttaaaatttcaaataaaatttatccaataaattactttatagtctcatttctggcaccagtaataatatcaatatgttaaatagaaatgctttttatttaaaatcagatttaaaagatatagtccatccaatttctacttctacatttctacatattccaatactgactgaaggcaaacacctcatttccttcagtgtttactcccctctgataaaaacgctgagggtataccaagcgtaggactctgttttccttcaaatccatactttgttcctgtgaactcacttgggggaaaaaaaaaactatatttttgtataagctgaatgagaagcacttgtaaagattgtcagatacttaatgtggcagatggataaaagggatgggatgagctctattttcagactaataaaaacctaattatttcagaatcaattatatttatgactaattttttaaagtccaaaaatgtattttgtcatgagaaatttgagctccaaaattaaatagatttagtgttttgtttcctatactggattatatttcaaaaatggttttaggtggaattgtaaagataagcaattttagcacatcttaataaatccaaagacacaaaattcaaagggatgattttatttttaaatggtaatttacgtaaaagcgattcatcatatataaggaagaatatattttcttggtttatatcttttataattaaaactgagaaataaaactgtggggaatataaatgtcttatacaggtttttatttgtcagaaattagtctattattaggttacagaaaatcttagattttaaatgacattgaacctactaagccatacatttttttaaatccccacaatatctaaaacttttacccttgaaagaaaacacactactgtttcaactataagcaaagttgtctccaagtattaaatgtatatttcttaaagacttaaaaaattaataaacattttaaagaatatatttattaagtttccaggaaatattctgtccttaccctttatttttctatttggaatacattgaacttagaaatatgtccaagataaagaaaaagtttacatagttttctgtgaaaaatgatgaccaatacagaaaatgtagtaaatacatgaatgaaatgtaagaaagtaatcatttattttttatttgcacagattaagttaatccacactgaaaactagccactgaactaaaaaagcaatagctagaaaaagtttacgtgatgtctaatgcctccaccctaattatcattaggttttacctgccaagtaaaaatagacactctagaaaatatttcaaaggttttagtatgcttgacccaggactattggcaaccattgtgaacttcagggatgattacggtatttaataatgaaatgcttaagtacacctgaaaatggatgataggcacttttaaaacttcatttgtttttacctccatttcattagagtcgttatagtattaaaaatattatatttgcaactcaaggggacatcatagtatgctaacaagctaaaacaaacctatcatttatttccactgtttcttggcagcaatataatgattttaattcaaggctttccaaattctgcaaacattatggacctttcatcacagtattagattatctatccgaatctccaaactattacatatcttagaaataattttttatttagtaatcattttaattgtctaatcaacaccttgaattgaaaatcatactttaattgccaactgtatataacctatgtaattaatttaatgcccagtaatttatagctgattatagcaacatatattttaatgagagcatgtacaagtgaatgtaatgaaattgctaattcctaaaaagtttttgcttatttataccttgcttagagttaacaggaaaattatattttatccaaacattatgcactgcaataatggcataatgaagacataagactctcctggcctaatctgattctctgcagagcagatgtagttagtacttagcagtctagactaaatataaggagatttattttaaagtgcatctttaccaatactcttgtgatggtcccaagatgaacttaagtttacttaattataatgataaattgttaaaacatatataaaatcccaaacagaggcattccaaaaataacagagaactaagttccaccaagagcccatcaaaactcaagtgtaaacctcatgtaagtcattgaaaacaatgaaataccttaaaggtaattgaataattgaacagtgaaataaaccaaaattagagtgatataaataagacttccatttgtttccatctcactctgtgaatttacatgtaagattaagtgataaactaacacttataaatataatttttagcttaataaaacagactggtcttatttgtaaacatatatatatatatatgattcacagatataaaataagggacaatcaaatactaagacatttgctgtctttggagaaatcatcatcattgccatatattcataccccatttccaaattataaattcacttgggaaaatcaaagactttcattatattgacacaaaagttaacagagttgatctatgcctttacaattctttttaaggtgtcagacacgccaagctcttcctccatgctttgtaatttcaaaacatactccaagatgcaataaagttcttagtgatcaaaatgaagtgctgagattgccagagattacaggagaccaaccactaggtctctgcgattccagcaatcatggtgacagggaagagttgccacttgtccactcttctattcatatatctacctactcacctactcatccatgcatgtacgtaggcatccacctactcaactaaatacacccaatgtttgtcgtaccttgtatagtgaggctgtccaagtctttagaagttcacacttttaagaaagggaaaaggacctgaaaaattggcagatgaaaatgaagacagaaaagaggaaaagaaagaaaattaagactaaagtagagaaaaacaaaaagtgtagaataggttatatacatcttgtaaaacaagatattcatccttattatatttctatcactcacttatctcttagataatgaggtttctacagaacataatataaaatgacatattaaagaatatggtgacatcaggagaactgtaaagttctttgaaaggcaaatagtgccgggtgtggtggctcaggcctgtaatcccagcactttaggaggccgaggcaggtggttcacttgaggttaggagtttcgagaccagcctgaccaacatggtgaaaccccttctctactaaaaaactacaaaaattagatgggcttggtggcagatgctgtaatctcagctacttgggaggctgaagcaggagaatcgcttgaacccgggaggtggaggttgcagtgagccgagattgcaccactgctctccagcctgggcaacagagcaagactctgtctaaaaaaaaaaaaaaaaaaaaaaaaaacaaggcaaataaattaataaatgcagctagaaatggatagaaatttattttgaaaaacgtatttatttttgaacttttttctggtccactggagaagaagccacaaaagatcataaacaatgtgtacgtaaaattataaaattgtatggttgaaactgtaatgcatttattccaatttcaaacaagaaagggcagattagacatttgactcatttgacaagcatcagctttagtcctctttggatttattctcctgtaattcacagaagagctctgaccaaattctaattttttgttcttcaatatttcttatctttacatttcgtcatgcattaaaatcctatttggacttgtctggcaccaatggcacattcttcctggctaacagcattatgcagatattaataatgttttaaaagtggtcaagggcatatcagcaatgcactttgtccctcttttaatgaaagaaagctcatacttaaacaggtgaactatcacatacctaaagttccagtgggaagagagaatcaaatatcaagtctaacaagatatttgttaataagagcaacaacaggatcttgaaaatacaaccataattttcagaaagaatacctaaaatttttgcagaaagtcatatttctcttagtcttatcatgaaataacagcacctaaaagcttggattctatgttcattgttcccacaaagtatgaaaaaggcatgagaaacattattaaataagactgatcacagtagagctactaactgcattcattatgttttttaaatcctcaaagccaaatacagtttttaccaccatgtccaacagagtttcagtgttataatgaagtttagtaattcctttaactacctgtgaaggaagtaaagtatcttctaaaaacttctgggtgctattgacataataaaaaaagagggagggaaattgctctataacagattttataaattttttatggtgtagtttttatagtgcatctataaaatacactgaaatgtgattatcaaatattgttcagctcccataatgaagaaggctaacattaaggatctgtccttgtttttactttgtaactcctattgtctgagccagattctcctcaggaccttattttattgtgattactgcaacatccctgccagcaagtgtagagcagacttggtcactcctttgctgaagtcagccaagagaatattctattagacaaagtaacatacgcctcaaaggcttggaagccaggggaaaaagtgagacacatacaagacaataatacataaaccaattaacttagcctctcaggaaaaccatcctcagtctcatcaaattgtgtattatctggcaatataaattgaaaatctatttatagagtagtcaggctaaatctcttattgctaaaacagaagtagtgaaggtcaaagaatgcaaaatcctaggaaacacaatttttttccaaaggctgtttaatatgcctttgatatagattactttattgacaatggttcttttgtctttctgaaaactacatctgcacaacaactaggtcaccttgaatttcaagtacaacattgcctataaatttaatttaacatcatattatccataattaccatgaacaggaggcaggtgtgacccttatggttaagctagagggaccaaggacaggataggttaatagacttgctcaaggctccagggtctgagttaactacaggctctacatgagccacaagtatgacctggctattaaaatattattacaatcacatgcttctttaaagagtagtacttccaaatcaaaggaggtaccagttccattgctggatagtacactcttcactccaactctgaggaactttattttagcgttagatggcatctttcatttcatagttggaattgaaagcatccatagagggcaatgagaaaagcaagcaatctgaaattgacgccccaggaactctgaatcagggaactctgagttgcagagaaaaggcggagcaaggatttgagggctatgtagctatgtataaatatccaaaggattgtttggtaaaaaatcctccaatagatcatttattctagttgggaatgaaagagaagaggtttttttgttcgcttgttttcgtttttgttttttttttttttgagacggagtctcgctttgtcgcccaggctggagtgcagtggcacgatctcggctcaccgcaacctctgcctcctgggttcaagcgattcttctgtctcagcctcccaagtacctgggactacaggcaagcgccaccacgcctggctaatttttgtgtttttagcagagatggagtttcgccatgttggccaggctggtcttgaactcctaacctcatgatccgcccacctcagcctcccaaagtgctgggattacaggcgtgagccaccgcacccagctctttcattttgttgtttctaaatgtaattagggctaccataaaataaagggatttttcctaataagtagtatgcttcatatcatgaaaatgttctaggtaatgtgacagcctatcttgtcggtatcattatcagaggggtacctaaatttggaaggcagtgaaatgatacatggaagatctttaaatctaagcttctgtaattacaggtcgtggagtctggcagagaaggagccaaactcagaactcagatctatgcagattagctctctgcccttcctttaataactggactcttggagcatctgattgacaggtctctaccccaatctttctactctgactgaccttacataacacgtagggttctctaatacagctgatgctattaacttgattaaaaatatttgataacttttaagtcgtcataggacaaagcccaatctgtctaaagtgacatattctggtctacacacctgaatttacatggtctcctaccacacttctctaacttccctgagagtgcctcgggtgtcaccaagtgggggtggggtgtaacacggctagcagctgtgacaccaggccttctttcctgcttggagaaggcagctttgcttttatctctttttcatatatatagatcatgtatataggttcaaaaaaaaataaacctatatataggttcatgtttttaaaacggcttagctttagaaaaccactgcttcagatacacaaaggcatcatggcacctctaacagtacaattaagtactaactacatgccttcctgcctttagacactatcttcacctcctcatcccttcctggcaaatgcctgttcgtcttttggggctgtaaaacaagcacaaccttctctgtttcttcaattcccaaggctgaattatttgctctttctcttctcccattctacacatgcctctttttttttttagtactttatacattaaaaatagtattaaacaagcttatctttcccatatacaattaccttcccagagctaggggtatgccttatttatatttttatctccacactttgcacagtgttttggatgtagcaggctctcaataaggctctgagtgaatggtagtcactggttttcaacctgtaatctttgacattctaggattctgctcaagattgagataattatgtaataataaccatggtaatactgtccttatattttccagcaacatttttcacaacccttgaattggaaatatgggtttgtggtcaatgagatgggtaaaggctggaaatttcctttaggaagtgatctccagatacatgatgatagaagtcatggaaattagatttgcctctccaaatgtcaggctacatttccatcatagggaaagagaacatttaccaccacgggctgagcaccatcaggcatattgcatatatcatttcatttaatacaacaccgaaaacaaatttgctctattatttctactttataaacaatgaccatgaaacttggaaacattaaaataattcaggctcttaataagagaaaattctagcctcgggaacatggcaagaccccatctcttaaaaaaaaaaaaaaaaattagccaggtgtggtggtatgctgtggtccatggtcccagctactcaggaggctgaggtgggagtatcgcttgaacccagcagtctgaggctgcagtgagccatgttcgtcagggtgacagagacagagagcctatctcaaaacaaacaaaaaactcagaaaattctatctcgtcactcctattgcatcatgactactagttcactcgctcattaattcactcactccatttattgatgtttatgaaatttattaagcacattagatgtgcctttaacatacaaaagtttcttgtaagtacattacttggatagattccaaatatttaatttccaggtccaagctgctttgaaatctagaaacaggccattatttaatttttttttttttttttttttgagacagagtcttattctgtcgcccaggctggagtgcaatggtgcgatcttggctcactgcaacctctacctcctgagttcaagcaattctcctgccttagcctcccaagtagctaggattacaggctctcaccaccacgcctggctaactttttgtatttttagtacagatggtatttcgccacgttggccaagccggtctcaaactcctgacctcaggtgatccacccgccttggcctcccaaagcgctgggattacaggcgtgacccactgcacccggccaaaacaggcctttatttaaagacacattttgaatttaaaaaaaggtaaatatgcaacttttaggggaaaaaacattgtatctctcatacataatatttttaaattataatgtgcccaagataggaggttttatattcagatcattttcttgagctagtttaaataacagttttttgtgtgcctttaaatactggtctatatattgtttgcaaaattgtgaccattacattttaaaaatctctacaaacattagatgatatcacataacaaaactttgacaatttcacaattttattccttttgacaaaattttattttaaactagtttaacatgtgtaaggcaattttggatttaagatttccctattggttttgttttaaaatgcacctctctggccatgatttcagcaagccaaatttcacactacacattttagaagtttcttcaactcagaacaattgcagtaatcccagttataccactacttcttagctcaaggatttggctataccacaagttatataacgttcccagaaatgtaactgctgagaaacagtcgaaatgtggttcactataccttacctgtaccaaacgtggcactcctacccccaataccagtattataaagtagttccctggtcagaaaacacaaagcatacctttaataattgggacaaacacacacacacacacaattgggccaccatttgttctaagtatagttgcataacaaagctgactgctttaaaagctggactaaatcatgctgattgcttgaaagtccagactacaagaacattggggctaagaactgtattttcttcataacctttggctaaatttgtcaaactgaactccaaaattctcctaaagattctagttctgtctcctattcatttattgtagatgttaaagtgtgactagatgcacgtcatatcagatacagattgtttaaacaacatgtgacggcaattctattatgtgtcaaatagagatttttggtaagcaggcaatcatttaccttagagcaaacaagttagaaatcaagaaggaaaaaaaaaaagccaccttaacatggctatcatttcatttttggctgtctaatctttaggtcatagagagagtggggcagagcttgccaaggttgcaggttcagacatagagagagtggggcagagcttgccaaggttgtaggttcagaaatgacttagcatttaccccccagtcaacagaaggcaatgaattccagtcaccatttctctgtacaattcctcagtggactacaaagagccaactcacttgaaggaaatgctaaaaacagaataaaagagtagtcaccttcaattgctcttagttttctctttctgtcctacttgattggtatttcctgcattacctatgactgctttctttcctcatggaagggtacttattagaataagattatatctgtaataaaaagaatagttcaaaatatctaaatgttcagatagtccgtgtagactggttataaacagatctgtaaaaaatgactaaattatatattcttattgattgaactagtatgtattaagtcctagaaaggagaaaagaaataaaagtattcatagttcttgaccataaggaacatacaattggattaaaaatagaatgggctgggcgtggtggcttacacctgtaatcccagcactttgggaggccgaggtggatggatcacatgaggtcaggagtttgagaccagcctggccaacatggcaaaaccctgtctctactaaaaatacaaaaattagccaggcatggtggcatgtgcctgtaatcccagctacttgggaggctgaggtgggagaatcacttgaacccaggaggcagaggttgcagtgagccgagatcatgccactgcactccagcctgggcacgagagcgagactctgtctcaaaatacataagcagagagagagagagacagaaaataaaaatagaatgaaagtgtttgaaaaaattaaaaaatcatgcaaaatacaaaccagtttgaatgaaaaaaaggaaagaccaggacattctatgattagctgccagattaatgatagaggcaacagaatgtcctagggatttggagagggagatgatcatgttagaatcatgggtcaacaactgctgtagagcaatggaattgactttattgatttttaaagaaatggctaaattcaggtaagtagatgaagggcagaaggggagccacatggtgggaaaatgcagggcttactggggacagcaagtaagccagattggggcaacagagtttggtcaggaagggagtggatggttagcatggtacggcaggccagggccttatggggaatgcctggacagctgtgctcaggagtctcaacattcccactgaatgctcaacatgctcggtctttatcaagggctttccatttacactgtcatgcttcaatctctcagtaaccccgggaactgggactttggatcaggagggtcagtgagttgaagagacttgctcgttagtgaaagagccaaaattcaacctcagactctatggctcacaaagtcagtgctcttgctggtggggacatgggaatttcttgagtaagggagtgaaataaaaaatttagtattccaggaagtatactctagccagctggtactgagggactgcattaaacaaaacaagtcagaagtagttccactgaaagtttcaaaatgtaagggagattgacttgttcatgtaagacatcaacagagctagactgatactagcataccaaaaccaactaatcaatagcttggtcatgctactctctctgtgttggtctcattctctcctactgcatgtttcatgtctccccgcaacatggtggatgtggggctgggggtaggcagagaagaaagtaattatcttagccacagcagaaaaagagacaacccctattacaacatcttcatataaaacctcagtaaaggactctgctagggcatcgctgtggcccggaggtagagtactgacagtgacagcacaactgaattaaaaagttgtggagggagttgcagactaaaagaatatagaatgctcttctcaggagacattgaaagaacggatggaaagacaacagttattcactataaccagtatgcactgaagttacactgaattaccaaggtaggataaattcttccacggttgaagaccataaacatgacatggatcatgcatttaattatgttatcctgagttaattcgttatcacataacggagtttgcatttttattcacagacatgttaaagttatatgagcattgcgtgtcattctaatggtatgatgatttccaaatttaccctatatctttctctactggttcacatgtcttgtttttagaaattactttaggaaagatgatttcagttttgtctccctttgtttcatttctgtttttgttttgaaagggggtaaagttatgttgcccaggctagagtgcagtagctattcacaggagtaatccccctgctgttgagcacagaagttttaacttgctctatttccaacctgggccagttcccctctccttaggcaacctggtggtcgcccctcctaggaggttaccatactgatgccacttagtgtttgatgcaaacacccaatgtgcatgatgcactacagcccagaactcctgggctcaaggaatcctcctgcttcagcctccagagtagctggactattggtgcatgccacctcacttggcttatttgtttttaaaatatgctactttcatactcaattacctttcatcaaaattttgtatatttataaattatatatatataaattatatatatatatatttttttttttttgagatggggtctcactctgttgcctaggctagaatgcaatggcacgatctcagctcactgcaacctccgcctcctgggttcaagcgattctcctgcctaggcttcccaagtagttgggatttacaggcacctgccaccacacctggctaattttttacttttagtagagacgaggtttcaccatgttggccaggctggtctcgaactcctgacctcaagtgatctgcccacctcaacctcccaaaagtgctgggattacaggtgtgagccactgggcccagccaaaattctatatttcatgatactatatatttctttttctcagccttccccaaaggaaccatttgcctattaccaggttgactatgctataggaaaaaaaaaaaaaacaacagtccgacatttggggattactggccctgaactgacacattccaagagatccaaaacatcactgtggcccaccagtcagagcaggagttagtggaggtcaggtgatcaaggagttttacctcaggtcagtcccatagtgggtacagtgggtccctgaacccatcctgtggttatttcctcagttccaaaatgtataattggaaaaaaactactgagcaactggcagaatccctgcattggtggggaatatagaatctttcttactttagaatcttctctaccttccattctgggtagtaaaacaaatatctagtgtgctcagaattagtactttgatttcaaaagtaactgcctataatgtctacgtgtatacctaagatatggacatagagaagcaaatattataatgcctcttaaattacttattttttgttttaaagacaggatcttgctctgtcacccaggctggagtgcagtggcatgatcatagctcaacacagcttcaaaatctgtgactcaggcaatctttccaccctagcctcccagtaagtccctcagctgggactgcaggcatgagccaccatgcccagcactatacataggtatcttaaatccatattatctacatttatcttaaatatacatcttaaaggatatatcctatggtttggaggtatcaagaaagtaaatatccaatttttcctaaacttattttataagcaactggaagccaatccaattaaattaatcaatgataggcaaaccatttggtgacacagaggttttgttgttgttgttgttgtttgagatagggtctcaccctgtcacccaggctggagtgcagtgacacaatctcggctcactacaacctctgcctcccagactcaggcaatcctcctaccaccaccacgcctcactaattgttctgattttttttttgtagagatggggtttcgccatgttgcccaggctggtctcaagctcctgaactcaagtgatcttcccacctaagcctcccaaagtgctgggattacaggcatgagccacgactcccagcctgaaatatagattttaatcttcagcttgcattttgttctaaacaacttgttttcaataagaacgggcagacaagtttaagccaccatttgttggagcagatcatttattggtgtgttcagatggtactgtactagccttcctcttcccctccatcctcctagccatgtgcagggaattttctctttttgttggttaacactcttcctcatctggattgccttcaactatgtgacaacgaagaattcaagcaccaaaatagcagcagctacatatcctttgcatgacagtgtaatttcttctgccttaaggctgtgtctagcactgaaatcatagtctgtttacttcgatctggtgctacattacaatgggagggatttaactcttacttataaacacacaagggaattatttctcagctctgtttagattagaattagagatgaaattgtgcagttcttgttgctgctgagccaatcaccccattgagcaaaaacttaccttcctactttactagacaagcaagaatactgtgctgtcttttaaaatgttctgcaatataactattagaaccaatacagaaaatttttggtggctagtgagtataggcaattaatcttgaaagtttcccacttgacttgaatgtttgactttctcttcagatgctttctgctggggaaggagcacttctgaattaaagaattttgcaaaagaaaatgtggccagggatattatgtgcgtgtgtctaaaactggggattatcagtacatgctaagtgaatatgaggctttataaaccaatattttaaaatttcatgatcagaaaaagtaatctttaacaccattctcttacccgtgatcgcttagtaatcttcgtgtctatgaaattctacctctgaaatatctcttcagctgttcccttctctctattcccaattttatcttttagatcctattgtctcatctgaatttttagaagagcctactaatttaatcttctgcttctgatcctttccctatgttaactttctaaattatgaatataatgtcacaatttggctcaaatgtgattttaaactataaagtaatttaaactgtaagtcatataactagtttgatgataccgtaaaggtagatataagatattaatactactactcagagacccatgaatgtatctcagtgcctggcacagaataggcacttgataaatatttgcttaatgattagtaagctttccatcgttgggcttatgagaagccaacatttattgagcatctcctttgtggcacatgcgtcaagtctccagcacttgcttgatctttagctaacactgttgttttaatgattttctcacaaagaaacagatagggtaggtattagtctcattttaagtatgaagaaactgaggtcttaagagtatataactttctcaaagtcgcaagactaataagtaccaaggctggagtttgaagttaagtctgaattcttaatcgaccctcacacttacaacatgcagctgaaactttttcttcctgttcctttgctttaatagtttaacatactatttgatacatacaaaagaatacatgtaacaaatataaattgcagagcctaaaaataaatagtaagtatcttagtttttaaaagtgagcaaaagataaatgacaagtcaccaaacagacaagtaagcaagtaaatgatgctcaacgtcatctgacattagggaattacaaatttagacaaagaataccactacacgtttgctaaaatagctaaaattcaaaacagtaccaccaacaactgttgggtgcaaagcaaatggaattctcattcattgatggtgagaaaatggtacaaccacattggaagacagtttggcagtttcttacaaatacgacccaacaatcacgctactaggtatttactcaattgattttaaaacttacgttcacacaaagcctatatgcaaatgtttgtagcaaccttatgtatagctacaaaaaactagaagcaatcaagatgtcttccaatagaagaatcgactacacaaactgcagtatagctatacaatggaatattattcattgataaaaagaatgagctatcaaaccacaaaaaagatgaattttgaatgtatattgctaagtaaaagaagccagtctcaaaaagctatataaggtatgattccaattatatgacattctagaaaaagcaaaaatatagcagtcaaggtctgtggatgccatgggttcagagtgggagagacaaatatgtaaaacataggggattttttttatggaggtgaaactattatgtatggtactctaaaagtagatgtaagacattaagtatttgccaaaacccaaagaactttatagcacaacgaataaatctcaatgtatgcaaattaaaaaaaattaactagaaagtcggggaagcctagcatgaaatgcaatctaaatatattataaataatctaaacatattacattgcatacaacaacttcccagaaaagtattggggtataaagtgcagaactaagtaactcttgaagaaagggaagtctgtaagactaaaggtaaaggaaactgtacgtaagaattgtctcccacaggggtatggattaattttgaaaccattatatatgtatactaaaattaaacaattgagtaaatggatggtggatagcgtgagccagatttctcactgttttactgagagattacagataagcaagggtaaaaacgctagaatgatccttatgggaatgaattagagctgaagacctcagtatgaactcatatttagtttaatatacagaggattacatataaaaatgtttttatatgtatatacatgggccagcacacacacacacacatgcacacgtgcacacacagagttcgctctatcagctgaggtctagaagcaataataccccagtggcacacagggcacgcagatcttggtttctgattccattttccaatgaccagggcttcttcaacaaaaggctgatcctgtctgcggcaagaaatacccaagatgagtgtggagcctcttacagtgccagagttaggaagtgccaaaagaaaaaaaatcacctaaaaccccacaacgatgaggctatgtcaaagggacgtaggagctaattaaaagaacatcctatgccaaaaatggaacaatttaagcaacaaaataacagagtattgaattataatccaaagtatgaaccaggcttgatggcacacacctgtaatcctagctacttggtaggctgaggcagaaggatccctggggcccgggaggatccctggagactaggagcaatatggcaaaactgcatctccaaaaacaacaacaacaacaaacaacaacaaaacaaacaaaaaacaaagtataaaataaatatccatgagtctctactgacataagtaaataattgaataaatcaacaaataaatggggtagaagagataaacctactatgtagaaaaattccaaataattccaaataatttgtgtaggtattctatccaaaagaaagtaaagcataactactctctaagtatggctctctaagtatgacctgtttccaaacagtagagtatgaaaaaagaaaaaaaataaaaataaaaaagagtggctctagagtggaaaaagtggagaaacctgacaaacactacctcaagcaggtgataaaagtttatatcaacagtgataagtcacattgacagtgtttacccttgatatgatgtgatgtggcactgtacctctgggatcttccttctaagtgtaatcatgagaaaaacatcagacaaattcctattgagaggcgctctataaaatacctgaccagtacacctcaaaactgtcaaggtcgtcaaagacaaggaaagtctaagaagctgtcacagctaagtggggcctaaggagatgtgaaaactaagtgtaatgtggtgtcctgtatgggatcctggaacagagaaaagcatacataaaaactaaggaaatctgaataccatatcaactttagttataagcaatgtatcagtattggttcattaactgtaataaatgtccccctactcttaacagaggaaaatgggtatgggatacacaaaacactatgtactatctttgtaataattctgtatatctaaagtcattctaaaatagagtttatttaataataaataactagctatgaatgtaccacccaatcagaaactagaatattatctgtaacctacagccatcctctgtgctccatctctccccttacttccggtacctcgcccccacctaaataaatcactatcctgaatgttgtatttaatatctttcctcgttttagcacagtcttattacacatgtatgcatatatacctttaaagagtttgcttatttttgagctttataaaaatggcactgtactatcttctgagacttgcaccagtggattatgtataagaaaatttattgtggcactctttctgaaagaaaaatctggaaacaaagcaaatgtcccaaataaataaacagtggtatagcttgcacaatgaaatattacacaaaagtgaaaaatataaactacattcaacaatgtggatgagctttagagaaacaatactagagctgggcgctgtggctcatgcctgtaatcccagcactttgggaggccgaggcgggcggaccacaaggtcaggagatcaagaccatcctggctaacacggtgaaaccccgtctctactaaaaacacaaaaaattagccgggcgtggcagcgtgcgcctgtagtcccagctacttgggaagctgaggcaggaggatggcgtgaacccagaaggcggagcttgcagtgagccaagatcgcgccactgcactccagcctgggttacagagagagactccgtctcaaaaaaataaaagaatactagatgagaaaaggtaaaggtgttaatctgaagcagaaggccctttgtcaaatggccacaacctacctcatctatctcacttcaccgaatctatttccagtcacaccaaacttctccatgcgacctaaacattccacactcttggacacccacttagcttttatttttttaaaaaggcatgttgtgatacaattcacataccacacaatttatgcacttaaagaacacagttcagtggcttttagtacatacagagttttgcgaccatcaccgtaatcaattttagaatatttttatcacactacaaagaaacatcatactcattggcagtcaaatcccatttcttgccaatccctacactctccctggccctaggcaaccaccaatttactttttgtgtctatggattttccttttctgcacatttcatctacagtaaacggcatagtatgacatgtggccttttgtaaatgactttcttcacttagcataatgtttccaaggttcatccatgttgtaacatgtattagttgcatcatcattccttttttttttttttttttttttttttgagatagattcttgctctgtcgcccaggctggagtgctgtggcgtgatcttggctcactgcaacctccatctcccgggttcaagcgattctcctgcctcagcctcccaagtagctgggattacaggcatatgtcaacaagtccagctaatttttgtatttttagtagagacgaggtttcaccatgttggctaggctggtctcaaactcctgaactcaggtgatccacccgtctcggcctcccaaagtgctgggattataggcgtgagccactgcacctggcctatcattcctttctattgccaaataatatgccattgtatgattatactcacttgcctttgtacatccagtttcttctgtcattgctctctgcttgtcaagttcctatttacccttcaatgcccagatcagagattacttccctaactcccatggcattccactgaaatattattacacttgtcacattgtattataattatcatgtgtatttctcctcctccacccactagtgaactgtgggctccccagacgcggggacaaagctttgtgcatctttgggttcatggcagttaccagaatttgaccaactatatctactcaacaaatgtttattgaattattgaatgagtaagttttcccacatttgtcaattttacatttattatacaaaaggagtatgcatactgtagaaagtgtgtgcaacaatgcagggttactatggtctcaaatctgggttcacatacgagttctgcttttgataactcaatggtcttgggcaagttgcttaatcagtctaagttccatctgaaacatggggataatatcacactcatatggttactgaatttaataagttatgtttttaaagagtttaacccaatagtggtagccattattatgaccaataataaaagccactaacagaagggtcggggaaggggcggggacctttaagcagtctgattcaggccaggtgcagtggctcgcacctgtaatcccagcactttgggaggctgaggtgagcggatcacctgaggtcaggagttcgaaacagcctggccaacacggtgaaaccttgtctttactaaaaataaaaaatcagctgggcatgctggcgtgcccctgtagtcccagctactcgggaggctgaggcaggagaattgcttgaacccaagaggcagaggctgcagtgagccaacattgcgccactgcactccagcctgggtaacagagtaaaactgtctaaaaaaaaaaaaaaaaaagtctgattcaaattcttcattttacaaataaagaaactgacacctcgtggggttggggggatgccagaggccactaaaggagggagcatggtgtgatggaataatcacatactatgaggcacgacatagctgatttttgaatcctagctctgtcttttactaactgcttatctttgggcaaatcgttgttttccaaacatcaattccctcctgagtatacgggggagcacaaatacctagctcacagatcagctttgtgaattaaatgagaaactactcatgtagtaggtttgtgtcatgaacacaaacatatacacatgtgcacatacatgaacatacacatacgaacatagaataatgcaataacaaataaattggaagaaagaaaagttttagaaagaaaaatgtatagtctaataaaaaaaaaagaggatagaaatcaccttaaaaggaagattaaattttgggaaaagtgatttatagtcagcctgcaataggaacagcatcttataaatatcagtgggtacaataatgtaggatatttaggaataaaagatgtttataaaattaatcattgttcatcttgccctctctccaaactggcttattttaaactttctagtattttctgtctgatattcctggagcagagctgaagaaaataaatgttctttctgaagcctctaaaaatagtccatcaacatgattttcctccaaaaatgaaaaccataagactggtaacatatttaaaggtgatggggcaggttttaacacacaactgtgccactgtttaaaaagtaccatcatgttcttttccttaggaagtgtttgtccattcactaaacattataaatgaagtagtagcatactcaaattgcaataacccacagaaattgtatagcaccatttaaagcatactattgatggggcataagtggctcatgcctgtaatgtcagcagtttgggaaactgagatgggaggatcgtttgagcccaagagcagtctgggcaacatagtgagacctagtctctacaaaaaaatatttaaaaattagctaggcatggtggcatgcacctggagctacctccagctactctggaggctgagatgggaggatggcctgagtctgggaggttgaggctgcagggagccatggttgcacctctcgacttcactccagactgggcaacagagtgagactctgaccctgcctaatgaataaagtaaaacacagtatgagcccacaaataatcccaataatttgataatatatgaagatctcaagaaactgtgaagaatacacagtggtattttatctctgtctccactaatttactggtgcctttatttatttatttatttatttatttattttttttgacaaagtctcgctcttgttccccaggctggaatgcaacagcgcgatctcggctcactgcaacctccgcctccgaggttcaagtgattcccctgcctcagcctcccgagtagctgggattataggagcctgccaccatgctcagttaatttttgtatttttagtagagatggggtttcaccatgttgcccgggctggtctcgaattcctgacctcaggtgatctgcccgcctcggcctcccaaagtgctgggattacaggtgtgagccaccgtgccttgccaattctgattttttaaaagatccctcacacttcattttttcctacaactttgtagcttggctgttttacatgaattaagtattaaataaacaagtatttgttgaatcttactttatacccgccattgttctggcaactgggaccaaaataaatggagatcctcctctccaggagcttgggttctcatgcagtgtgataaacagcaacaaacaaatgaatatgtaatatgtgagaaggaaatacgtgctatgaagaaagtcttgaagacagcaagggagtgagctctggggaaatctgggcagagggaaaagcacaaaagctccaaggtaagattacccgtgtcaggttcaaggagcagaagcgggacagtgtggctggagctgagggagcaacagggagagagctgggagatgaagtccaggaagtggtggaatccagatcagatagagcttttgcttttccccatgggagccacaggagagtcttgaacagaggagtgatatcatctaactacagtttcaaggctccctcgggttaccatgagagaatagcacatagaggagcaaggcgggaggagggagaactttcgagaccattgctgttgcacatcaggagtgatgatggaagcactggggctggtgagacgtcattaggttctgaatatattttgaaaggataattttaattgcacaaccttgttccatttgtcacaacatgttccctttttaaactgcagtctaaaagccaccttctccaagaaaggctttaaataaccttatggtctccaagccacttatataaaccctcctatttttccttaatctgtacccgcaaattgctttttttcttctatagactaaaggtcattgctgtcttagcctaatagaaacacaggaattaagtcagccaagtgatataacatggctacttcctaagaaatgacagtggagcaggcttaaaaggctcatcagtctagaacactcttgtctgattagggcctccgttccgacagcatcttcactgtgaagtgagacgaccttgagaatacaaagtgatcaaccagaactcatcttgtgggtcctctggtgtttttccgatttttaattcaacatagtgcacggacttcgatgttcaagtgacagcttaaccagttgtatttaaataatggcatgagcctgttcatcacttggttagaagaccaggatgcactggtattatagcatttatgcaaaaaccacagagacagaaaacagtatttgagaaaatgtgagaaagaatacagaaaggtctggaaagatatacactaaagtttcaatggttacctctaccaagtgacagttggaaccaggatgagaaagcaggatgattaaaggacactttgcttgatagtaatgtacaacctacttttgagaataaattattcttattgtgtagttaactttttaaagggtccattttagttatttggctccttcagcactattgaggcagatggaattccataatgtgtataaaaaacagttttatggaacattaatgcttgtatttcatattctacttataaccaaatattagaaatagttgaaaagttcctttccaagctgatatttagattcatgaaaggaacactggacccttggtgataatgaatataaattttcttaataactgataccctctatcatgttctatactgatacggtttggctgtgtccccacccaaatctcatcctgaattccagtggaaggtgactgaattatggggactggtcttttctgtgctgttctcatgatagtgaatgagtctcatgagatctgatgactaaaaaaaaaaaaaaaaaaaaaaaccccgggtgcggtgtctcacacctgtaatcccagcactttgggaggctgaggtgggtggatcatgaggtcaggagttcaagaccagcctggccaacatggtgaaaccctgtgtctactatacaaaaattagatgggcatggtggtgcattcctgtaatccccgctactcaggaggctgaggcaggagaattgcttgaagcgggacccaggaggtggaggttgcagtgagcccagatcctgccactgcgcagcagcctgggctacagagcgagacactgtatcaaaacaaacaaacaaaaaacaaataaaaaaacatgggagtttcccaagggagtttccctggacaaactctttttgcctgctgccatccacgtaagatgtgacttgctcccccttgccttccaccatgattgtgaggcctccccagccatgtggaactgtaagtccaattaaacctctttttctacccagtctcaggtgtgtctttatcagcagagtgaaaatggactaataatacagtacattggtaccagtagagttgggcattgctgaaaagatacctgaaaatgtggaaggtgactcttgttatgttttagcaaagagactggcagcattttgcttctgccctagagatttgtggaactttgaacttgagagagatgatttagggtatttggcagaagaaatttctgagcagcaaagcattcaagaggagacttggatgctgttaaaagcattcagttttaaaagggaaacagcataaaagtttgaaaaatttgcagcctgacagtgcgatagaaaagaaaatcccattttctgaggagaaattcaagccagctgcagaaatttacataagtaatgaggagccaaatgttaatccccaagacaatgggaaaaatgtccccagggcatgtcagaggtcttcatgatagcccctcttatcacaggcccagaggtctaggaagaaaaagtggtttcgtgggccaggcccagggtcctccagctgtgtgcagcctagggacttggtgccctgtgtcccagccactccagctgttgcagaaaagggccaacatagatctcaggccgtggcttcagatggtgcaggccccaagccttcacagcttccatgtggtgttgagcttgaggctgcatagaagtcaagaattgaagtttggggctggacatggtggctcacacctgtaatcccagcactttgggaagctgaggtgggtggatcacctgaggtcaggagttcgagaccagcctgactaccatagtgaaaccccatcactactaaaaaatacaaaactacctgggcatggtggtgtatgcctgtaatcccagctacttgagaggctgaggcaggagaatcgcttgaacccgggaggtggaggttgcagtgaactccactgaactctagcctgggcaacaagagcgaaactccactcaaaaaaataaaaagtaaaataaaataaaagaattgacatttgggaacctccacctagatttgagaggatgtatggaaatgcctgaatgcccagatagaagtttgctacaggggcagggctctcatggagaacctctgctagggcagtgcagaagggaaatgtgggcttggagtccccacacagagtccctactagggcaccgcctagtggagctatgagaaaagggccaccatcctcctgaccctagaatggcagatcctctgacagctcacaccttgcacccggataagccacagacactcaatgccagcccacgaaagcagccaggagggaggctgtaccctgcaaagccacaggggcagagctgcccaagactatgggaacctacttgttgcatctgtgcgacctggatatgacacatggactcaaaggaaataattttggagctttaagatttgactgccccactggatttcggacttacaaggggcctgtagcccttttgttttggtcaatttctcccatttggaatggttgtatttacccaatgcctgtacccgcattgtacgtaggaagtaactaacttgcttttgattttacaggctcataggtggaaggggtttgccttgtctcaaatgaggctttggacagtggacttttgagttaatgctgaaatgagttaagactttggaggactgttgggaaggcatgacttgttttgaaatgtgaggacatgaaatttgggaggggccagcggcagaacgatatggtttggctgtgtccccacccaaatctcatgttgaattcccatgtgttgtgggagagacccggtgggaggcgattgaattatgaaggccagtctttcctgcgctgttcttgtgatagtgaatgagactcacgagatttggtggttaaggaaaaaaaaaaaaaaaacaacagaagcttccttgcacaaactctctttttgcctgctgccatccacataagatgtgatttactcctccttgccttctgccatgattgtaaggcctccccagccatgtggaactgtaagtctaattaatcttctttcttttataaattgcccagtctcagggatgtctttatcagcagtatgaaaatggactaatacatataccataagaaaatctggcaagaaagctaaaagttaacaggagaggttaacagaaaacatgagctgagcccaggaatgaaaaaatggggaatggcattcctcatcaggaagcccacaaaaagaaacagcaaggaaataaaatggctagtggaggatgtgaattttagcagatgctaaagatagagagatccaggacttgtagaatcatagtttcaagaagtagttcctctggagtttcttgttttcttcttttatatttaaattccccattgtgcaatctaatttccttagctctcacaataatgctttcacagtagaatcattctacataacttcaaaaagaaattcttcatacatgaggcataggatgtcaggaagagagaggggggaaaaacccctaaacaatgggtaacagttgataataaatcccatacaaggcaaggcatcacaaggatgcagcgtgtcttccgagtacaactggcttatgccttgacagactatgggctggtgacaagttgagggatctgtggcttgatagacgtttcctaggaaatgaggattctgcagttggttttcactgtgctgccaaactgttctgggaaaaacagatttagagaaaccaatgaacttctttatctccatgcttccctgtgtccaccagagccacactcattctgtaatccctgagtccagcttgtgggcagacacaaagcagcatgcttacctgatatagtaagatgagcagtaaacccaaagatttaaatgaggtacagctttctcacacagcacaatggtacactgatggcacagcacctgaatttaattgcttctactactttgactttggtgttgaggagcatggatatgtatgacaaactcctaattcaacactgtgaactcatttcttgttattatgtttcacttgaaactgtctaaatgagttagaataactcattatttttttcacccaaagggtttgcctgctacatcttgtttttatctcaattaattttgtgtctgctggactaacacaaattaccacttccatgtcttgcacttttgatgtaaaaataaagctaatttgggaggtgtttaaagctttattaatatgtatatggccattagcagcgcctatgatgttagcaagcttctttctaaaacttagaaattctccttctgattctgagctgcagcattcccactctgaccacatcatttttagcatttttcttagggcacaaagaggaatttcacacagggtcatagaaaagttggtttgagttttcctaccatttatcttacccattctgctcagtgagtcagacttacataatacatttctttctctgattttcttcagaaatccagaggcagcactttctcccacggaagtgcatggctgctgtgtaacaaccaagcactattccgcctctgtttccccttctccagcctgaacttagactgggcaagtaaaaaaagagtcacgagtattctaatgtgataccgaaatacagatgatgagattctctcttaaaaggaagaaaggatgcaaaggacaagatccatactaaataatgtggcctatgactccctctgcactccccctgtaagttcccccagccttaaacaaaaaagcccaccagtgctttcagcatagtagggcagctaaagaagaccaaagaggaaatgtgaccatcaattgggaataataggtcctgaggctaaccacatataacaatggaacaagtaaaagtaattgaattgtgcttagagaaatgaggattgagaaaaaggcagcattgcatcagtctttgagagtatgaagctatacagccagttttcctgaatacttctcccaagtcttccattttctggatgtgtgacctcaggcatgtgatttgaccactctgtgccttaatttcttcatttggaaggtagggataatatttgcactgttctccctgaggttttatgagcactaaaaatctagtgagtaaaaaaaaaaaaacatttacttagaatagtgcctggcacatattaagtatagtcgatcctcaggtaacaggggtttgaactgtctgagtcaacttatatgcagataaaaaaatacagtattagtgggttacaaaacccacatttatggatagccaactttttgtatacttgagttccacaggaataagcatgtgtagatttggaatggggtgggggtagtcccagaaccaatgctctgagtatacccagggtcaactctactccataaacatttgttgaatggaagggtttggacaaactaagtcaaacattaaactgaatagcaagtaagatataatgtacattaaaatgacaggatctgtaagctatttctagctacagccacagaattaaataaatttgagaagtaaaatgcaaaataaaagagttttaatagttttctgctattaaaaaagagaaggttaagattaattaaaactaatctttaaagtaggtattcccaccatgtttagtaataatttgtcattaatgcatatatattaatctggcatctttcacatattgcttagagctatgctagcaaatataatagccactagctacatcaggctattgacagcttaaaatgtggctggtccaaactgagatgtcctggctgggcgcagtggctaatgcctgtaatcccagcactttgggaggctgaggcgggcggatcacctcaggtcaggagttcgagaccaggctggccaacatagcgaaaccctgtctctactaaaaatacaaaaattagccaggtgtggtggcatgcacctgtagtcccagctactccggaggctgaggcaggagaatcacttgaacccaggaggtggggtggttgcagtgagccgagatcacgccactgcactgcaacctgggcaacagagagagactgtctcaaaaacaaacaagcaaacaaacaaacaaaacaaccaaaaaacaacaactacaaaaaacaaattgagatgtgctatatgcataaaatgtacattacatttcaaagacctagtatgagaaaaataatgtaaaacctctcattaataattttcagtactgattacatacaaatgttatgagttaaataaaatgcaatgttaatcataatttcacttattctatttattttaacacagctattagaaaatttagattacatacatggctcacatttgtggtctgcattacatttggatcaataaggaatataaaccgcactattattaccactacttcaaactaacagttattgagttcttactctgctagatgttttaaatacattatttctagcatcacaatacctctgtattttctctccttttataagataagatgttctcagagtatatattgccccaaatcacaaagctactagtgtcaggggaggaatgaatccacatctgtctgagtgcaaagcctggtgctttctcctatactagagaccacatggaactagaaaggcctaagcccccatttgccaacagaaaaggtaggaaaagaattcacgagcgacatagtgcatatatgaaaagcaaaaatgtaaactagaaaaagtatactcataaggaggccatttgccatgttttcataaaaaattcaatagagaattaatataaaagtgctaaatctgatacctagttaacagcagaaaatgcttagatgttatatagcatgaacaatcagaatacaacactatccatacacttactacagctctgtaaaaggatctatatatcatgaaagaagactgacagggacattcaaaattgataatatctttgaataaaggcaactcaaaaatgagcaggtggggtggggactttgatcctcaggggacatttggtaacattgggagatacttttgatggtcacaactcaggaggtactactggcatctagtggactgaggccagggatgcttctaaacatcctacaacgcataaaactacttcccaacctgctgagattaagaaatcttataatagggtaatggtgttacaaatttcctcctctactttccacattcgataatgttaaattgtcttactatacaagaaactaaattaaaaaatataaaaaaattattactaaaaaagtaacagaaactaaagcataatcgccaacatagaaggttattttatatatgggggtaggtgctgggtaatacaagagggtcccttaatatagtagcaaattccttctaagtacttcttagattcactaaaaacgacatctgaaaaggatatatgcaattatacatagattaaaatttggccgtgtttcctcaatcactacttgccattggaatgactgattcaacatctaacaggaaattggcactcctttcactgttgggatagcatttgctaaacatcaaaatattttttctcactcctttgagcaagtagtgcttcacacgggtgttattattactgagattgacaatatatgctgctatttacactgcatttaggaagagatgggaagagagatttttctgacaatttttttcagtatctgcatcattatgataaaaaacagaagcttaaaacttacacttgtataaattctgtgtaaaaactactcattttgtgagcttaactatttgtactaacagattacctgattaaagatttcacaagagtaagtatatatgccatgcttgcaggcatgaaagaaaggaaatctgaaagctgtgtatatactcatctttttcttcatttattcagttacatcaaaaaggggatttcagaataaaaatatgtacaggaagaacctatttaaataggtttattgatgctataaggaaggcctaatcacagtctatgaaatgcttgtgctacatcatttgaccagagaaaacgcaagtgctcttttactgaatatagccagagcaatgaacaatttagttttttcctctcagcatgaaccatcgtcttggtaatctccagtaaacagcacattgcctggcacgtagtgagcactcaataaatgttaggtgaatgaatgaacatttataaaatcataccatgtgctatccagagttgtgccaaatctcttgacaagaagtcatatttcagttccctttctcctaagtttcactcacacattcattcactcaccaaaaacttactactcacctgtaagtttttatagcatgtcacacacaccacctttatgatacttatcactgctgttttaattatttgtttgtaggtctatctctcccactaaagtgtcagcacttcaaagacagagaccatgtcttgacactttgttctctgatttaatcttcaataaagagctggaggataagaaaataatggttccaagaacttgcctacagtctcataatttaaaagtcgtagagccatgatttgaactgaggatggctcactccaaactatcttcttcccattttaacagactatagagaaaatgagagtgaaggcagagtgtggaatgagaagactgtgaattaagacaaaacaaagcagaacaaagaagttttagaagctaagtaagacccaatcagtgggttctattgcaccagcaccaaggaacagaaagcacaattcaagaaactgatatggacaactgcagagacctcagaaatagtctctagaaagtcaacgtatccaacatttatggaaaatcgaccacaaccatttggaccaatctaggtgaactttttgagggggaagaactgaatctcttttctgtttctttatctctaacttataatttgttggaagaatgaaagactgtatgacataaccctagtgaaagagatcccagtcctgtagagtgaccaacagataaaagaggtgagataaatcctattaataggcagcaaattgtcagactggagaattagccaaaacaaagcagacaagagattctgcagtaaatttatcctaattggaattttccaagtacaaaaaattgaaatgcttatcagggtcatgccatctcaatgtaatgataccctgaacaggctcttagtaagtacaatatgttaatattggttttatttgttgaagaccaaatggcagcgtaattaggaaaatgagttctggagctcacttcactgcttgacttcttagctcagctctgccatttcctagctacctgactttaggtaacttaataatgccagttgagagctatgcaaagcagaatagtacctaatacgatacacatgcttaacaaatgtttgctgttaattgtattgtcattttcaaaatgttatattaacatataaatttttaaagaatcatgggacttcttcaatgcgacattctaaaattactgaaagtgaaaatatatttttttaaatatttggataaatccagaaatctggaacattttcattaattcaaaattaatgaagtgaagccaaacaaatatggatgatgagggtaataatgatgataatagtaataattcttctaaaacataattgtatgtactatggtttgaatctttgtcccctccaaaactcatgttaaaacttaatcctggctgggctcagtggctcacgcctataatcctagcactttggcaggccaaggagggtggatcacctcaggtcaggagttggagaccagcctggccaacatggcgaaaccccgtctctactaaaaatacaaaaattagctgggagtgatggcgagtgtctgtagtcccagctactcgggaggcttaggcaggagaatcacttgaacctgggaggtggaggttgcagtgagtccagatcacgccagcctgggtgacaacagcaaaacgtctcaaaaaaaaaaaaaaaaaaaaaaaaaaccacgaaaaaaccaaaacttaatcccaaatataacagcattaaaagatagggaagacttttttttattttttattttttctgagacggagtttcactcagtcacccacgctggagtacagtggcgcaatctcggctcactgcaacctctgcctcctggattcaagcaattctcctgcctcctggattcaagcaattctcctgcctccgtctcccgagtagctgaaattacaggcattcaccaccacatctagctaattttttgtacttttagtggagacagggtttcaccaccttggccaggctgttctcgaaatcctgacctcaagagatccacccacctcggcctcccaaagtgctgggattacaggcgtgagccaccacacctggctggagggcttttaagaggtgtttggtcatgaagggttttgcccttatgaatggagtagcccattcatagattaatggattatcatgggagtggtttagttatcaagggaaggggtctgttataaaagttggtttgggccaggtgcggtggctcacgccagtaatcccagcactttgggaggccgaggcgggtggatcacctgaagtcaggagatcaagaccatcctggctaacacggtgaaaccccatctctactaaaaatacaaaaaattagccgggcgtggtgccgggcgcctgtagtcccagctacttgggaggctgaggcaggagaatggtgtgaacctggaaggtggagcttgcagtgagccgagatcgcgccactgcaccccagcctgggcgacagagcgagactccgtctcaaaaaaaaaaaagttggtttggctctcagttcagcccccttgccatgtgatgccctgggtcacctcgggactctgtaaagagtccccaccagcaaaaggccctcaccagatgtggctcctccaccttgggcttcccagcctccaggactataagaaatacatttcttggttgggtctggtgcctcatacctgtaattccagcactttgggaggctgaggtgggtagatcacctgaggtcaggagatcaacaccagcctggccaacatggtgaaaccctgtatatactaaaaatacaaaaaaatattggctgagtgtggtggcgagcacctgtagtcccagctacttgggaggctgaggtacgagaatcacatgaacccaggaggtggaggttgcagtgagcctagatcacagagccactgcaatctagcttgggtgacagattgagactttgtctcaaaggaaaaaaaaagaaaaagaaatacatttcttttcttggccaggtgcaatggctcatgtctgtaatcccagcgctttgggaggccaaagagggaggatctcctgagctcaggaattcgagaccagcctgggcaacatggtgaaattctgtctctatgaaaaaacacaaaaattagccaggggtggtggcacatgcctgcagtccctgctacttgggaggctgaggtgcaaggatctcttgaggcagggaggtcagggctgcagtgagccatgttcgtgccgctgcactctagcctagatgacaacgtgagaccctgtctcaaaaaaaaaaaaagaaatacatttcttttgtttataaattacccagtctcaggtattcaattatagcaacagcaagtggactaagtatgattatgtgtgcatgtctgcttaaaatggtatctttagatataccaataaataaatgtttttaattagaaaaaatgatgagaagcctgaaaatatacacattgaacatctcaaatttcaaaggagaagagcaaatcactcccataagatttcaaagtgacaggtaatcacaggcaagataaataacagttacagttcagtctaaatcagatttttttttcaagtatagatgctctctctcttccaccgcctttcccccccccccccccgcaaagccagacccaacctctgcattcaagtaggaaacctggaagtctcaaaggaatttttggtacactattgttcagaagcactttttggtacattaatgttcagaacctcctactgaactgtgtcagggaaagtggaagctgattagaaaataagagctaccggccaggcgcggtggctcacgcctgtaatcccagcactttgggaggctgaggtgggcagattacgaggtcaggagatcgagaccatcctggctaacacggtgaaaccccgtctctactaaaagatacaaaaaaattagccaggcatggtgctgggcgcctgtagtcccagctactcggaaggctgaggcagaagaattgcttgaacctgggaggtggaggttgcagtgagccaagattgcaccactgcacgccagcctggtgacagagcgagactccgtctcaaaaaaagaaaaaaaaaaaaaaaagaaaaaaaaagaaaataagagctacacattgactataataataataatgaaatagacatcccacacccacaaacctgccactgtatcactcttattgttttcaggacatttgcactgacactgggccaatttttgttttactataagaggttttaggatatgtctttaaaaatcatactgtgtacaagacaggttggttactatcagccacgatcactaacaaaacagttccccatcatcagtcctaccatctgtactcccagttctctccacacacgggcttggttgaacagattttgaactggccaaggtcactgcacagctagcctccacagatggggacagtgtgaaaaacctaattgcagctgtggataaacacaaacaaggacacacatggttggcaatacccctgtctagacttgatggtggctcagtgtcactaagcacaaaaaacaaggacatagtttcaaggtaactatctctcagcgctggtacaaatgctatcatcatgtggtctaaatgtctccgagatatttaagtatcaatttaagaaatggtaatagacaagcaatatttcctatcatacatacattctctcaaattctctagggaaaaaaatgcctttcttaaacaaaaagataaagcttgggaatcagcacagtgccataccccatgtgaatgtcacaagcattgcctgcacacaacacagaagatactgcattagggaaaaaatgaaatatcctctttccacatatttatttcatatgtatcaaaatttccttttcccactccctttccaaaacaaattacttggttagagactttactttgtttttgtttcaacaaaatttaattgggtacaccttctattctatacccctaagacactcatcaaaatagaatcacgctgaagatggtatcctagattttcccccttgaaatacatatggccctcagggaatgtggattgtcaatgtcttttctagacactcaacatgtctggtcactcaggtttaaagccaaattggttatgcattactttttgagaagttgttaaaacttaaaataagttatcaagtcagtgatatttcaaaagattgttgataaaaaagaacatataactgtaaccatactgaacagttgattatagaacgacatgtcagtgcacatatggcagtcggataaattatgcacatctggattacttttggcaagaaacatagctaagtgtctaaagccaagtttagcaatctgtcactaacaatatgtacatttattttaaaatgtcaagggctcaaagtcatattttctatttcttcataaactttccagctcttcgtaagacagcaaacaggtgacaaaacacattgcccaaactgccaaaggctgtataaataaggggtaattttgaacttctcaccacatatataagaggactcaaagtctgaaacaaactcatgtgttgtgggatgtactgacatataggtttcaagtgagattgttaccatttcacttcagaagttggttagaaaatgctttcatttaaagatatggctggcttacatggagtagtaaacaatataacactctggggaaagcaaatggaaatagtctagtggtgtctccttataaaaggaaaagaccagtgtctctgtgatcagctcagattaagtttccttttttccattgccaattactgacatcatttaagccccaaagaaatgttttcctacttctagtccccttgattaaaagaaaagccaagagacacgaaggtggctctcaaactagcagtaacaagaaactttacaatgggatgtatgggcagcagccaggtgggaatgtagcagtacctgtaagcacaaaactcctcttgactattatgctgcttcctagtttttctagcattccaagcttcttaacagcttcagtgggaatgccaagatatgtcatggagactgggtggggtcccgtcattccaggtgttgccttccagtctcatttgtgctggcagcagagaaaaaccagagtggaactattttatttacagagtgatagctgaatattcactctgtgtcagtctttcttctagctcacccatttggtaattttactgttgactagcatctttactatataccagatctggattataacatgttcaaatggtgtgggtggtgggaaatcctgtgtctctaaatcatacagattggtattcaaacaccaggtccactgcttacaaactgagcctcatctaaagaaggaggatgattatgaagcacctacttcacagtgtggctgtgagaactaaatgcctaaaacctacaatacatccaaaaatagtggctataatcatttctgttccttttctccttcttaaagtgacagactgggactaataaagtccacaaaccacagattgtcaataaaatgttgtaaatccaagagtaagctaataaacaactgagaagaaggaagaagaataaagaagataagatcctaagaggaaaagatatttaacttttaatttttatctgcttttctgcttttgtaaagtttgatgcataaagctattgaaatctatgtgagcttaagtgtctttccctgatgaaataaataaaagacaattgcctgtgttattaagaaaaggcacatgttttcagaactgtcagtttctattattcaagtcagagagattttactttaatagtattagaggcagagtgaaaaatacatctatttccttcttaattttgatattttctatttgactctgaagcttaatttttaagttatatcacattaaaaatgctcaaataaaagacacatataagaaggtaaaagagtaaaaagaattttaaattaaatgagtccatttgcccatatttcacttccccaggtctcagtggtagcaatcttcacacactattaatgttctttagtcttttactccttacactcctgaggaattttatatccccacaagacacaaaaactctagaaatataaattaagagaaacactcacagaaaaacccaaagcagatctgacagaatgattcttagtacagaatacaggaaaaaaaaaaaaaaaaaaagtcctggcctatcattatactgtattactttaaataagttaaagtctcctggcccaaagaagctattataagataatttataatttagatggttaaatgaatgttcatgatctttgccaagttcaggacaataaatatagggggttcttccaaccctaggaatctgttattgtcactagacaaacaaggtaggcttgagaaaactgatatactttccccaggtagacgtgaagcttcttcatattgaattacagaagtaaagttttagtgaatactactttacataatttttctatcacggtcatttaagattttattcacaaggcagccaaaggcgaaaagcaaaaacagaagctagaacaaaacagtctttgggttaataatatatattcctttttttttttgagataaggtctcactttgttccccaggctggagtcagtgccacgatcttggctcactgcaacctccacctcctccgcctcctgggttcaagtgattctcatgcctcagccttctgagtagctgggaccacaggtgtgcaccaccacacctggctaatttttgtatttttagtagagatggggttttggcatgttggccaggctggtctcgaactcctggcctcaggtaatctgcccaccttggcttcccaaagtgctgggattacaggtgtgggccactgcacccagtcatatagttcatgtggagttttaaaattgtagtaatttaatcttgtatttaagttatacccttaataagtaccatattaaatgtggtaaaatgaagagtacggactaggtaagaggataagatctagaattagaaagacctggatttatacactgactctgcagtttgtcttttaacccattatactaccttatatctattcataataaattatgtatctgaataagtgtgtgtgcatgtgtaaataatacatacacacgcaccacagagttggtacaacgattaaatgagtacccagcacaatgcttggcagacactcaatagcaaactaagaaatcaggataatataggccaggcgcggtggctcacggctgtaatcccagcgctttgggaggccaaggcgggtggatcacgaggtcaggagatcgagaccatcctggctaatacagtgaaaccccatctctactaaaaacatgaaaaaaaaaattagctgtgcatggtggcaggcgcctgtagttccaggtattcgggaggctgaggcaggagaatggcgtgaacccaggaggcggagcttgcagtgagctgagatcgcgccactgcactccagcctgggcgacagagcgagactccgtctcaagaaaaaaaaaaagaaaaagaaaaaaaaagagaaatcaggatagtatagcagtaatttgatgaaaaattatggattcatatcataatatacgtcaatattaaatcctttctgataaactatttgaaatagtgacaaagaacatatacaaactctttgagaaagtattcttcactgcagaattaaatcacaagtaagaatcctgtaaaaaaatcaccttctcaaggccaaaacttacatttttagctgacatctcgttacaatggtactacgttctaatagattgtggaggtatataattacaacacttaaaagatgaaactaaatgaaaaataaaattcatagtgttaatagagtccaatgtaggagtgcttttttttttaatcccccaaactatgtagaaaacatccatggaggaagacatcagcgttaattcctaaaaaggctcctgtgctcatcaagaggcctccaaccactggaccactgcagttgccacataatctgtctgaagcaaattcttcctcttagcagttgctgaaggagtggtgacttcttattagcttcccttatgagaacatcttctatgctacgcaggatgtttcaagtaaccccaaagatgtttagttgtgcttcatcatcataaatgaagacttaacagggagaaattaagagtaccgttaaatttttcttatgcctgttaacatattgtcattcatttactcaagttcttcaaactctgacctccttttggctggaatgcaacaggatgaaggatgatatcttctcaaactgtgatgtttatttaaggatatctactactcaaagaaagaaaatgaatgtggtaggaatatcatgaaaataacacggaaaacatggctccagagaagcaacgtaaaaagtgtcttaccaggcccaagtagaaaatcaccctctttagacagttcattaaacttttcagagattaatcactagagagattatagcagtggctatgaaatttatggaagcattcccccagaaaaatgaacgcagacactgagccataaatgtaaagaactcaaaaggaagcaatctaccttccaaacaagtgttgaaaaggtctgaaggaatttggttgtctatgtcagccattatacggggaaacatgatgctcactgttctaaggggaaaaatgttcaaacatgtatactaaatgttgccctggggttctcattacttaattaacatgcacacataaaatctggagtgtgtacaacaacagctagccttaataataggtaagtcgcgtcagtctctttttctaatattctattttaagttgtgaaccttaatccaggtaagctgtctgtcatttggcaaagatgtgaggttttctcaggaaagggtaggtatgtaaggcagctctaacatgacctgatttttaactacctttcaagggatattttacaatgtttttgtgaacactctggtggattctgggaccttaagacgccattcctttggaaatatgtaattaataaagcgttatgggaaagatgtgtgatgacaatgtctttcttgagttatgctaatttgattacaataaatttaagtaaattctaaagtaattatttctttcaaataacagcatttccagtatttaaaggaactgtccccacaagagtcttctgaattgaatttaatttgtctattacttataatatgctcttaagtttaacaaaaagcaagcacaatgagttattcctaacacccaaattgatggggttttctcattactgaatctcatctgctcctaagtatgcttacattgtaatcaactgaaaaccctcagaatagcttttgcttaggatatacgttgtgcttactccacaggctggtctgaataaaagcaaagtgtagaacccaggacaagtcagacagtagcagtaccacactctctgtatataattcattgtccaacaccatatgagtgaagaaacaacacgaacgaccacacacaaaaccttcaagtcactaaatgatacacacaggaagctcagtaactccttcggggtaaattttattttaaatttctatttagacacatatgagaaggcatactagtactccacacattagttttaaaagcattggcccatggcaaatattcaaccctgactctatccttacttcatgggatggcataagacaggagtatcctccaaaatttctgacctccctaacattaatagctaaaatgactattctcgctaaagtaacattgactgaacatttcctaaacaaaacaattatgagcatcattctcaactaccaaaaacatcttaatagatgcaaaatattaaatcataaataaaaataatcacatataagctaactcactatcctactaaaccttgatagcataaaaatcagcttaaaataatcattaaattttattacaattaagtgctattataaataacatgcttgttttagtagtaaagtatcgcttaactaaagtgataaaagggggaaataattatttaaatgaattactatcaataccttatttaattcaaaagaattcagtggtttgtgcatttcactaaaacatcagatttaatttactgttatttttaaaaagtaaacgatatttacagattaatagcaagtatttaaaattttacaattttaaattacaatttatataaaaataaatgatcagaataaagtcagatgctggaatagtcatacatgtattaattcctatattataccattatttttagttcctgaaaataagttggctttttgtcatctcatccctttgctatgatttcgctggataattatgcactgaagttcattactcaaagcatccagttgttgaacagaatcaaaatcacccaacccaataaccacagagtaaagaattgaaagaaaattggatataaccatggatcttaacagaaacaagtaacaagcaaatagggcccaatattaagtgctaatgcaaaattccattgccttcttttcacttgcaaacctacacaatgtcaacattttctgaaactgattttgaataatccctcttattttcaagtataggaaaattaagatatattgatgagaaaaaaaattctatcatttccctttctaaatgctattttcaaatgaacaagatagatagatacctgtagaaaattgggcagtgagtacaggcagtgatgtaaactgtattagaacaccaaaaattcaaaataaaaacaaatttaaagatgcatattaaggccaggcatggtggctcacgcctgtaatcccagcactttgggaagctgaggtgtgcaaatcaccagcggtcaggagttccagaccagcctggccaacatggtgaaaccccatctctactaaaaatacaaaaaatagccaggcctggtggcacatgcctgtaataccagccactcaggaggctggggccagagaatcacttgaacccgggaggcggaggttgcagtgagctgagatcatgccattgcactccagcctcggtgacaagagtgagactccgtcacacacacacacacacacacacacacacacacacacacacacacacacagacacagatgtatattaatttaatcatttagtcctttaggaaatgaccttctatgaatgctatgagcactttctatgaacaaggccctatattaggtatatgtgaatcaccatgtacttccaaggaagtgtaatcactttcaataaaacacaggacataggaattctaaagttgaaacagctttgggtattctgttagataggaatacttttgaagactaacaatttttaaatattgcactagagagaggtgaagagttgaaaggattagagacagaaacaaaagacatcgctgctacgcacataattcattcagtgctgctggttacaaatgatatggtattcaagttactttttcaagcttttcatttttatgcataatttcttcaaagatgcctttggggatggacaatttcagccagtaaattattttttacataagcatttaggtatggctataaaatcatttttgcttgtatcatgttctcatcatccccaagaaaaaccccatcgtccccaagaagaaaaaggcctaacgttttgtgtttttagattttaacttcatctgaaataataatagaaacatgttaaaaccaactatttgagcgttaataaatttctaataatattcatattcaaagtagttcaaaattcataaaatataaatatcaaacagggagtacaaaaaaaccctgagatgtctattcatcacagcaaattcagctgagtgctctgaaactccccctgtcctttaaatgtcacaacagaggagtgaggacaattctcttcattcatcagaagaagatggggacctgaacgttttctaaatttcaagtctataagcatcttagttttccaggaagtccacgatcaagacgccaaatggtcagtttctggtgagacctctcctggcatgcagatggccacttcctagctgtgtcttcacgtagggaaaaagagagctctttcactccttcttcctcttaaggccatcaaccctatcaaatgaggatcttacccttatgacctcatttagccttaatttacttcctaaaaaccctatctccaaatatagtcatgttgggtgttaggacttcaacatatgaactgggggaagggcacaagttggtccataacttaaatcaaaaattatgtcctatgtcattcatgaaagtatgcgttatataaaggatttttgtgtcaagttattggttattgtgtgatgcccatttagccttagtttgaaaacttttaacaaagcagttaaaagtattcaatctatttgtttgaaataactccttccatgggtactctactaatgatggaattgtatcataagcatattaaacttgagaaagaaagaactgaaacagtcccttaccaccgctccatctgaatttatgttctgaagatggaagacatgaatcctggtatgtttaggctttgtgtccccacccaagtcttatcttgaattgtaatccccataatccccacatgtcaagggagagaccaggtgcagttaactagatcatgaaggtggtttcccccatgctcttctggtaatagtgagttcccatgagatctgatggtattataaattgcttttccccctttgttcagcacttccccttcctgctgccttgtgaagaaggtgccttgcttcctcttcgccttctgccataaatgtaagtttcctgaggcctccccaactatgctgcactgtgagtcaattaaacctctttcctttataaattacccagtcttaggcagttctttatagcagtatgaaaacaggctaggtatggtggctcatgcctgtaatcccagcactttggtaggtcaaggtgggcagaccacttgaaatcaggagtttgagaccagtctggccaacatagcgaaaccccgtctctactaaaaatacaaaattagccgggagtgatggcgggcacctgtaatcccagctactcgggaggctaaggcacgagaactgcttgaacccaggaggcggaggttgtagtgagccaagactgagccactgcattccagcctgggtaacaaaaaaaaaagaaaggaaggaaggaaagaaggaaaggagggagggagacaaatacaaatccccctaatgggtctcagttctctggggcttctcatgatgagaacacttccactacagtgtgtgattctagtatttaaaaacgagtattctttttcatcctgacccttgaatgcaaatcaaatactacatcttgtgcataacaggagaaataggagaatgctccactgttggaaagaaaactacagcatgaaagttctaaaatattttcaaagggaattttaactttttatgatttttctccttataggttgacttttttttaaccaccataatattcgctgtggttttagaagttttaccctttcaaaaactacatatacatacgtgtgtgtatagacagatactcacatttggaaggaaaaaatcctggtaacattttaaattatcatcatgaaaaagtatctcttgtgactgcaagttgaatatgttctatcttccagagatacactaaagacacataatctaatcaactcctaccaagataaaataggaagaagccctcacaccagccccttggctctcctttttttctgtgtttttctcctctttgtttctgagtgtatattgctcttgcacctttaatgctcagaaggaagatgaagcttcagctaaggccttactttttccttctcaagcctcatatttagaggggggaaaattagatgcaaaatcaccttttgattatatgcaaatttgtcaaatttttccattaaatggtatattaaggaaatagaggctgctgaagaattgggcatagtaaaagacctagatttgaactaattttatcattttatttctgactctggaggagtggctacctttgttgaaaatatgggaaaaatgaaaagacagatgaggcctacgaatcttcatattttagagtaaaaataagggaaacagaaagaaaaatatgtaagcaaatgtggtatgtttaaaggttaggatttcacacaatgcatttatttttctcactagttatgtttgacaatggggcttaatttaccaaggaagaaataaccatgacgtctttctactgtctagagaacaaatcaaagaattgtatttcatgagcagtgccttccaattaaaaaagaagaataaaggaaagagaaaagctcatatattctgttgagtgtgtagcaaatacatagtaccactgtggctatttaaacaattgaggctaatggaactaaggagaacttctaatgcaactgaaattgatgcaatggtacactttaatttttaagtgtttctcttaaatattctatgcaatagggattgagtgctcatttgattaacttattgcagggatggttgcgcaagaattaaatgtgctttggctggacattgacaatgaaatgaatctgaatatacttaaatgtgatatatactgttgctttgggtcaaaagttttttcatgagaaaatatcaccaattaactaaaatcaaagagaaaatgtcattttctcctcatttaggttcttttaggaatacattaactatattatcagtgcagcacctgtctttattaataatagatgtaaatgttggttctctgagctgtcaaacttacaactcaaacttcctaaagtaaatcgataactataatacatgactataataatgtagaactgtgagttctgcaaaatatctaataagttttgagtaccatttaatctgggagtttttgtttcaaaggacaacaatacctcagaaaaggtttatcactgatgagttgttcattattcaatgaagatttatcatacatatgctaaaattaaatggagtagggagggggctggagaattaatcatacagaaaagaagatgactgaatgatctatatgggggtagtaatccccacactgccagcgtttattccatagccagggtgccatgggaaccaaggggctgagtcgcccagtctttgggaggagtctcatctcagaggaaaccaggaagtcttccaggaggaccactggacattagccaggctaggggtgaagggcaggggcactgcaggccgttggagtgctcttgtacaattagccttagccagtgggcttggcactctcagcctgtgtaaccaaacccagaaggggtctagaaggcctttcaggacaccgtatgcttcagaataggagcggattctcagtccacagatggttcctgatagagtggctgggtggggtaagactattcttgggctcatctagtcttagagatctggagactcccagaggggtggaggagtaggatacttttggggccactacagtggtactgactcttcaaaaaaaaaaaaaagagagactgtaacttaaagtgatctaaatttattcatttttaagggaaaaagcacaacagaaagaacaatcactctgtctaccctttctcctcaacgctgcccctcgacatctccctgggagaagctgtaagactgccattgtttttgtacgacccccagatgcacaaagttgtggggagccttcacattgccatctcccctccagagccagatttgtctgtggcattagtgcactgaaagctgaggggtagggttgggtattctctggaggacaaagtgctaatgttcagtaattctgcaaacatatgaagacaacattgcctacctgccaagggtgtggcaccatgttctggcgaaaaaaactgcaactgatttcactcatccaagcaaattcttagggtgtaatgggagttgaaaaacatcatcttggaacctactaaagggacaaacatgatatgaaaatgattgggcgggagaggccatatttatgaatccttagtgaggctgttttatggttcagatattatggctttggctaatgtctgagtatatgtatacacagattttaataaaaacaaccgtgaaatttgagaatccacttcactgaaattatagaacaaatatatcttggatactacattttgcgtaaggctgcagtcattccctttaggtgaactgaaatgacactgctaccatgtcttttctgtacagaacagggaaacaatgacaataagaataaatgaattgtttaaccctgtgagcttcagaatgcttagcaaactactgtgaatcaaaagatactacagaacaatctttggctttacttgacagtatttaacaggtcttataagtctatttattttatttattagtcctttattttactcccaatgacctcatttccttctcctttgctatagtttacagcaaagcaatttgaaatagcaaatcaaaatattatccgaggacaaaatgtaataaatgcagaaattgagaataagtttttttagaaatttttgttgcagtgtgacatagctgtgactcccaaatatataatcagtggcttcatgtcactgaacgtacagactaaaattgccagttggtgatgaattagggaggaaacatgggtatttccccacaaatatttttattagtattggtttaaaacatctggcaattgtacataaaatatttttaaattcccttcagctatcaatatataaattattgcaaaatttattaggctaacactttctaacttgtactcttagatacagaataaagatattcttggtatctggaacactgtagttgcttccattgtctttggcaggttttcactaggagaatggtcagcgccataggtggtaaccacggcttagaagaaaagagaagaggtggatgggtcccaggagaggcagactgaaatacctatattctctcctaagcgtcccatggctccaggcaccacacatgagcttttttttttttttagatggcgtttcactctttttgcccaggctggagtgcaatggtgctatctaggctcaccgcaacctccctctcctgggttcaagcaattctcctgcctcagcctcctgagtagctgagattacaggcatgcgccaccacgcctggctaattttgtatttttagtagagacggggtttctccatgttggtcagagtggtctcgacctcccgacctcaggtgatccgcccgcctcggccttccaaagtgctgggattacagccatgagccaccgtacttggcctctacacataagctttagcatctggatacttcagctaatctgggacaggtccaatgaatatttccacagtttatcactttggaagttataggcttttttcaaaatcccctttaattgcttattagttctatagctctataaaggcaaatagcctcatcctgctcataggaactttagggaagtgctttacaatctccagccttcaagacattgagacaatgaaaaggcctttttttttttttaagtatatgtgtttcgcagtagcttaaatagacatttaccagatgtaaattttatcaggctttgtgttgaagagatttcttcaagtggtgattgttgactctaactgtaatgtattttatgatctctccagatagaataggagggaaaaatgagaatattaacccttcctctacctgctattagttaatcctaacaaatactctatgaaacatacatgctatagccaaaaaatacacactggtccgctatactagaagcaaaagaaatcagaatgggttaaaaaaaacaaggcaactagcctaatgatacgtacaatgaatttggccttcatttttctaggctctgggtttgcttttcacaaaaactggaatcaagttcctctaggcggttgacttaatgatttgaaaacagtagtataaacaaaacatgaagccacatgggagagacgaggaatttatatatgcaaagtcaacacatactttatggctaaataattttcatggttttaataatttaaaaaatgttcaaagctgaattaatagatgattttcatgttaaacctgggtaagcagaagtaaggtgtttaagaactcagagtcactgggcgtggtggctcacgcctgtaatcgcagcactttgagaggtcaaggtgggcggatcacgaggtcaggggatcaagaccatcctggctaacacagtgaaaccccgtcgctactaaaaaattagccaggcgtggtggcaggtgcctgtagtcccagctactcgggaggctcaggcatgagaatggtgtgaatccgggaggcggagcttgcagtgaactgagatcaagccactgcactccagcctgggcgacagagcgaggctccatctcaaaaaaaaaagagagaactcagagtcatataacctatacatggtactgccgagatcttgggctgcagctcctggtttctatactaagccatgttattatgctactttagcaatttctagccctagatctccttaataacaaaaatcaaaagcatgtcatggttagattctttgaattctgccactttcaggaagtagcacctctggtttggatagctaaaaggaatagcagaggtattaagccacaactgcacttaccacaaatattccactcttttaaaatataaacatgtgactgttaaaatataaacatgtgactcgtttccattggcattcaccgctttcacaaagacaatggaagaagccagtaacactgctacatctacaggaaacaaaaatgaaactaaatggctccaaatatatatatatatttgagtctcttaagttcaagtgattctcctgcctcaacctcctgagtagctaggattacagtcacatgacaccatgcccgactaatttttgtatttttagtagagatgaggcttcaccatgttggccagactggtcttgaactcctgacctcaagtgatctgcctgccttggcctcgcaaagtgctgggattataggcgtgagccactgtgcccagtcggctccaaatattaataagcataaccagggtactgtattttggatattagctgattgattgtacagttacaaaaatatgatgcatcctaggaactatccattgaaattttcctgttaagatagcaagatatactgccaactagcatgactgtttccagaaagcatatgggaaggtgataaagaaggggcaaataatagagcaaaacacaaaaagaccaagagaaaaaaacaattaattctacaattggggaattgtcaggacaaagatatgtataaattaagataaaggaatgtgaagtatgcagtgctgactgaagaggtcatatggggttgtcaaaactgggctatacgtatgtgactgaaatggcagaaaatgtgaagtaaacgagtaaaagaaaacctgcaagactaaattaaacagaacaaagacacatagtatgtacacatagtactttaaaacaaaactgtaaaaaaaaatcatctatttggccattgaaaacaagcattttcccatccttgcccactgttagcatgaaaatgatttactcagcttggtcagaggtagattaacctgatgaaacaaccaaggcaaaacccattctcaatgtgaaaagtaatgaggattttcctcagtttgtgtccaaggacaacactaggcagcacagccctagtgaagcataaactcctagcagacagaaagcttcctgagggcagctataatttgttgtttacatggaggcctagcagagtccttttcatactgtaagtgttctatgaatgtttattaaattaaattctacttaagtagctctcttttctaattagccttggcaatcaagtagtttattaaaataaaaaagtccaagtattttggaagtgaattttgtagcagcaaattcaggatgggaccaatgacctacaaattgagctgcagcaaaatattggctgggaacaaagtagatcctaaaggtggttttgtcagacaaagtgcaacaaatctcactgaagaacaacagtcatatggagtgttgtcgcatatgaatgattacttgaaatcagtgttagaatctcaaaaagaagtaacttggtaatgcaaagtaatgctattcaaagtgctgtaaaaagataaacaggtattctagtctcagctccagcaccccccgcctcaggaagctggctcagcccactgcagtccataacggtttttgccaactgaactcaaagccccattaatgcagaaaataattacaatctacccttgtggcatctattaacttttctttaatcatgttttgtctctccaattagactgtacgttaattaagggtaaagagtttcagacatttcttctgtagccatcacatctaatactatacaagggtgatttaatattagataataaatttaggtaatttacaacattaatagttactattaataggaaaaaaatcacataatcctccccataattatggaaaagcatttgataaacttcctcatccattcataataaaattcacttcacaatagaaaaggatatcttttataaaaaagttttttacctactacgagattaaaggcatttatctatttaaataagtaaatatcccacagaaaacatcacacttaaaggaaaaatgttgaaagcactccttttgtaagccagaggaagtcaggaacactttctgtcaccaatcctattcaaaattgtccaggagataccagtcaatgtaggtagacaagaaaaagtaatcaaaataagacatgaaaaggatgaaagaaattttcatctgctaatgaatttaatatgtgcaggcatgtattaatattatattcaaatgaatcaaaaggattaaaagtctaggttttctggctacaaaaaccaacatacgaatgtatatttcttgtattttatagcaacaattagaaaatgtcactttatgcacaaagatttgcaaaattttaaaacccagataataccatatactgataaggatataaacaaatggaaattcttatctactctgggaaacttcttggtagtacctaataaggttggatatgcatataccctataactctttctattcttaggtacataccattgagaaatggttgtacatatacaaatgttacattcattaacattcacagcatcagtgtttgtaatgtccaaataatgaaaccaacccaaatgtccatcaacagtagaatgaataaatcaattgtgatacactcaatatgatggaatattacacagcaataaagacgaataaaccatagcctcagagatgagtatggatgaatctcaaaataataatgaacaaaaatagaagaccacagaagaatgcatttagcatgattcccaatttatataaagttaaaaatataagatggctattacatatattatttggagatgtatatatgggtggcagaagtattgaaaagcaaaaaaaaagaaacaggcaacacaaaattcaaggcagtggttacttctaggtgggaggtagaggatgcatgaaaatgaggggctcagagaataatacagcacagggagttttctatttctatttcttaatgtgggtagtggagacattgccatttgctctaatactactctttaaactacatacacatgttccatacattatacattttttatatatcacagaaaaggaagaaggaagaaaggaaagaaagggaaagaaggaaaggaggagggagagaggaggataggaaaaggaaagataaaaaaggataattataaaatccttggaatgctaaggaaaagaagcttgccatgggactctcttttaaatgaaagtacacatacttctacaaacactacttagcaagaaatatgcacaacacaaccacaaggggctataacaagacatcacgcttagggctgagattagactcctttcactaaaattgatgagtcatttgtcacaatacagatgttttatggctgaaaggaatgactgaaaacactggtattttcttatgtaaaaaacaagagtttctccagattaaatttcctctaaaatttttaagtactaggttgaaaaccagaggaatctactttcacttttcttcaattatttgcaataaaacaagaatatatatcagaccatggggaaaatctttttcttccacactttggaaatctaaaaggtactacttttatgtactaccatctaccataattagatttaatctaaattgtgctattgagaggcgagaaacgcaattaaagtgtcaacactcccaagaccagccaaacaaccttttggcaaatgctaatataaatgttttcataacctatgttttttaaggtcactattcaaattccatagttatacatatctctgttttcagagactttatttctcaggttttgaagggctggagaatgttactcaaacataaggtcggtaaagaaattttagcttagaagtctcctataatgctacagagctgtagtctgtagcagtcctacagggcactgctcatatgcagtaagcaaaggtggggcatggggaggaggaagaaaacagatccagagactgtctgcagagcatctgttccagcaacccagttgtgggccttctcctggaccagtaaaactccatctggtatgggaagctaactgttccccaggtggtgtgcccacctgtcaactgacagtcgggcttgtgccactaagaacaagggcagacacattttggcacagacctttggagcatttctttaacttaatggctgagcaagacttgagatgaagagatgaggaaacacagaaaaaaaaaaaatgcaatgggccctgctggtcccaggcatcagctagggaatctaggtcacgcctacaacaggcgtctgatggggtataccatagagggcggagagtggcagggaatggtgccagcctctgcctttctgggcttgccagcccttggcagggattctggaaaatgagacatcccaagtcaaatgcatttccgcacattcctctccctctcctgcctctagctacttacatgtggttaatagactgctcaaattgaaaacacacacacacacacacacacacaccaccaccaccaccaccatcaccaggatatggaatctatacacgttcgttccggaatgtttaggttgaaaatacacgtacaaatatagtctcctggtgaagctctgtgctatgtatttattccaagtgatgtccacaatctttttggaattcttctggcatctggctttagaatccttggcatattcttgtcaataccctcaggtgatgaaagatgttttattctaaagagtacattttatttaccaggcttatggaattagatgctccatcaatccatattgaatataagaataaatggatgggtgaaacaagcacatacctatagttcttagacaaattcctaatgaaatgaatgaccaagcatggaatgtacaattttttaattttaaaaaagcaaacaaaaaataaaaaatagagattttcttgtatggctcatatggtagaacccagaagaccatttcagtggaacaaaggagaccactgaaataaccagagaaccactcaaggtgatcctggatataggggctattaaccttttaatctttgcattattccttaaagcgtttagatccatttgctccttgtcttctcctatcctctagtcctgaaatcaccagggcaccaagcctcgagaggctgctctctcccttactgggctgggtttctaagatatctctgaccagatctcagagataactccaatccagaggatctttaggcggatctttattctgccaaatcctacactgatactaattttcaaacttagatgtattttaaataggaaaagaagacccaaattatatcattttaacttaccttattttttcctgtaaaacaatatatcataaattttaaaagtctctgtgcttagaagaaggtggcattcatacatttctggggtgtcttttaaagagccttattggtccatagttacatcccatacacatatatattataggcacatttacatgcagacatataaaggaagtattcataaaggatgagtgatgaacaaacacaaagccatgctttgatgttaaagatgcagtgcttcactgttgagaaggatgtgtaattgaattcttggtaatcactgagaatggtgtctattgttgaatgtagagtgctcacagaagtcttgcctagggagtttgctctgttctaaggtgaattctccatagctcaactcaaacatgaaaggtgtcctggcattgagccaaatgcctaggccagggtgttctctggatcctgctggggtcactgaaagaccaaagaaagcaccccaaacctggcctgacatgaaccgagaaaacttgggcagcatttggccccagggtaaggatgtgacagagcctgctcattctccctgcactcactttggcacacattcagcaatgctctatttgattgctacctttccctaataaagagctaggcttttagtggatgttctgattctcataatgcaaagacagaaggtatgtgtgaaagtctccagtaacactatgcttcctgcacatagtctacccattaaatgactgacttggatttcttgcaaagattgaatgctggaggtaatttaataatttaagtataatataaacatttaaagttaaaaaaaaaaaaaagaaaaaagactgatctgggttattaaactttttaaatatgaaagtgatttctgaaaaatgtgcaaaaatgacttttactcttttcttacttaaataccattatcatacaatattcaagtgattttgctattggtgggaagtttagaatgcatcctgatgaatatcaaggatctgctataaaaacagattctcttaaatataatttatgtgcatgcaacacacacagtgtttaaaatccacattcttaagtgcagatgtgttttcagtgtggtctcagagtgaaggtttctatacagggtttagtctgagaaacaactcgggaaacagatgaaaggcatttcagatgattaccctagagacacagtggttctcaagacttgaggcatataggccatcctgggctagtagacaaatttttgacatttaccacctgcttagcaaatgtcataccagttcattttgatactcaccaaatttgtgacttcctagaccagaccacgtagagtctcatatggcttttatttggattgccttaaaaattgccatattttcccaatacctaatagtacttcaatttcttaaaatacagaggaaaaaaagaataattttgctaattaaatcctgtcagaagtacatgaattctgttttaaaacaacaatattaaagatttttgattaggaataaaacatggaaattcccaactaagatataacatagcacaaaaaaaaaaaaccagtaatgatatagagactacacaaaggtaaaataacagcaacaaaaaaggcactggggtatataattcatatatgtattttaagtaactattaccattttctcttaaatgccctaataaaataaagcattttaagatatgctataataccttaataataattcattaccattatctacatgattcattttacctacctctaaaagagaattactatcactttgctataaagcaaacagttctgaaaactacccacttggaatgctgtacagtgaccaggcctgggtctgtattgctcactactctacatccaggacacaatgcactgtttgtcccatcataagcactgaataaatttgttcatctgacaagtatttatgagcatctactatgtttaaggagctgttctaggcacctatatatacatcaataatcaaaacaaagatacctgcccaatggatattgccgacttgctaaaagttagatcagcagccttctttgaatatcaactacttctgacatagagatgtggcacaactatatgaatgaaagaagaaaacagtgtgaaatcaagactcgaaattcttttgagaactaagatatattttctaatgcctctgtccttcagtgggcctgcagtgggcttgcataggacagggaaaaggatttaggaattcactgccactttgaggtcatatgagttgatctaaaatctcagttcatctttcctccatcatatgttacctgggtcacagagggcatgaatttaataagaggtattaaaaaaaggaactactatctaatgacaaggccgccttttaaactctgtaatagttgtttcctgtttatgcataggaagatgtatatttagaaaatttatagttctttttagaatggctaacaattaccagaatatgacacgttttatagccccgtgccttttcttaaactcttccctttgtccccaaagacccttttctactgtccttttcccttctcatctcttgtttgttaaactgatgaatgaaaaaacacgtgaatgaatggaggttgagagctgctaaaggctggttacaaccaggaaagcttagggaggaagctggatgtttacagaaatggctttaggtgtcattagttctgtaatgtagtcctgtgttgtttctgaaaacaaagatagacaggacagtaagttaagcccaaatcagcaggctttctccccccaagtactagaatacaatagccactctgtctcacaaatatataaaaacacacttggcttagtttcttcaatatattactctcatttcaattgagctcatttgtaaaaagggcccatctgcaaaatggcaactggggcctgtccaagtagcaaaaaacataaaaaaaacatccaaagagaaaaaaacttgaatcaagacttcaaagttaaaaaaaaaaaattagattacattttaaaaatcaaataataaaatgtttttgttatttttaaaaaaatttaatgacaggagattgttgtggtagaatgaaagagcatatcacacaaagtccaaagagtcaggtttaggtcagtattagaagttggatcttgcataatttattacttcatttttgtggaccttaagtctttcatttataaaatggataaggagataataccacatttcccagaacaatcaggagaagtgcctgatacaatgtatgtgaaacatacttaccactgttcatgttagttcatattaatttcagttcctcctctgcactccttagtactctttacatatttccagtggcttttaccataatatattgtgattatctgttatatgtaggttattaatctttgtacctgtcattctgttattcatttttgtacctccttacacaatggtggcacacaataagtgtgcaaaaaatattgtttgaagagaatgaacacaagttgttttgttaaatgagcaatgacatttcatttcatttcattttttattttttagaaaccaagtcttgtcccgtcacccaggctggagtgcagtggtgccatcttggctcactgcaaccaactcctgggttcaagtgattttcctgcctcagcctcctgagtagctggaattacaggcacccgccaccacacccagctaatttttgtatttttagtagagatggggtttcaccatgttggccaggttggtctcaaactcctgacctcaagtgattcatccaccttggcctcccatgtgctgggattacaggtgtgagccaccgtgcccggcctaataatgacattttaaaaacacagaagtatgcttaaaattctaaaccaaggtatttctcatctttgaaaaagttgcttttgccaatttgtagataggcaggcctatctacaaacaggacagttttctacagctaagtcttcacatactggttactatgtaaggcttaaatttggtctatttaatgttgaacaaaattctttatcctgttgaacaaaattattcttaacacagccagagtacctgaatcaagactatgggagtagccagtccatctcctgggcacccttactgcacaaagaaaacaagttacatatattttatagctctaaggcaacaactacccatggagtaacttatgtctaacacaggccgggcacagtggctcatgaggtcaagagatcaagaccatcctggccaacatggtgaaacctcgtctgtactaaaaatagaaaacaattaactgggtttgatggcacacacctgtagtcccagctactcgggaggctgaggcaggagaatcgcttgaagctgggaggcggaggctgcagtgagctgagatcacatcactgcactacagcctggtgacagagtgagactccatctcaaaaaacaaacaaacaaacaaaaaacttatgtctgccacaaccagccaataacactgccatttgtttaggcttccatttttacttcaaacacaaagttttagattctctctctatcttaactaaaatcaagaagctggcactaccaaatgttatttaattctatagtgagatggcttttaattggctagtcttacaaaaatggtagtcaaatacaagcataattgtgatcaataactgtaaaatagtttgtagtatataaattccaaaattcttttgaatatgaagaaaattttacattcaagtagatcacttttaggttcctataataacatttaagcttggtaacatgctaccagaacttggttattttttggtaagccatctttttcatctaaaaggagtaaaagaagaataagatgtaaaatatactcatttaagcttaaggtggaggaaggaagaactttaaaacctaatttggtttgaccaattaacgttctgattgtactctacagggagagcacacaaagtgtatacatgcacacacagacatcagtgctgatgtgcagggacaaatttaagagctacctcccattatgaggacataaattcacaaacacactcctacagcatttccaaatggaaagcatgggcatctcattaggggtcgaacatagggcataaaaaagtacaacgaccttgctgggtttggcttctctttcacatctaagttccttgtaaaacaggccaaccatgagaggatgtttaaaacctgtagcattaaaaaagaatctagggtcatataattatttcataaatatctgtaagactgaggaaagttggatgctcctctgtttcctgcaattcaaaggtaagtgaaaaccaactttggaattaatagctttcagagatctgaaagcgttctaataccaggattttcaatgctgcaatttaacgacaaccctgctgttggccttttctgacctgttgtgaagtaaatcaggcaaactaatgtgggctaacaagtctttttcacaccgttcgatccccctgcttctcttttctccgcagacatcgcctttctcccactttctgtctagccatcctccgtcaaagcacacaaaatggccactgtaaccctgcatcactgctcattagatcacaggttagtcaagtggaactgcccggggttcccaaaggagagctatacttcaaaaatctgtccatgtcaaatgaagaaaaaaaccctgagcgtggggtcacccagatcaatgatcaaaagaaactgagaatgaagggggaaaaaagcacaccctcgtttttgttaaaaacacacaggtctgatttattataaggaatacagagatacgatggggtttcctcctcttctgccctgttttcattttttaactaagtaatttgttttaatcaggtcctgttggttgttaaacttcagactttggaaagtctacaactaatccttaaaatttcccccaaagaaaacccattctaggaaatccagttttaaggaggactcctaaatgtttccaaaaacacttgaaaagcaataaaagtaatacaaagtaatccatctttaatgcttgagaagattctatttaaatctgagagtaagagttggtgcgacatacactttaatatgctttaaaataatccgagtaacctcttgagccttcaaagaggggaaacaacaatctgtcaatcacgttaggagcacacacaagtgacatactataaaaaggcagatttctggattttggtgaggctgcaaagatatgcaggtaggcctataccttgtttaatcatctccctcatttcttctatgctattcaaagtacaacattctatatttgcatttgtactttttgaaaaaataacactactaatataacagtaccgcaaacttgacatattaaaaatgagggcagaatgatatatctggaacatcttaaagaacaagacttggtatcaaatttcacaagtgaaaatcaccaaaagatttggttttcctggtttcctcataactagagagaaaagtacattttatcggctaatgattaaaaaaaaatttctgcccgcaataccacatatatgaatgaaagtaaaataagttaactgcttataatttaacctagcaaaagttgtaagggttgtgtaagggctttatagctttgcagtattttcttttttacatttggaatttattctttaagtaccctcaaaggaatataaatatattcctttgtgactaaattaaatattttttgtttgacttttgtgtatttaaaaagcactcccatgacacttactctataccagacactgatataattgccttatggaacattaactcattcaaccctcaaaacaaccctgtcaggaggagggggaagaaagcagggagcaactgttaataatgagtaagactctctatgtgctatgccctcctttaatcctcaccattcactacaaggtaggttctagaattagccccattttacagatgagaaaacagacttttaagtttttgcccaatataatttagatggtcaacagtgagaaggatttaaatccaaaagttctgacttcccagtcttactgtttgtcatctccaaaccaaagtgccaagttaaatattcatcaagttaaacctgggtatatcctgtgacccccccgtaactgcaattttacatgtattcacttgagaaatgcttgcatatacaaggagacatgtacaaagatatttatcaacagctctgtttataatcacaaaaaatctagaaagaacttaaatataaagaaaacaccagaacattttttaaaaagctgtaaggcatcacatataaatttttatcacacaaaccattatcatatattatttagagacacatgtatatgtagtcaaagcatagaaatgtacactgggaaagatacacaccaactttaagatatttcttgcttctgaaggagaaaggatgggaaaatgatgaggaagggaaaggaaggggctttaaatgcagctttcatgatttgtttcattaaagaaaagatctgaaacaaacatgataaaatgttaacattttatcacgggtaatgggttggatgggtttgtctgatattttctatacttacctatatgtttgaaatttttcataataaacacggtatgactgcttagatgtttacctcatgcaatcacaaataaattgtgaaattactgcacatggttcctctaagtcctctccctcatttgactcagtaaactgctaaaaattcataccttggtaacaagttagagattaaactattaaaattaattttcttaaaagtgttttagaagtaccatctttaagaaaatcactaaatttgaaggaatttaatgaattcaaatacggactatattaatatatagtctatgtttcattttgttgctaaagaaaattcattaagttggcatttctaaccttttgacattcaaagtttagtaataaagcagcctggtttcagactgagaattgtaaattagagctgaacagggcacttgactagaaaagtgaactacttttcactgtatacctttttgtaaaattgtaccacatggctttattaatcattcaggctgattattaaaataagattgaagatttaaaaattatgtaatatcacatggggatccaaatgaaaatgatagaaatacattttctatagaaccttagttagtcatacaatcttaattgacagaggatggatcaagcaatctcaactacaattctttacaaatgtatgcatatttgtaaacaaaatgagtgagagaagagttgttattctaaaaataattgtggtgaaagtaaacccacaaattacagccacaactcttcctttaacatcttaaaaatatgatacaactttaaataacatatatttttcagttcggctttaccaggctaaagaaacatatgacaaaattttgactaactagagtataaataaaaacaaataatgaaagaattataatttttgtattccatttttaacagatgaaattacaaaattacagattcatattgagtgttttataaaaaagcaatgtctaggacctaaaagtcagtcattgcttcaacaaaattattttctgcatctacactgctagaactaatgttctaaataattgaagggctactacaacattcagaataattaaagaagcctgtatttccctagagcagaaaactgtgctgtattagcttaaaactgtattagtttaaaagatttaacaatatgaaaagaaaacaaggagcttctctggtaaagaaaaaaagatagctatagtgctcaaaaacatttccattaacagtaacaggccattcattactcaagtacctgatgacctcatgctttgccttaaaatctattctcattttttcacttaaaaaatggacttaatttgcttattaacataagtcattaaaaagccagtgttaagaaaacagaaaaatgtcccaacttatacttaaagaaaaacatcaaagttaatatgcaaaattggtatccaaaatatgcagaaacatgtatttccatattcatggctgtctatttaaataatttacatattaaacatttaaataattcaaatatttacacttaactctccaataaatttgaccaatactattttattttttgttttgtttttttttttgagacagagtctcactctgtcacttagactggagtgcagtgatgagatcttggctcactgcaacctctgcctcctgggttcaagtaattctcatgcctcagccttccaagtagctggaattacaggcgtgcaccaccacgcccggctaatttttgtattttagtagagaatgggtttcaccatgtcggccaggcttgtctcaaactcctggcttcatgtgatccacccgccttggcctcctaaactgctggcattacaggtgtgagtcaccatgtctggcctaataaataccactttaaatgaaactatatgaaaactgagtaaaatgtaaatctttatgtataacaagaaagaaagtgttctttctaaacaatttgtgccatgttttggaaaatcgggacatttatctggacacagtgatttgctttcccataataataataataacagtagtaacaatagtgttttgtgcatatacattgtacctccatctcaagatcttttttggcctatttttcaggatccctctaatgattattcagtcttctcttcaatgaaatatgctaacgcctgatgagagagcatctttctttcatagcacagttaacaactgtaattcttcaaccagctgttctctaaggattcccctgacaagctcttattttcattgcattatttctttgttctccttgtctaaactgtacacaagttacccagattttccactctggcccctttcaataaagaactgctttggcttgacaaataattagtcataaccagtattaaaaaataaatattacaaattctacatgctaaaattatattgttctatgtgacttctaaattacttaacagttcatatgtagaaccttcttcccataaggctccattggtttaacttctcatttatgaaaacaatcccagttattttatggagctagttaccatgtaaacattatagcccataatcttatgtcaggtgtagcatgaactaaaactcaatctatgtatactgtgtttagggcaactgaatccagatacttgaacatattaagatataagcctaaataaaacaaaattaaaccctacttgactcttctcctttgtaacctagtaaaaaacttgtaaattttttttttgttgtcaaatatttatatgtgtaccaatttagatcttggaatttctactaaagaaagtaattaccacttcactattagatactgtgataacaaacacagcaaagaccataacaggcccagtcagttgaaagctatgtgctaccttcaaaatgagatatttttcttcattagacctttgtagtataccttcttattggtattgaaggtgtgcctcatatcttcactcaaaactactagataaccttttttcatggtatcaatcctcgaagtggtaatgtgactattgaaataatagagtcatggctgaatataaaattctatataaagagatattattaaagaaaaagaatgagagactgtagataccaataaacaaaagtgaaaggaggtactataaacaaattactcaggtttggattagttcatttccaagcctatgtacactggaagagtggccacttctaagttgcattcagtctattacatgtaccgttgtacatgtccagttcattgttttcatcaaaggcacatgcaattcataggtaaggaaaaaataaagtggcaaggagaaaaagcctgtttctaagtaggagagtattctattcattgcaaaagatgaaagcaggtatctcttattacatgtttttgttctcagaggaacaaggccaaaaatatgtgattttcgtatttgtgctaacgcagcagaacttttcaaagtcactgccagaaatggaccagctttcttacctgttttttccatgctttaagttaaggatgtctgcctcattatgaacattgctggttcccccagacttctgtagtctggctttgctgtgattactggtcaaaacctttaattacagtatatagtttgtgcagctgcctggaaattggtctcagggtcagtggctcttcccgttcccctctttccattcttttgaagcaatattgctgaactgaaggcattgttccagctttctggtgtgctctgtctgctgcacattatgaatagctttgcaatcactctagcaattggttcttcaactgcctttaggttgtcaattgtaattcattggcttcaggcaccttttctcttttcattctcttgaggtcttttattacttaatttgcaataatattagggaatgtcttcttcagacatgtcactaatgccttactgattatgaggctgggggtacatttgactttcatacatgcgcctgttaaaatgtttcaatatttccttcatctctgtgacttgtgatgccaatatttgcagtaccttgcaaagaagtttgcttaatgctgaagtcttctctctaaagaataatctaaagactcctccttaagatattcttattggggttaatttatataattagttatagttatttttataacttcccaaagatatgatttctcatttttataataggaactaagatttcatattttcttcccatattatgccctattcttttttaacatataaaaattataatttcaagctccacacaactcagagatactgaagtagaaatcaatggctatgttttcagaaccttttaagaagacctgtatttgctcctcagacatatttgtagagattatataagaaaatattaagactattcaaaatgagtgacaatgcttctgcattacagaatcaagaggaagttttgtttctgttttttcaggggaaggaataaacaaatatatctcttgctccattaagaaaaaaagtaaaccatttgtgcattatgtctcaaatccttagttctggataaaatccaacagattaacccttctcattagtctcagccatctcagagcaaccaagggtattttaaagcagacactatgtaataataataatgataataattatcataattataataactaacgcttattgtgctttttatcttcaaagtaccttactgacattaactatgtctctattttcaaattaatttacctcgacaaatgttttattaactttgtaagctatggaatgtgtagtgactgagttctcttttgcaaataaaaaaataaatgaaaggaactaagggacaaggaaagggtaccttaaacttttgcctcaaatcagccattgcctttgttgaatgaggattaatgaaatgctaatttttataaaatataatattaacatacagatctaaagtgtgaagatcaccactacaacaacacaaatacatactacctcaaaaagattagaaagtagccaaataatattgtttggataaaatcagtctctaactttactagttatgattcattataaaatatttaaatatgcatacaaagtattaaatataagaattttttaaaatccttctaagtttcacttacgtaataaatgattttattaattaaaaggctacatttttttatttgtttgttttttgagacagagccgcactctgtcacccaggctacaatgcagttgtgtgatcttggctcactgcagtctccacctcccgagttcaagcaattctcctgcctcagcctcccaagtagctgggactacaggggcgcgccaccatgcccagctaatttttctgcttttagtagagacggagtttcactatgttggtcacgctggtctcgaactcctgacctcaagtgatttgcctgcctcggcctcatttgtttttaataaattgaattcatcactttaaaaccatgtcattatgttcccttagagcttcattatgtaccagtctctatgtgataaatctaaacaggaaaaaaatagattttgatgctagcaaacaacataagttctataagataaatataagcaattattttaaaatgtattaaaagaatatcatttggccaagatgtccagccaatttctatgagggattttggaaagagaatagtaccctgatatggtgttaaaaaaagtccacaaatagacaaacacaaatgtagaaacataaaatcaaacatttgtaaatacgataattaacaagttgaatctttttaaaactatgtattaacatggttagagtggtgaggattcgaggaagatgtggtttgtaagcaatattaacaggtcaggtttggtgtttcaggaaaataaaaatttttatattcaaggataaaaatagatgcattggcttgagtaaagagagagtaaggaaatctggataaagttgatggtatgaaggcagtaagaaaggatgtatggtaagattcggaggtagtcactctttcaaacaaaatacagttatcccttggtatcttttgaggatgggttccagaatctcccatggataccaaaatctgagacgcataaatccctgatatcaaatggaggagtattatcatataacctatgcacatcctcccatatactttaaatcatctctagattacttataatacctaataatgtaaatgctacgtatatagttgttatactgtattatttagggaatattgacaaatagactatacgtgttgaattcagagaatggtgtttttccctgaatattttcaattggttgttggttgaatacatgaatgcagaactcacagatatggagggttgactgtttattgaccacagagacataaacaagccgtaattcctgtccttcaacaaacttacaaccttaaggagtagacagagaagttataggcgaaattctaatattatgatttggataagcgcaggttgccaagggaaatcagatgagagagcccaactttggcatgggcattcaagactacttcctgatgtaatacatcatcttgagggggttgtattagtccatttttacactgatgataaagacatactcaagactgggaagaaagagaggtttaactgaacttacagttccacatggctggggaggcctcagaatcacggtgggaggtgaaaggtacttcttccatggtggtggcaagagaaaaatgaagaaggggctaaagcggaaccccgtgataaatccatcagatcttgtgagacttactaccacgagaatagcacaggaaagactggcccccacgattcaattgcctcctcctggctccctcccacaacacgtgagaattctgggagatacaattcaagttgagatttaggtaggggcacagccaaactacatcaggggttttcctagtgaattaggaatagtgagtggtacataagcataagtgagtgaagaaaaaggaatccgatgcacattaacatagaagatctgtggaattacattcgattccagaagggattaaaagattattaatattagaaggttttaaaatatgggtatcatgaaacttcgataggaagtttgcttgttctgctctgtgttgaaaaatagtgagaaaagaggagatctaggggtgtaaactattaggaaactctgagaagcacttcagaggcagaagtgggagaatgagactgtgaaaagtctagatgtggagaataaaaaagagtacgaattgaaaaaggcttcaaaatgttcactttacataaaatgaagatatgtatgtgactgaaggaagatagtggaaaggaatgggggttttaaaagagaacataataaattactttttgtatatacattgacatatattgagatgtataactttattaccctcacctaaataatttgcttgataaaatggacatttcttatataacgtatttgctcatggaaattttgcttttggtggacaaggcacactttaatcatattgcttggtagatgcaagaaacacaggtatacagaggaaaaaacagtgagatcaaggtggatagacatagaatcaagaaaatcaggtatacaaaattaattttatcaaagaatgcatatagaaataaatgaattaatgtataataaataaaatattctggctgttttagtacttacagcttaaaagttgctcttcaaaatacacttaaaataatgacattcttatacctaatgaaatgattgctaattcagaaatatttatttctcttgataaatattttcaagagatagctgagtcattcagtggaaaattgacttccaaaccctctcattgtttcctcaatatttaattgtaacagcgtgcagtgcatctgtaaggaatgaacgaaaaacagtttgtatctctcataccattttagaataagtatacgtcccataggggaattttcaagctgctcacaccataggtatgtacactgctccatgtgaaatcaaatcagtattctaaaatgctgccaagaggcaggtcaagatacttggaaaactcttaagatttagagtatatgacactttccaatgattattttacaaacacatttctctacacatacagaaagcagtattaaattaagctaagcattttacacgatttaaacactgctttgcattttttaataaaagatttgtcacatgaagtcagagaagatactcagtacttcataaagctaccaaaaaagaaatgatctgttatcaagcaatataaatataaaataatttaaactatagtttattatctagagacacagattgcccaagaatttcagtctttcaaaactctgtctgatcctttgtagaaaggaaaaaaagtacacaaggtagaaataatcacctataaataagtagttataattaaatgtgatagttaaataccatagaaacacactagcaccctcttccagaagatgtctaatactaaaaagcgaaaattaaataaactcttcatgcacagagtaatgaatgcattgttcaaaaaaatctgaatatttataaccaaaataaaacatggtctaaaaaaccagtaatgtttatatcattacaaaaatacttgcaaatacttttctcgcatttatatcttgtttttcaaacataacacaaagttctatgcatgtcataataacaaactgaattaaaattgcataaaaattgagaaatggcctgatcacaaattttaactttaatgttgacaccctaatttagaagctgtattttcctgtgttaatgagccgtggaacaaatagagccattcaaccttataattctgcctcaaaactctgtttcacagtcttcatatttctcaattagtatttgctttaatagaaaatattcaacaaatacttaacactgtacttttgatatactatttctgaaaaagttaaatacttttggattaaggatatagacaaacatcaaatcagatgacattgctagaaaatatagactgtttcatgttaacaaaacgtgttcttttataagacacaatgtccagtaaaatgaaaataagattttaaaaaccaggaggtaaaagaatcacaatcagcaactgtgtagaaggaaaataggattacatttattggctactatatcaacttaacttctcataaaaccctcctgatctattaaataacttcagaactgaagtatgctctcctatgggagttgtaaaacaaattagttacaattacaattcaatacaaatgagaaaccaacctatttacccttaagatttctctcattttatagctttatcatttaaattagatcagaattttccctaatgtaccaagtgggccacttgacataataataaatttttctcgaatgctttctatagagaaaaatagttgatatgagtaaattctggaattcacctccccaaagtgaatacaacaaacatctgttgcaagaattgcttggctttcagacagtatgtaaagggtgttctttttcctagagttttgctgttgttgttgtttttttaagcttgtttaaaaatacatgttttcactatcagctctcaagacataaaatcttaaaattctggtaagttaaacccaggtcattaccaggtatattacagaaagaaaaaatatgtaatgtacaagactacacttgcttttgaaagggcaagaaaataattgggcatgttgccctctctctgtgggttacatagtaattttaaccattgtcttcatttcttaattcagtgctccacacaaacatagcaacactcatagtaggggaggggactacatatacaacttccttatgatttttattctctttggagtcccactgataatttgactttctcttttgaatttcactggcttctccccacttctaaagtcaacagtatccagacacactcatcaaccaatagtgtgtttgtacagtttcactccagtgacaggataaattattgcacattttctgcattaaacataaaatgtaataatttcaatggagtgagaagaagaatcaatagcctttatgactgattatcttttctaactgaatcaaagtttagtgctttttggtaagttgaatgcaccttccttgattctgacagatcagaattttgcctaaaattcacaagtattttgcagattaaaataccatctttttagcattggtaaattccataaaacatacacaaattagcaggtgcaaatgagtaagaatgcttatcagcaatagggcacaggatgtgcaacacctttaggaaagagagaataaaaagacgaccgttatctaaatacatttctagtaacacatgactttgctcacttttcaatcttctactgcctcttctataataccaatgcctgctcccaacgattttaaagttattgtttacaaaatgtttaagattcaattccacaactccatttttatgccaacaataaggtactgatttaattcttaaaacattcctgagagcatttcaacaaggcattttaatacagtacacagagaaacttctctgtcatcaagaaatgggaaaaatctaggatatatccttttctttttaggccagacccaaagtaagtataaccatgtcactgtgcttccataaacttcaagacttataatggaattagcccatgtatcccattaaagcagtctaaagtgtagacatgcacctgtatggtatatgtttatttaattatggggaaaaatgctttacttaaagcagtccccatattggtattatgcaaattccattacaagcaaaagttttgagaaaagtaaatttaaaatggatacaaataaaaaggaaactcaaagccacatatgctccagtatacacaagtttagaatcattttcagaccatatctatgacaacgctacatttataactatcagtcttactgaaagatgaatcacaaaaagaaggaaaaagatatttgctctttacctaggaaagacagccagtcaacacacacaaggaatactcagaagcaattaattgctaaaagcttcctttattcaatgtgatcatctttcattcctatggagggtaaccataagtcatatgttaggtttaaagatacattactttcaattatatgatgtctaaggaaaacagatacacaggttcataactttaaaagcagaaagaaaaaatcttttttcagatattgcaaataacttgaataaagttatctgaagttaaaatggcacttatatctatgttttatcaatgtgtatatgtattatgtatatattacatacacacattatactgtctacatgtagtagtgtacacatacatattacaagattttttagaatgaatagctgaataacaatgcattctcagcaaacgaccttataatcataaactacccttcattacatactattatatctactctataggcagaaaaactgatgctgagaagttaaaagatttacaaactaaggtcttaaaagcacattaggagacaccatcattataatgctgaagatcttcacattaatgactttctgaatagatttttattgctgttttttacttaattacttaatattatctataaggtatttttcaaactctattctttaaaaggtgctacgtacttaatgctgaatgaggcaactaaagtgagacatgagctctgtctgttgaataatgggtccttgcctttcttttttttaaactgtgtttctaaaatttgaataaaaactctatttatatggttcttctacttaggtgtttaaacttcaaagtaaattatccaaattaatcctattaacttatcataataaattggattattctcattttagaggtgagaagccaggcacaagaataggctatctgccgtgggtcacacactaagtgtgagggaggtctggagttagaacatgttatgtccttggctcctcatttatttttcaggctgaaaggcaagattgttcatattaatcatctcattccaaaatcacttgaggaagcatgcaattttctgaaggagaggggaaatcatatcctgaaagttacaagtataaaggaatacatcaggagttttgatttcactgtacttacgttataattcactataatttaagttttaaaaactattcacatatctcattactgcagtaccatgaatcacaagctctattggctgagactctatttgcctagaattagtctcatgcttttataggagagatacaagctaagaaataaaattaaatgaggaagataaacattggttccatgttaaaatgtatttgatggcatggaatttgcaagacatcaattttcagcctagcagattacagaataggatccattaatcctagtcaacattgaacacttcagaggaacaagaacatgacacctgaaggcgagtaatgcatggaaatactcacgatatgttcctagaaaagctgaagaagagaatgaactaagtccacaggttaaaacaacattaaataaccaggcctttagcccctcaaaatagatgaaaaatataaccagaaacatcttttaaccattgctaaatagctagaaaactctgtgctctccaagtagggttaggtatgtaaacaagtgctaacagattgatataggctttctgcttcctatgaaaactaaggtttcatgttgaaagcagcataaccagcacattcctaattacatgcatttttccaggttccaacgtggcagcaaaagtacaagcaaggaagacaaagagttgtcatgctaatgagacatacctcttgtactgagcgagctgctggcttgtcttgatgattggccaatattaaaaagggtaaagtgcataactgtggatgctgaagagctgagtgcagctcatttctagcagcttctaaatcatcctctgaagaggcactgtctaatacaaatattaccccttgagatccttggtagtagcggctccagtatttccggatgttatcagcccctgtcaaaaacaaaacaaattttcgttttaaaaagagctttcagcaactgaaaaatgttcccaacagtaattcctactggaaaccaatgtaccttttaaaaattaagtgctaaactctgtggtatggattaaaacaggaatttagaaaaggcagaaatcacagtggatgggaacaaagaaggcagtagagccaataggtagatttggccttgaaggaagacacaaaatccaagccattcttaatgacttttatataaaaatgtgtgtgagagaaccaggataaatacttcctagacttaaactcaaaaggatattttcagactttaatcatctcaaatgaactacacactctctaaaaattgagactgaacctgcctcagagagctgcatggcctagacatccaccaacgcttctttccaaaccattaacattagcttggtgatacttttttaacagaactgcttgctgatcaggacagccttgtttaatttcacctagggagttattagcacaatagctttatgtgtcaaagtgctaaagtttgtgaaaaactaaaatcatggcctttgatacaattacatgattctgtttggcttcataacccatgaggaaaaataacagacaacaggtgtacacttatgatctcaatgagataagatgtttattaaaacaaacaaataaacaaacaaacaaacatatggagaggctgggcgcggtggttcacacctgtaatctcagtacttttggaggccaaggcaggtgaatcacctgaggtcaggagttcaagaccagcctggccaacatggtgaaaccccatctctactaaaaatacaaaaattagccgggcgtggcggcgggtgcctgtaatcccagctacttgggaagctaaggctgaggcaggaggatcgcttgaacccgggaggtggaggttgcagtgagccaagatcgcgccactgcactccagcctgggcaacacagcaaggctccatctcaagaaaaaaaaaaaaaaaagcaacaccacatggagagtctcatcagccaaggcatgtcatgtagtattcctctttgtatttccattatatagcacaacatctaactcaaagttcagtactggaataatgaaaattgagggaatgagggagtaaaattatatactaattaagctttacaaatttgagactagaacaaactctagagatgatttagtccaactctctgaggaaactgaggcagacagaggtaaagtaagtgatcccttgtcatgtatctaataaatcacaaaattgggatttgcatgagttagcagacaacctgcccagggaaggcataggcacttcccattacatcatggtgactgttttcatcactttcattcaagaataggaggggcaatatgtgtgcatgtgtaggaaaggggtgctactggttatataacgacaattagatttcaaggaatttcaccaatttattgcatatgatcaagtcctaaccagttaataactgtatttcagtcatccactgaacatctagctcctatgtttgacatattgttatgtgttagggaaacagtggggactgcagttggtgtgccctggctggcaagggtcacctgtttgcttctcttcccaactctgtgctcagtgacatcctgttggtagcttgaaatcaatcagggtgaaagcactgtcactatggaaatcagcaaatcctacatatcgagtcctttcatctcccagagagccaacacaccactgatgacactgagcagcttatattttctgggagaaatagaaaagaaaactcaaagattataatagagtacaagaaagtgctgtcatagagatactcattaggtcctctgggatcaagagataggcatttcatccaaagtggggcaattcttttttaatttcattttttaaatttgagatgggttctcgctatgttgcctaggctggactcaagactcaagtgattctcctgcatcagcctcttgggtagctgggactaaaggcacataccatggtgcttggggcggtgggggtaaatttcttgaaagaataatatcagtagccaaacagctcccatttattaaacacttcctatcctccaggtactaagtgttttaaaaagaaaagctcatacaattcttacaacaatctaaggagggaagtataattgactaagcctttgaaactaattttcaggtcctaaaatctgtgatttcaccattatactatacaaaaataactaggtatatatttaataagaggatcaaggacatttgatgttgagtaatgttaagtatgtgaagacatgggatatgagcagggttgatgcatatcaagcagggtccaactaagaaaacaaaacaaaaataaagaggaaatttaagccagagattatttaatatagggaattcattacttaggtggtggtggaactaaggaaacagcaggggtactgagataagcaacatcttaggtccggttccctagacacagagcctgagacatcatttcttgtacacccgatttagagggagtgctgtcaggagaaactagaagtgaaagaagtaagctagaatgggggaagaagctaggcaaagatattgtttcagaaatctagcctcagcttgatgcgataaggaactctaaagcatggattgaaccacagaagttgtctagtccaaaggcaagggagctgagctattacacccttgtatagtcattagccatccctggggagcaggagggggttggggcatgatctcataatctcccaaacatatttggttggggcaattactgtcagccaagggcaggcctctggagaagagtacaggtgtgagtcattagcagccaatacccacagcagctgggagatggatgcactggcccaggaaaggagatctgggtaggataccaacagcatctgctacaggctacatccagacactatccatatgcttgagaaccatccataagctggagggacaaaactggaggcagtgttactcggtggtaagtgtttaaaacaacaaaaatagtgtgcatgtgtatctgtacactagcttgttataaatttcactaacatgaaggatgtgcagtgcacagttttcattgtaagactcaatgcagcatgctttattgtaaattccacatagccaactaatgcccacagaatgctttcattgagtttctatccacagccaactaatggctgcaattgacaaactagtgtagttctgacatgaatggtggctgctcaaagtgttttacgtatattaaatcacttacccatgacagtctaatgactatcatgaggtaaatactgttatcaatctcattttatcaacaaggaaaccaaaacacaaaacgattatgtaacttgcccaaggttacacacctaataaatatatttaggtctaatgtgattgaaatagagatcatggactaaaaaggcaatgaggctaaataaagaactatattaccacataagctaggagaaaagaaatggaaccctattggaacaaaaggtaagttaatgcccacatacattaatggaaatatgtccaaaaacatttcccaactggttaattcaatggatagttattaagtacctattccatccatacaagtctctgagctaggacctaaagagatatttagaaagccattattcctcttaactgaaaccatcaaatcctgtaaagtaatacaaattacaatgaggcctgcaaatatagcaggcagagcaaatacatccacacattagatggtgtccagtgagtcaggtataaagagaatttggttgcatgttttactagagcttgtcccttggaaacacacaggacacctggaaattcaacttgtgcagtcaactctttcaatgagaaactatgttttcattggccacatttaggagtacatatggtacctgcaaatagtgagacacatacacacacacacacacacacacacacacacacacacaaacccaaagagaaataccataactttaaaaaatgtcccttatatgacataatgtatgaataatatattaatagtgaaaagatccttttctttaatctcctgctacagtttcacccaagaattcccttaatacggcagtaaaagttattattttattaacttagctcttaaacacacttttaaaatattctatgtgactaaatgggaagtaagcaaaatacatttttgctacataccaaagtagacagttgatttgacaataagcacttgtacaactgtttgagttgtaagctacttcacacaactccatttttacttgaaatttcaactgacaaactatgattattcagatttgactgtttgatagacattttctcaaaaatagatgtgcaagcttgtcatttcaaggaaaacaaatgatagtatttgttgtcaatggtaaaatttgttttcaagcaaaagctagaattttagaaaacttatttctgctaagttttaagtgagcctgacagcttttcagtgatgagattggtggtgatattaatagacagatattcataaagtaatctgtaaacatttggaagctctacactactcagtgaaccaatattttccaaatgacgaatgcatgatgttacaaaaccatgcatagataaaaaaatacattcaaagtacaagaaagaccaatgcaagttaattaactgagtacaaaaagttccctgataagttttccagattccacactacaactgattaagaaacaaccacctgttgaagaatttcagtatagtatcaaagaagacaatcaacagttacttaaaaaggttattaaatcatgcctccctttttgagttatctatgtgagactagactttcttcatatacttcaacccaaacaacatattaacaacagattaactgtagaagcagatatgagcatccggccctcttctattaaaccagattaaaaagatttgccaattttctcactatttttttgttttcaaaattgttgattttcattaaaaatgttatttatattaacatgttatgagcttattattcttttataaaaatttttaacatggctttaatttctgacatggcacatatggatactcattgtctttaatgtgagaaaaagacatttaagatctactgaaatttaggcataaatttagagctagtttctagcgggaataaaagtcttactttaaactatctttattctaaccttggctgactcaagtcccaagatagaagagctggagttgggagggcaatctcaaaactaagaggtctacccaggaagcatcctaatctccttggtaccattatatcggaattctaacccagtgatcagatacttgaaggcctagaaagattactgaattgtgtgttgcccaggaactttaaatggcatgcctcccaggagattccaaggtaggtggtcctcagcctacattttataaaacaaagttctacgtaccatacaaactgatatgccagttgccctctcctcaccttatcctccctcaacacttattctggatgtctatgtgactccaaacacaattttacatcattatcttagatgtcaattcctaacaattgcattgaggaccatgtctgcattctgacattggcccctcctttatgttctcactatggttcatgccttcatcaccttccagctggatcagtaggatgaccttccaacggctctttgcacagctccagttaaattactcatacttgtcactatgggttcaatgccccttcaaaaattaagaggtagaacctttaagaggtgattaagtcacaaggacttcactttcaaaaatggattaatgctgttcttttggaaatgggttcatttgaggagttttctccattttctcctctctcttgcatgttctctcaccatgtgataccttctgcacgttttgatgcagcaagaagacccttgccagatgagaccccttgaacttggatttcctagccgtaccgagccaaaaaaaactcctattgcttataaattacccagtctcaaatgaaccaagatacttacctagaaaactagcacaaactatcacaaatatactaatacttgtccagaaaactagctcaaattatatcactactctgctcaaaaacattaagtgcctataacttgaagttctcaaatgacttgatttagcatttatagttctccataatctggctccactttgccattcctaccatgttcctctgttgatctccttagatactccacaaatgagcaaaacgttttgctctcctggaccagacctaaggtttccacccttatgcatttggttttgttatctcctttgcctggagttactaccgtgtgagttgtccccttagttcttgtaaattcaaaccactacatgcgcttcaggggccagatcaaatgttgcctactccaccaagctttacctgatcttgcagctgggaataatttctaaaaatcttctggtctgtttctcttggttctccatgtaacactttctaccctgtagcatagtaatctaaatgcatagttcatcttcctgattacactggaagaaccatatgggagttttgtgcattttcgtgtctgattcatcaccatactctgaccacatctaacccataatggaaactcaatagtttttaaagaattaatcttttatagaatacttattctgatttctcaaaagtagaatgtagaatttaccaagcaaatcattctttgctatacaaataatctatctttttggttgatggtggtggcttgagtaaagttattagcaactaatttttatgtttctggtacatacccagttctgcaaggaatctctcattcagcatctgatattaagaattccttaaacatatttacaatgaaacttcactctactcataggcctttctcagagtcctgtcgtagtatttgaaaacatgcagccataatacagcacgtgctaagcactgtactaaaaccacaaagtacattaacctatgttccttgggatactttttgattctatcctatttatgaacctttatactgttctgatgtccaacagaatcagtacccaagagaaactgaaagcatagaaagaaaaagctgtgggaacagttctggagaaatgttcccttccgtactcctgcaaaagccaacagctgactccttagaagaaccacagatgccaaggggatcacaacttgcatagttccaaatgttttttaagcagctaattcttgagccattggcatgacacaaaaaacaaaacacttttgtggtattctagaaaatctggtggcaagactagaaaagctagtgggaacagctttgctgcaattgacgttgaccaaagcaataaattgggaagagccaaaatggagacttcctggctgacagaaagatatttgttgcatacccaggatgaaataagatcttttaataatgcggaaatgctactgctttctagcacaacttgccaatttccccaaccagtattttttcttttttatcagaaactttaacgtaccaatcctgtgacaaaactgataaagatgcaagaggttctagattaagacaaactcacggaaaaagttaaaaaccatctaatgtctcatcctatatagcataaagtataattagagtcacatactataagccttgatgttcaaaagtggaatagtaaatttgtccctcactttgagtgttttttcgtctgtgactaatcagacctcaaaacaagttattaccatatttactcacataacaaaattgtaagagaattatgcttgctctgcaatatatgactgcactcacatttgctctttcatcttttaactgtctctatgacattctttttggaaatgcttatcagagctcttaaaatgagagttccatttctccacctggcccattccctttgatctagttgttgtccccctattgatgacagaaggccacccagcatcatgttcaggctcaagcataaaatagtgaatggcaaagaaaaagtctagatttcagggaggtgacatcaatgtttaattttataatgtgcatatcgaattatgtaattagataagtcaatgcactttataactcataaataaatttgggcagctctaagtttagggatcaagtatgttctaaaactttccaaagcttctaatttttttgagaattcagtacacaattttccttgaaaacaaagcagtgaatctcaggagtgagattcagccctgaaggacagaatgatggtagagtgatgaacagcatggactcttactgagttcaaagcctggctctgccacatatcatctaagtaacatgaaaactccgcttaattgttccaagcctcagtttccctctcaataaaagagaggaaaataataatacttaattacctcataggattgtgaggattaaataacttttttcacacagtacgtagaatatgctaactgttcacaagtgttaactgtcattttgttgtggatgttactattatcatttgtccaccatttaagcctataactcacagaactactgaacgaagaactaactcaagttagctcagtacctggaagtaaaaggctaccagatgctgaacaaaagaggcaaagaatagattttctgtaattcctgagaaaaccaatgttataaaaaaataaaccaaagtttttacttgggacagaccctttctttttctgttcaactaactttctcctatgtcctgtatcaccttcagactcagtattttataatctccagtttcttcctccctcattgctgtctagatttcttcccttgactaacaccaaataagaaatttctccccttcagacaaaaacgcatgttctttcagtacaggtgtcttcaactagacatgaacacaaacagcatgattagtcgtgttaacattcaggtgacacccttatgaaaaccaaaactgatcactaatacaaactggttttgtccacatgtgcacgtgcatgcgtgcgcaatgtgcgtgtatacgcatacctttgagagatgatgttacctacaaggctgacatacagtatacatacacatacatataaagctattattacactttatgacatttctctttcttttgttataaagcatagataaccaaaaattggtactatttttttcagcggcttgcatggttgcacaaataagagctcaggcagcatgggttaaggcagggggtgccatttgtaggcaagtactcttctttttttctgtcaagtagatttttaaataaaatataattgaattgtgaatacaagaaaagcaaacacaaatctaagcacaaaatgggctttttcttaataattcttgtaactgtttataacccactttttcagccttttcacagcttttgcttaagcattctaatttcactggttacctgtctccatagctctactaaataatttttataaaataccccaagattctcatttgtgctgttcatcactgtgtctccagtatctatacagaatctggcacagagcaggccattgatatttattgattaagttaattaatgagtgaatggggagtgattatgtaaactatttacccatcgattcgaggacaagaagtctcatttttatatagtctaaaagaactcttactcacaccctctcttctttttatattccttttttttttttttgagacggagtttcgctctttttgcgcaggctggagtgcaatggtgccatctcggctcactgcaacctctgcctcccgggttcaagtgattctcctgcctcagcctcccaactagctgggattacaggcacctgccaccacactcagctaattttttgtatttttagtagagacagggtttcaccatgttggccaggatggtttcgatctcctgacctcgtgatctgcctgcctcggcctcccaaagtgctgggattacaggcgtgagccaacgcacccggctccttttatatttcttatctgaaatactgtttcttctctctgagcttctttctaaagcggtacagtccctttttttctattctcagaagcaagcttcccctttgtgttttgaaattgccatttttaaagaggatgctagtaacatgatcatcctatttcagacaattcgaaatgaatagtttctatgagtgaaggtggatgaatgaaccattaaaatcatgtcttaaagtgatcagacttccctctttacacaattactatatattaaaacaagactagcccactccatcacatataccatcaagcaggtttcttcatacttaatcatatcactaaatcagtcattgccaaccttctatcttatgctctggaatgcatcttactgtctcaagaggcaagtggaactctcaaaatgaaattaattttaattaactttaaaatataagtgttaatgtgtcatacagcacttggaaagagaaggttatacaaaagagagtgacacagcattaaaggagtagggatcaatgcactagccaaaaagaagacaaatgactttgaaacattgcctgaggttaagcacttcacttccaaatacagtttcccacgaagaacacactcaggagaaaagggagagagacagtgtaatttgaatgatgttacacctactgtctaaattttatttagattaggatagttaaagactatatttgcctgaggacagagaataggctacatgagaagagacatttattgggtatccagtaaggttccacagtgctgaattttcttacaattctgatattagattaggacttattttcatagttgactgataagaagatatcactcctttcatgctcttcttattctagacaggtcgaaacagttatagggcagcacatataaaagtatgttaatctgcttaagcttgtaattctgacataggatcaacgtccattttttaaaaatttgttttaaacacatttatcataggcttgctgctgttctgaatattttttcttatatacaaatgactgaccacagaaaaaaatagcaaagaaaaaaacacattatctaccacacctccactctttggtttgtattcttcaagattttgtctctttcttaattagaaaaatgaggattttactacaaacctcaaaaatcagatcattctattcaacaaatacacaaacacagtcttagcaaaaatcaatctaaggtcatgcaccattgttaataatagatatataaaaaactttagaatgacccatattttgtattttcataaagccagaaaccacatattttctttctttatacttgccataatggcatcataggtgctcaatgattttggatttaaagaaggttaggaagagcatagtcattccaagctaattactaaaaccccacagaaatgttacatggtgaaggctaccccttcatgtttgtggtaggtagactctaagatgacctccaatgatccccacttcttgatattgacccctggtgtaatctccccttgagtgtgagctggcctagtgccttgcttctagccaagagaatgtggcaaggtgatgggatgtcacttccttgaataggtatcttctgtcttgctatcagattctctctattgcctttctggtaagcaagttttttgttttgttttgttttgttttttttttttttgagacacagtctcactctgttgccaaggccggagtgcaattctcctgcctcagcctcctgagtagctgggattacaggtgtgcaccaccacacccagctaatttttgtatttttagtagagacggggtttcgccatgttggtcaggctggtctcgaactcctgacctcaggtgatctgcctgccttggcctcccaaagtgttgggattacaggcgtgagccaccgcgcccagccccagtacgcaagtttttatgaagcaaactgccacactagagagtcacacatggcaaggaattgagtgtattctctcacctaggaatggaggctgctaggaaccgagaccctcagtctaacgctgcccccacaaggaaatgaaatctgccaacaaaaacaggaattagaaagagatccttttatggatgaataatattccattgcatggatataccacactgtttatctgttcacctgctgatcagcatgtgcgttgcttccatcttttggttattgcgaatagagtggccatgaatattggtgcacaagtttttgtttgaacatctgttttcaattattttgtatgtattatctacaagtggaactgctgggtcaaatgttaattctatgtttaacttactgataaaacgtgtgctgtttaagtccccaaatttgtagtgaattgttacacagcaatagataattaatgcaaagtttaaaataaatttgcagctaggtagaaattcccaaatgtggattaatgaactacagggagaaaaaaataataatttaccattggtctgactggcgactcatgattcccccagtcaatagtatttactgcattctcaaaatacttcttaaaaagcaacattaaaaaaattgctatgagggtttgccgggtgccatgtgttgcgctgtgctgtactgcagagattttttttaaaaaagaaaaaggcacagtttccaccctcagagtgcacagatctccaattaagaattacctctgctgatattctccaaaattctgttcatcagcttatttcttctcttgttgtacatcctctttgggaaagtctttactcacattgtttcatctacctctaatatcacgaaaacactcagttcaaatgctctcatctaattttctcctgagcaccaatactcttacttcttctatcatatgttcccttctagatgttccccaggaattttaaactcaatttgtccccaaataaactaattcttgctatgcactcttttccagcccaacctcttgaattccctgtcagacttagcagccaagattgaaactatgaatcttaagtcattctttaccccttatcctttattcctaattctcaatcaactgcccaacttacctctcctctataacccagtgtaattgccaagctctttgaaacttttaaaacttctctgctatgatttgaatgtgtcccccaaaaagcatgtattgggaacttggtcctcaatccaacagtgttggggggtagggcctaatagaagttgcttaggtcatgagggattcaccagcacaaatggattaatgctgattataaaaaggcttcaggctgtcagttcaatctcttactcttctgccttctgccacaggataacacggcaagaaggcctttgccaagtgccaatgccatgccttcgaacttcccagcctccagatcttgagctaataaacttctttttttaaatttttgtatttttttaatttatttttattttattttattattattatactttaagttttagggtacatgtgcacaatgtgcaggttagttacatatgtatacatgtgccatgctggtgtgctacacccattaactcatcatttagcattaggtatatctcctaaagctatccctccccacttcccccaccccacaacagtccccagagtgtgatgttccccttcctgtgtccatgtgttctcattgttcaattcccacctatgagtgagaatatgcgggtttttgttcttgcgatagtttactgagaatgatgatttccaatttcatctatgtccctacaaaggacatgaactcatcattttttatggctgcatagtataccatggtgtatatgtgccacattttcttaatccagtctatcattgttggatatttggtttggttccaagtctttgctattcccaaaatctccttaagctgataagcaacttcagcaaagtctcaggatacaaaaccaatacgcaaaaatcacaagcattcttatacaccaataacagacaaacagagagccaaatcatcagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcatgaaaatggccatactgcccaaggtaatttatagattcaatgccatccccatcaagctaccaatgactttcttcacagagttggaaaaaactactttaaagttcatatggaaccaaaaaagagcccgcatcaccaagtcaatcctaagccaaaagaacaaagctggaggcatcatgctacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagcaagctgaaactggatcccttccttacaccttatacaaaaattaattcaagatggagctaataaacttctgttcgttataaattattcagtctcaggtattttgttacaacagcacaaatggactaagatgttcctctggctgtttttcctctgctacacttatggcttacctagaaaattcttatgcagatttcaagcctgaacccaaacattatgaccttgtgaagccttccttaattttattttttataagactactttctctatccattgtgatcctgcagcaaactgattatctcttcaatttcaaaagctagacacacaacaaagcatcagtttttacatgcctagttctttatgactgttgtgggctgacagatttctgcacttatgttctgagaccaatttttctggatattttaggtagctaatataggaatcaacatataatcttcactcaattcatgtgtgctgaatttaaaatagccatctgatttatattatgattcacttaatcaactaacaagtatgtattgagtagcttctatgtatcagacgtaacactaggcataaggaatatggtggcaaaccaaatagacatgacccctgcctgactcatgagctcacagtctcacaggtcactgagttgataatacatttatgacactatgtcatttaggcttcaacctatctctgagcaacacaagtatttcctatatttattattttgattctttttttttttttttttgagatggagtctcgctctgtcgcccagactgtagtgcaatggcgcaatctcagcgcactacaacctccacctcccaggttcaagtgattctcctgcctcagcctcccgagtagctgggactacagatgagtgccaccacgcccggctaattttttgtatttttagtagagatggggttttaccatgttagccaggacggtctcgatttcccaacctcatgatccgcccacctcagcctctcaaagtgctggattacaggcatgggccacggcgcctggccttactattttgattcttaaataaaaactggaaaattaaatttcttttcagtgagttataagtaaattttattaccatcattagcactgcattaaaaacaacaaaaaaaccaatcccttcctgatacctttcaacatatatgactgtttgtatactatctaaatcgaaacatctaatatctaaatctgaacattgataggatgcctcaactatccagaagacagctaaaaattaagaaccatgggacagccaacagaaatgtctccaaattaataacctaaagctcccatgcttaacattctaaaaagtccctcaggtccacacagaaacctggcatagaaaaaaaagtgatcacaatttcttggctccctattcagagcatattagaagtagtaaatcattatgtgggtgatggaagagagagagaatctgccagaaacaggcacagagacagtagcaagaagagatagctacaacagagactaaatcaagaaattaaaaaattaaacgagaagagataataactatgaaagaaaataaggcacagaacagaaattaaaagcgtagcagttcagatttaatgtagcatgcaatagccacccactttcccaatagtactgtagggtttctgatgtccatcaaataaatgatgaattatattcctggcattttcatttattatcatttgaacatataaatgtaacaaggaaagtctgatgaacgccattaccaacaatcctgtctaatccagcctcacctcacttcctcctttctattattttaaagcaaaccgttaatattacatactttcatctgtaaatattttggtatatatctaaaagatgagaattctttttaaaacatagccaaagtaccatcaatatatgtaaaagaaattaaaatcaattgtaaagtttatagcccattttcagcattaaaatgtcttaaaatattggctggatgtggtggctcatgcctataatcccagcacttggggaggccaaggtgggaagattgcttgagcccaggagtccaagaccagcctgggcaacagagggagacctcgtctctacaaaaagtaaaaaatcagccagatatggtggcacatgcctgtagtcccagataattgggaggctgaagcaaaagaattgcttgagcctgggagatggaggatgcagcgagccatgactgcaccactgtactctagcctgtctcaaaacaaaacaaacaaacaaacaagcaaaaccataaaatgtttaaaaatattaaatcaaaatatatttttacattcttaattttattggttaactgtcaagagagatttaaaaaaagtgttctgggaagcactctctttcctaatgcaacacccagtgacgatgtggcatcattaaattatgatattttgctattgaaacttaattctttaatcaaggaaaatccttttacagaaaatcattaattttgtttagtctacaatagctctttcagatttaaaagttaacaatgtaatttattattatttgagggccacagactaattccctgaaagtgttatcagaaatgatatattattaacttattaggagatcataggctatcgtgagaaaacttcatgtcaaaattagttgtattagtactgagatgtaattattcttcaaaagtatcataaaatcaaaaacaagtagggaaaaacaaatacaatgatacatacctgggaaatatagaattgatttttggtagccaaaacttaggtagaaaattaaagaaccagggacacaggtacataatcatctcttctttcaattaaaagccatggtttgaaggaaacttaaatgaatggcactctaggtagttgatttggaaactaggaacctatttggcacatctaaggaaggatgcgtatgtatgtgtggaggggagaaaatgggcagaacacaaaacagctttaaattgaatttgagagaaatgtctagatgaaatctgaaactacaaatcttatcttcttcctaacttagatgtgccttggaaggattacagaagtgctgagatccctgtagcccttggggtgtccagtgggacctggggcatgctctccccatctcttgtcatcacctctagcagtaagcagtttctgtttatcctaatataccattaaaatattatcattttcaatgtttgataatgtgaaaaaccttgcaaagcattagtccaaagagcttattagcctgtcattcaaggctcttgatgatttgacccaaatgacctttctaaccttgaatcttttcacaccatttatgaaacgtttacactggtcaaaatgaactgctcgtgttttccccttacacccttcatgcttctcaactgctgttgcctctggtttgaatttctcctcctcctggggatctactttttccctatctttatattttcaagtataatcgattcctaagcctgcattaaatgccatctgtaccacaaaacccttccttttactgtatttgtatataatcttttttcccccactaaggagccagagtagtcagttatctacagtttttaatgtcatgcgtaactttctattttgtaccattgttacttatgtaaaatgtttttagtttaccaactagagtcaaagttctttgattgcttaattcaagtaaatttactccagcactttctgagaaacttttatgtgccaagtactatactaggtgcagaggataccacattagtgtggctacactatcaccagaattactgagtattgtttttaaaattctagcccagctactcgggaggctgaggcaggagaatggcgtgaacccaggaggcggagcttgcagtgagccgagatcgcgccactgcactccagcctgggccacagagcaagactccgtctcaaaaaaaaaaaaaaattctagccaatatgataaggcagaaattagtaagaggtactgcaactggcagggggaaaaagtatgattatttatagatacaaacccaaaataattaatgagaaaacttagaactaataataacatggttccataaggtgataagaaacaaaatttaaatgttttcaaatactttgataatacattaaaaaacatttaaaaatccagcaattttaacaaatattttaatatgccaatatgtacatggaaaaatatcccaatatgtatatggatgaacacacaaacacatacgcatgcaggcacagaaacaaaatatgtcttatactaccatatagtataagaaatattttaattctctccaaatttaatgaatatgtttattaaatatatttatgcatttaatataataaacattttaatctttccaaatttactattgagtttaagacactaccagtcaaaatctcaaggaaatctttaacccaaaatttcacctggaaatcattaacccaaaatctttcatgcaaaatttcactaaaaacagtcatatttttaagagcaaaataatcaatagacacaaattacaaaggagatacaaacataaagaattttaatttgttatttaaaaaatataaactaaaattatatggtacttttttttcttaagtgaaagtaagtttattaagaaagtagagggataaaagaatggctactccatagataggggctgctggttgccatttttatggttatttcttaatgatatgctaaacaaggggtggattattcatgcctcccctttttagaccatatagggtaacttcctgatgttgccatggcatttgtaaactgtcatggtgctggtgggagtgtagcagtgagaacgaccagaggtcactctcattgccatctttgttttgctgggttttagccggcttctttactgcaacctgttttattaccaaggtctttatgacctgtatcttgtggtatggtaccatttttcacttatccaactgcctaaaaaaatctaaacgataatctgcaacaatatgaaagatccaataacaaagacaatagaatgtatttctaataggaatgtaaatctatgtaaattttctaataagcggttttgtattatgtatcaagagccttacgatgttttaatcctgaattttctgtttttaatatctaatctaaggaaatatttagaaactcaattcaaacataaacttttaaaagaaaatcagataaatactaagtgccagatctataccaaattacacaggacaacacaggcatatagaagatctgggaagtgcctaccaaggacatagatactgaaggttaaattattttatcattaatcatcagaaattgtctaaaccatattaaagagtcgaagttccacacaagtcggattcagttaggaatactgacagaggtactgataaaaatgagttgataaggaggagggtagatcagcaatcaaaccccgaggagagagaaagtggcaagtgctggcagtaccccacacaagtattatccatggccaaatacgtgatttgtccagtcttggtagcaggcatatcgctattaacagacacactatcagagccagatgccattagacatgtggccgctataaggtcctcagttctgacaaatgtatacctgattcagctgacagtttcatagcaaagaaggataagaaaacaatgacaaatctaagtctccaaacttaattgtgaccatcaaagaagaaatggttactatgttattctagagactacactaccaaaaatgatcatttaccctagactgtagaaaggatttcaacctaacaattggaagaagatgagaaggcggagaccatgaatggtcatccaaaacaggaagacagttaaaggaggataaagctatcagaaagggaaagattagaggctaaaatgaagttatactcgcaaaaatgttaagatcagataagaaaaaaaactagagagggcataaaaagagtaactttgaaaacagttaagaggaaagtaaatttgcagataggagagagtatatcaaacttctttaagttaactcaagtctccagatccagacagattacatacaagatagcagaaaaactcagatgtaactgcaaaactgctctgagcaatgttatgtaaccctggagaatgggaaggttaccagatgattggtgataggcaaatattgccccagatttaaaaactgggatcattgtgaaccaccatgggttcactaagaataaatgtttctaaataattctcagctccttttggactgacttgctaggttggtacatttggggaataccatagtatgggatcatttcaggaaagtatttgacaagtctcttacagtatccttgggaaagaaagaaagaaatcagacggcagtagttcggtagctttgtagctgatttaactgacttacccccaaattcgtggatttgtgccaacatgaaaggggctaggtcttctatgatttgcaaccaatcttggttttcacagcacttcacacgtaactctactatagcaattatcacactccattacagttttataattacatgtctattattccctatagcctgtgagctccctgaaggaatgattagctttttttttttttttttttttttttttttttttctgagacagagtcttgctctctcgccaggctggagtgcagtggcacaatctcggctcactgcaacctctgcctcccgggttcaagcgattctcctgcctcagcctccagagtagctgggactacaggcacgcaccaccacacccagctaatttttgtgtttttagtagagatgaggtttcaccatgttggacaggatggtctcaatctcttgacatggtgatctgcccacctcggcctcccaaagtgctgggattacaggcgtgagccactgcgcccagctggaatgattacattttatccatcttgttatttctagcagggagcctgagattagcacagagtagacagtctgatacatgtttacatattttaattgaattaaaaagttgaagaaattattttaatatttacagatgtctcaaagctgaaaggaattgctaatatgttggatgataaaagaaaaaaagccaaaaagttcttgacaagctggaacaatgagccagcacttacacaatgaaatttaatagagatataagtaatgtctggtacttggaataaaaaaaaaatcagctgaagaacacaatgggaaagacatgactaaaaacagctggatgttttgacagcttatccaacatgggccagtagggtgctatgattcgtgttgttggcatgaaaagaaaaagcaaacctaaaaagagatgaatatcactggtcagaccacatctatagcatcatgcttctaggcacatattttacaagggaccccacaatttaatacttctccaggagacaaggaggatcgtgatagacctggagaccacatcataggaaaaatagttgaagaaatggaagataattagattgaaaagtgatccttcagaatacatgacacctaaattcatgtttcccaattactatctaggggagctgtactatttgttagtgtggctccacaaggcagagctaagattattttaacaaagaaacagagagttgcattttagtaaattataatgaatgataataatgaaaactcttcaaacatggcatatatacatactttctgagactgacttcctcaccatgcaagtactcagtttgggactgttcagttcagtcacatgccagagatttgaaaacagcaaattcctatttggtgtaacaggtttgagcaagaaatgtctgatttaacaaatatggtttcatattcttttatgagataaaaactgctggaaggtagaatgctattataagactcatttctgaaggagactgcatacccaactttcctgacactgcttctgagaaggacaggttagaccactgcccactgcagcaaatgcacccatagcccactctgagttccagagtgatggtagaaaatctggaaaacactgccttgtctcatgtggggcagagtttcaagacagcagaaggcaagggagatcagaaacatcaccttgttattcaggtaaactgtaaaagtatataaaaatatataagccatcaagaacaatgaatttataagctttattcccactctctttgtatactgactcccagattcattgactcatttagtacaattttatcagcaaaaaaaattttaaaaatgactacttaactaatggataatgtatatttaatatgcgattttctaatcatccttcaaataccttcaatagccagctacatcatgagagatatatctgcatgtttaagattaattcaaattataaggagaattcaaaagtgaattaaaatgtgacttacagccagtaaaatacaagcaagtcaatttttcaatgcatcttgactaaatgtaaaatatcatctgtttttgtgacaaacaagtctgtatcattaatcatatgcttccagctgcaacagctcgcattcaaattaaaaccatgaaatagcatcacagtgtcaagattcacgcaaactgatcttttaacagattgtgagggaaaaaaaaacatacattaaaagaagaatctggagaaaatgttacacaataaaaacatctgaaagagcttaagcacacaagatagaattctggtttttgaactgtattggaattaaatgttaaacaaaactcacagcctgctcttaaacaacgaacacatcataaaaaataattctttttatagccacagggctgagagttttgctgtttatatctatcccagcatacaaatccatagtactgccaggactgtcccctctgactttactgggaagctagacaggacagtctgcctgggttttttttttttttttagtttagttcagtttgtgtccaaaactggcccaagaatcatctcttcttcagtcactacactcttgcctgccagttgcacagctccaaacattctccttccagctacagatattaaaatgttttgttgttttaaaatttgatttagaactgcagtagataaccttttttttttttttgcttcaggctcccctaggtcagcaaggcatagtaatgttcaaacagtgcaacagcagccactcattgcacattaaaaacaaggatggtgccaggaaccagcaaagtgatatattctaggttagccatgtcaggcattttccagtcccaaagcaggtttcatatggtcagcacatgggccaaatgatgcacatggccgtcctgcacttgccccttgtgtcctcctctggtgacctgccccattgaactccctggacgagattcccagcgatgctatgcaaagaggacatgttcctctgagagtattttctgcattagggctcacattgtattgccatgggactttacacttttagggtataacctgacatgccacaaccttttcttccactcctcagttgacacctctttaaactggtggcccagccctagcctagtacacataaaaacgataatagccactctgccaatcaaggttaatatttcagcttctctaataaacctggggtagacaccatgatacaatatataaaaacaagaaaagtaaaaattcagaactttatctcaaaattgtgcaggctcttacctactagatttccttatcttgtaaccatcatttctttgttcttttgttccttgttcacagagatattgttccagatgataaatggaggagtatgtaagattttaatttcatcacagcctataaagaatattcccaatgaaatttaatgtgaattttaaattgtatattatagttgggcatggtggatttcagaagctttgaatcccgtaacatggattttaagagagaaagctttttttttttttaaaggaaagtaggatgaggaaataatatgaggagaacatgcagtgactaatcacttacaaaagagaattttagagtcaaagtatgccttagaaatggtctggaaaatacgcagccaaatcaaataacttaatatgtattgagacttcaatgtttacagaaaatttgaaaccttttataaaaccactaattcttttgtaatgctacaaattacttaataagagttactaatgtataaatctctattattatatttaggattttcttccagaagagtaccaccacacatcttaaaataggaggatctcgatccaggtacagtggctcatgcctgtcccaacatttcgggaggccaaggtgggagaatcacttgaggccaggagttcgaggccagcctaggcaacatagtgagaccccatctctaaaaaaataaaaataaaaattaccaatggaacaggatagagaatgcagaaataaagctaaacgcaaccaactgacctttggcaaagcacacaaaaatataaattgagaaaaggacatcttatttaataaacggtgctggaaaacaagatgaccagatgtagaagaacaaaactggatccctacctctccacttacacaaaaatcaacccaagatggatccagacataaatctaagaccagaatctgtaagaattctagaagaaaacctaggaaaaacacttctggacattggtctaggcaaaggatttatgactaagaccccaaaagcaaatgcaacaaaaacaaaaataaataaataaatgggacctaattaaactaaaaagcttctgcacagccgaagaaataatcatcagagtaaacagcccacagaatgggagaaaaaatctgcaaactatgcatccaacaaaggactaatatccagaatctacaaggaactcaaacaaatcagcaagaaaaaaacaatcctatcaaaaaataggcaaatgacatgaatagatattcctcaaaagaagatatacaaatggtcaacaaacatgtgaaaaaatgcccaatatcagtaatcatcagggaaatgcaaattaaactcataagatatcaccttaccccagcaagaatggccattattaaaaagtcaagaaaaatagatgttggtgtagatatggtgaaaaaggaatgcttatacaccgctggtgggaatgtaaattagtacaacctctatggaaaacagtatggtgatttctcaaagaactaaaggtatatctaccattcgatccagcagtcccactactaggtatctacctaaaagaaaagaagtcattgtatcaggaagacacctgtacacacatgtttatcacagcacaatccacaactgcaaagatatggaaccaacataagtgcccatcaatcaatgagtagataaagaaaatgtggtacatacatacatggaataccactcagccattaaaaaagaacagaataatgacttttgcagcaacttgcgtgaagctagaggtcattattctaagtgaagtaactcagaaaagacaaaccaaatactatatgttcttagttataagtgggaactaagctatgggtacgcaaaggcatacagagtggtacaatgaactttggagacttagaagtgggagcctgggaggtgggtaagggataaaaaacaacatattggttacaatgtacactacttgggtaatgggtgtactaaaatctcagacttcactagtaaacaattcatccatgtaaccaaaaaccacttgtacctcaaaagctactgaaataataaaaattaaaaattagctgagcatggtgatatccacttgtagtgtcagctacttggaaggctgaggtgggaggatcacttgagcccaggaggtggaggctgcagtgagctgagatcgtcccactgcactccagcctgggcaacagaatgagaccctgtctcaaaaaaaaggaataaaaaatgacttttaaaagtattttaagtatgttcagagatacacctaaagactttaagcatcttttctacatttctaaattgaaagcatactcattttggatcttaaccaatcaccatttaaacaagttttcatctgctccagtagagataatttcgccctacaacttgataaatgtttgcaaaatagacaactatatatgagtaacagcaaagaaagcccaaatttaaaatctatcaatgtatctatctgactactatccatcttaaagtccacagtagtctgacaactaagcgtccaagaagtctcctctgtgtttttaacttcctggattatagtaggtctctcttaacttactggaacaaaaagggtgattaattgatatctaaatacatttagaagattttgaaagaaaaaaaaaaaaaaacaaggcagcatgtgctctgtccctagttcctgaagtatgaattgtttattataatatggtaatcccactaccagctctggttgtaccaccaactatgattttgaaataaagggtttaaatatatatatatgcgtgtgtggatagacagatagatagatagatagatagatagatagatagatagatagatagatagagatagagatagagatatgcttacacagcccacatttaaaatctaccattatcttaaagaaaaagaacatgatagtggtggctcccactccatggagatcactgatggcaaagtacagagtgggaaaacatatttatgttttacccgcttggcatattataaatagaacaatctcaaccaggcattttgccaagatgtggaaaaatgaaatgaggcaaaatgcaaatggaaaataaaattactttttatgccaaaataaggtctggatggaaaactttaaccaaagatatggtctggatatggtaagacttatagaagatcagctgaagatgatttgaaactgcaaagattcttgaacaacaaaaaatggtatttcattacccatacacaaaacacaaactgtctagataggaattatgctaatatattttggaagcagatgctttctaatatattttttcaccttaatgtcattaccgttttttccccaacctgctcctttctataagatctgcactttgccaaatgcagaatcaccaacacgaataattattataaatataaccaaaatggttgggaagaaaatgttatatcactatggttttgagtatcactacggcatgaaccacaactgggttatactgagaaatctctcactctttatataatgaatctgtcatttttttttattaactgagtgctgctgtacacagacagatcaatctgtcttctcttattagcactgagattttaaaagtctacacattaagttaattgatttgataatttctttatcttagagtttgaagtgcttacacatttaatcttaacaattcagctatatacgattacctagaaactgacggttttctttccgagtcctttcccagtcactttcatcttttttcaagctttttttaccttaatctgtctagaataaattttcattggaaagcaatccaagaaaagggccaaagtctccacaaaacacaatttcaacgatttttaactggagataattaagagtatcttttaattttgcaagttatagaaatatttttaatagttttagtgtggtataactgacacacaataaactgcatatatttaacatgtacaatttgacaagttttgacatgtatacatggtgaaaccatcaccacaatcaagataataagtatatccagcacctcaaaagttttctcatgacccttttaatctctctctttcacttattgccatattttccttctcccactcccaggcaatcactggtctttctgtcactaaatatgagtttgcattttctaaaattttatataaatagaatacaaatttatctcagtaggagaacactattttattttgcttggcttctttcactcagcataattattttgagattcatccatgttgttgcatgtatcaatagttcattcactttgattactaaatagtattctattatacagatgtactacagtttgtttatccattcaccaattgatgacatttgagttgtttccagtattgtgttattacaaataaactgtgtacaagattttgcatcgatgtaagttttcacttctcctaagagtggaatggctggattatcaaattggtgtacatttacctttttcagagactgttaatctgttttcaaaagcagttgtgccattttacactttcaccagctctatagctacagtaagtggaggagttaaggtcttcaaaccctaactgattccagatcctatcttctgtaggctccatttttttctaaattagacatcagctttggccagaatttggatgacaggagatggaaatttaaagagtggcatgggggaatttggattataggagataggaatttagggagcaacatgggggagtttgtctaatgacaaaaataaaggatgctcacagcctggggaactaagtaattcctatctcattggtaccaggagctaacctagacgacagagacaaagtaaagatcagtcagaaagaacaactcagaacagaggaccaaactgagccacgagggttgatcagtgacagcccatgctctcctggactcaccttgctggcccattcatgcctgtggcctccctctccaatgacctcccatcacccctcataaggacaagatgctgtttactttccatccgaaatgactgtggttccgggagttgttaggaggccaacgtgttccatgctcttatgttaatagtgtggggataaaaactaaacaaaggaagcaagcatctgacaataaatgagtctactggaagtgaaaaaaaaatccaatttaccaattttccttttatggatcatgctttggtgtctaagaaatctttgcctaacccaaagtcacaaagattgtcttatatgttttctactagaagttttattgttttaggttttaaatttagaccttggatccattttgattcatgacacaagactggagtacttttaaattttgttggctgtgccattatttttgtctatttgctattaatttctaattttactggatattaaccagaaaacacataaaatatggtcacatgtgtaaacattatatggataattcaaagaacatatattttctatttgattataaaaatatacaattatcaattagatcaagtctgttaattggctatttaaatcctttatatatttttatttatttgatctgttatctgctcaaataaggagagctaaatttccctactaattgtggatcgatctgttgactttacatttctcttagttttagctttatatagttcaggattatgtagttaaatatttaaaggttcatgattacttagttatcttagtatatcaatatgaaatctttttctttagtctatttaatgatctttgcttgaattctatttcatctcatattactttaagtactttcttttttatggccttttttaagggtatcatttcctatatatatttttaccttaacctatctttttttgtagaagtgtcttttgtcaccatatatagctgaatatgtaatatttttatgctatccgtattagaaaagggaatttaatctacttacatttattgtggttattgatacagatatacgtgttttctatttatcacaacttttttgattgttttatttctttctttcttgaactttgctaaatgtatcaaatattctttgctttttgtccttacagtacatttcctttcttaaaaaatctttatgctttaaaaaaaaagttatggaaaaaaattcatgcactacagataaagcaaaatttgtatttgatcccggtgaactcttactccgttccctaagataatttattatatgagctgaataggtaaactttcaaaactttcttaaaaattcatttatgaatatatcatcctatttttattatcatgtttattcttaattgcctttaagacacataaacttcaatttttttcttctttaaatcataatctataccctaaataaaaaaagaacataatatacttttatgcttgtttctctttacctgaccctgccatcttccatgttaaaatcagaaataaagctattttatgtgtgcatgcatgtgtgtgtgtatgtgtgaaagagagagaaatcgtaattaatagtttatttttgtttataatatttctaagtatggttattttcttattaattatatttggaattgagagggctcattacatctaaatatttttttttcatattttatgctttttctcctactatttctttgataattttgtcctttccagtttctcttttctctaagagaattacagggatgctagaacttctgtaactattctctatgtctctcaaatttttccccacatttctgaagtattctttttgtatgtcattctgaaaaagattccctagttcaatctttcatttccctaatttatatgtgagttgtattaatgaccattttcattttaaattttaaagtcaaactttaaattcttaatttctgtgcttgagtctttttcatgaatacatctctctgaatgtcttcttctgatcactctattacctctaggtccttgaatattttttcttctcatttttcatttggcatctttctttcatggtactgatttacttcatattgcggtgtgtcataattatatgctcatcttttgtttgagaatctctgtgtgccagctcttttgtttaccattgtctgtttccagtgattaatagggacagacaagtggcttgtctcctgtgtgggtgggctttctaacccacctggcagtcagcacattactgaggcactgccctacctctctgggtctagcacccacactcaaggatttagtttgtgggtaaacacagctgctatccactacttaacacaaggagaaaagaaaaataaaggcacagctccaaatgtggagctccaattaataactctgatgagccctttgattaataatcctgacgaattcctcttttatttcgtgtttccattgtctgtacctttagctttgtcttgctttcttttctttgttgaggatttaaatctatttttgttatagatttaatttattgtttcttttcttaccatttttttcataaaatagaattttggctatggaagaaaaatataaagacatatataacaaaagacatttaaaaaaacaacttccaattttcaatcatgtacgttgcttaaatttaagggcttcacacacttgtaccaacagtgataattaactttacataaattcttcgcattattgctgctcacaatgatgccataaataccagggaatttcaagattaaaataatcaagcatcttcagtagaatctttcaacaatactttggaccgcaagaaattaaatgcaacaaatttttgattcctcaaaagaacactactcagatctattttaatcagctttgaacgtgtcagagaatcaatctagtctgttaagtgataaatagctataagcatattacctcttcaacagttgtcgagttgccattccatttatgggaatctagttttatgtttttctgagaacttccataatcattatggccaacatcactctcccaccgaagtatacaaagaaacagtctcagaggatggtgtgtgtgtgtgtgtgcgtgcgtgtgtgtgtgtgttcacccacacctgggcatggcagggattgcatcctcagggcctggcatggagttggtattcattaaatattcactgaagtgaattaaataacaataacaaaacaaccttttgcttgtgaagtgtctagcattactcttgcatcttgggtcataatttggcaaatttccctccagcttgaaactgctgagatattttatactatagtacagtgaacccttaagattatggtttgtttttcaatgattcataaatctccaatcttgtttcatctgtaaactaaacttagtgtatctccatgacttttgtctcatctgtcccttttcgtagactcttttcctctgtgaagtctcctttctccttcctatatgatcctaactgcatcttatactcagtcttgttacaggacttaccacaccagactgtaatgcttctcaaggaaaacatcagagtgataggaactttgtcaagttagtattagttattttttattttatgtatataccctgcctcacaccatacacacaaagagctttgagacttatccaaatgtttactgtacaaaaaaaaaacaaaaaacaataattgaagaacccaggatgaaagaaaaatagagtgaacaatgctacataatcctgtacagaggttagaggtaggatctacgatttgtaggggccaaagcaagatagatactatgactttcaagataaaaataaactagttacgttatacttaaacaagagaattgttatcagcatcttcgactgctggaaaaaaaaataagtagccttggaaaagttaagtgcgccctgcccaatatcccatggcttgttttgttagaggaaaatactggtctcttgacttccagtgctgttgctgcactaccacactgaaactaaatacacagtgaaaattagttgctattatggcaatccctgggagaaacaaatacttattcccttgtgagggataggaagttaaactaagaacccaacacaaatgttctgtgaggcagtttagtagagctggaagatacgaaatgacctgatggcccctgaagaggaaacagtggtgcagcagcaaccttcagaggcacatgagatcctcattgccaggggggtcaaaaggccagaaaaatcatttctagaacattctacatgtatatacagtcttagaaaaagtggacccttaagtgctatactagactatgactgggaagataaattttttaaaatttcctaaggcacttctccagaagaaaacaaaaattaaggtcaggtctacctcagccagtaacagacttctgggcccctagattcatttatttggctctgctgactgtttggctcagttttcccttagcaagtgtaaaaaacacttaaacaccaccaccctgggatcctattcaaccaattcagatagctgtggccttttaactcacatccaagtgacttggctttataccaatatcatttcccctagtataggctaagcctaagtgagaaagtacacagctcagggagccaggagttaactggctgttctcattccaaaaaggcctggttcttttccttgataaggaaacaatattatatcaagaagttgcggtcattcagtattacatatcacactagatccatgactataaaaagagaattagtggaaataccaccatctattcttaaagcatctctccaaggagctttagataattgaaaatgttctcttccagcccaatcccttgggaaataaatagaggtgatttattaaaacttacattttacgtataagaaaataacaacaagaaaatcaattgcagagagtggcagaggatcttgagggtatcctctacttgctgaaccacacttcttccttagaattatataataaatacagaatatgtacatttacttgtgtatagctgcctgtgatttacctatagtaaggtcaaaagcattctatggacatggtcttccttgagcccttcttctgtgctgtcattttcctttgccagggaaatggtttctcaccatccctcccatggacacctatgtctggaaatgtctaaaacacttttcgaatagcaagttgctttctcctataccagcaagaaatttttgcaactccacctgtccctcaaagcaatgtggccacaataacctctgcaagtctgtctgcctatgctgtttctttttctaatacccaactaatttattgatttatattgtctttacgtctcctctggctttgcagtgtggcatgagtctcagagccagtgattacattacattcataagtatttggctggagttttaaaaaatgagagatggtagtggggatctggagggggatgatgcataatatacatggaactgtgaaaatgcgtaagataaaaattaaagaagtcttctttcctctaaagtaagatttaataaaatgagactctgacgaaagaaagctttattttggtgaaagacatcaaatggcatgtgtacaaaagacagaaactaaaagaaataggcagcagtgccccctgggttgcctgtcaagaagtgtgtcctgtacagtttctggagaaattaagaaatgcaaataacctgggcagattaacagcacccgaagataactagcaggatacaaacaaacagcacctttcactatgaggaggcgtattcctccaggcaaacaaagaaacaggacagagtcaacatctgtttcatataacagcttggctgctgacagaagaaaccttaaaaaaatggcttagctgacaatccacaaaaatcattcaatcactattgcatgggccgaagcaaacgagtaaatgaacacaacctgcactttctatattaccctaaaaaagttgtcttttctttataggaagaaaaaaattaaaatgaaaatgcaaacaaaaatcttcatgaactttccccttttgattgacaacaggcagcaatgaatactgaatcataaaagacagccagctgcttttcagctggtctttgcctttctcaatgtcaattgcgaagacaccactttcaaagagaacattgggtaaggatggtggctgggatggggcatggggagacaattcagatgtaacacattagaatattaagaggaagaaaacaagtcatttgacacacccagtcctggttacagaattcagttagggagtattatgatgtctgggtccttatcaataaataataacacaccaaacatgttaagaactaaaaatttccatctctggattctatcaattcacacatacaatttcaaaatcaagaggaaaacattcatgactgcatagaaacctgtttgtaaatttaagtactggacatttctaaaatgcaacattatcagagctgtgacatcactgcagtgtggacaactgctttcaactcagctaaatgccgtgacatcactgcagtgtggacaactgctttcaactcagctaaatgccagatgcttcacttactttcataatgcggttaaagtacataaggcaaatgcaaaatgaaagcaattaagaggcaatgatagaagagatttttcaggtgaaatgtgaaaacagaaggaaaggtgatgaggtggagcaggacaagatcatttgatattaacgcacgcacagtgccaaaactatgctaggtagctaaacagagactccagtgagggccttttcgagttgcttctcagtttaaacaggtgtaatatcttgtttaagtggaagagaggtatgaccacaaagagaaaaaaaaaatcaatacatgatttgcattatttctgaccttggaaaaaaggctttattgaaaggtgtcctttattgcacagaattgagaggcggcaaagtgagagtatgatcattataaaagcaaatcttccataatgtgagctataggccaagcaaattctcagtggttgacctgcatttactaatttagccctcacaaggattatatgacataggaactattattatctcactttacagataagggaacagagatacaagaaggtggtagacttgcctagaatcatacagaatttctgagctttgaaacaagtcactagaaggaaggaaaattctttaaagagtaatccatcagtccattcagcatccttgttaggtatcttgtacaatatccagaaaaataaaataatctagagcaagacaagcacagtaactaattaaaactaaaagagaaggaattgagattagcttcaccaaaaacctcctggataaaagactatataggaaaacaaaaagttcacgaagtaatactataaaatgtcctgcgtaggaatcaggactaatatccaggcttgctaataccttggatggtattagaaaaccccttcaggtgtgaaagggcctaaatggatatctgttctaggcctataagaagtaatagttgactttaagaagtcaagtatggaagagtttcctctggcacctcttacttggtttatgcaggaacagtgcttgttttgacactataaccaccacaactttctagaactgagcctggcatgtaatacatgctcagtaaatatttgctgaatgaatgaattacaaagaataaacgaataaaacagtgaaatgtttgtggaaagttttagatagtttggaaagtagaagtaagactttgattcagaaggtagtcttgaagaaatcaaaggagggaagcaggattacagaaccagaagtcagaaccataactgagcaagagtttgacttgaaagatctctaaataagagagtgtgagagagaaaatgaatgataaaagcaacagaaataattagagattaagtcctataaatgtctttgagcagagagcaaggtattcatgttttgtcaatatggtattttagggatgggcgcagtggcttatgtctgtaatctcagcactttgggaggctgagggcagatcatttgaggtcaggagttcgagaccagcctggccaacatggcgaaaccttgtctctactaaacatacaaaaattagcgacgtgcggtggctcatgcctgtaaacccagctactcgggaggctgaggcaggagaattacttgaacccatgaggcagaggttgcagtgagccgagattgcaccactgcattccatcctgggcaacggagcaagactctgtctcaaaaataaataaataaaaaataaaaaatggtgttttaccaacacactgttaaccaaaaaaaaaaaaaaaccaaaccaacatgtgaagacttcaaatcatgcaaataataatgatacaaacagcagcaaataacaggtgggagcacttctcttgtgccaggccctgggtaaagtgctgtaggtgtagagtgcactggttaggcacaagagctcagactgataccaacctccggctccaaatgaccacagtcaaatcatcatgtctggtgttatcttatctgtgagataataatagcatctactctctaggcatgaagttgcaaagactgagactgtgtaggggagagaaaagggaataagggcaaaacagaagaagaaaatttagagctccaatttcacaaaaagataggcataatcactgcagcctggagggtgtgacaggtagttgagaacaaggcattcttaaaatagcaaaatagaaatggcccaccaaaccactgggctagactatcactgtgtcataatttaccttgtacttctgcacttaatttttttccctttcatttcattattttcaaaattttcactaatttcctatttctcttttcatgaatgtctccatcactgaatgaggagttccctgaagatgagggctgtgcttagatctttcattctctgcccataggaccatgctagacccataattaattgtggtaaaatgatcaagtgaacagtaagaaaacaccacatgaaaagaaattgatgtgaatgagaattttaagaatttttcaggaaaaagatataaaaacactttcacaaaacagaaaattggtaagaggaaataataatttttataagtaatatatattcaacacatatatattcacacacaaacatatgtttgtgtgtgcaaacatatagtttgtcattaagatccccaaaagtgactttcactgagtgtaactccattattcattgtttcctcaccccatatcatttcttctaaatagataatgagcacaggtttatgcgcttccctattttgaagaagtgagaattttaacttaagactgggaaagagtgaagaagagccttggaactatctgaaatgggtagaggaaggacattagcagggagaacaggggccatgctgttctcctgaattaaccccaggataaggagaactacctgggcattcctcactaagaattcatcactgtcctggctcttaatctctatatttaccacctattttcttgaggtcctcccctgaattcagaatttttctctgattgacaatgtgattgaactctgattaacctgtcttctgagcaaccctccactggtgaataaaagcttcatatcttcacacattgatcataaaacatataactctctcctcccagaaattctcagtcaagcaactccctctcagacaacttgatttcagccagtcataattccccctaagtgcacatacaccttattttgggatgatccccttcatatctagcatacacgttaactcctaggaaagctacactttatacaggttagcctagcttttcatgtgttcctggttgagacataacctagtacctagcctcaaaaaatatttgaggaaatgacttagtgaatgagctgtcaagaagtcaactcccttaagtgcttgcccccgagcatgtgacacaggatacacaattggattctactcagaaagtcccctcttccttcagacactgtgtcaactggaaacagagctattaaagttgagaaagtaaaagaatctatgcataggctagaaatttgctcttcaatactaacacatgccaaaaacttatgtatcactagcctggaacgaatgtatctgctctgatccctgaggctctgccttttacctgcatctcttaacctcattacgaaataggtaccaactaaaacataaccaccaaatcctatggtatcctctccattgtaatttccatttcagcaactgtcagggaacagctctttcggcaaaattaaaccgtgcttgagaacagacctattcccaccttatgtacctctagtcccctaacttgatctttcattgtactgaattttgatggcacagagccaaccttacgaattccttggtgttcactttttttaaaactgtccacatacagttactgtttgtttcatccaagtaaacatcatatgtaataaatgtcttattaaccaaccaatagtttcttatacctggaaggtgttcaataaaagctttgtgtccaacctaaaaataaaatacttagtaacagccatatttaaaacccatataactctcaaaccatgcatttacaatgtgttctttgatttttaaatatccataagtaatattattgtcaccaaggaataatcagcagaagccacaaagcaaaaaagcatttttttataaaccatgcatctggaaattttaaataggagaaagattattttgtttcatttgaatgttctgccagctgcttgtatttcttttttgaattaaattaaattaaactaatttctagacgttaatttatcaatagtttctgagcaaccattgtatttaaggttttaagcatatggcatggttaatatgccatacatttatttttcttaaaagtacaattataatttaaaataccctaatagaacacagtcttttaaaaactttgcatagaaaaattattataagaacattcatgttttataatttttggagtcaaaatgacaaaaccaaatgtcttaaagaaaaatcggaatttattgatcatggttgttttatatattaatgctataaagctaaaagtgaatatgaaattgactggcagaagcgaacctgtcctacacatagcgaactgaaaacagacacctgaaaagatcagccagttttttattagataaaaataagaaggtaccaaacgctattaaaatggcgtaaagttggtgttacaatctcatcgagctaaaaataggtcacagttagaatgaccttaagggaaaataaacaaaacaaaacaaaacaaggtaaggccaatatcacaaagtgattaaagagatggaagataactctctcctaagtcattaaactcaccgatatcatactgaactccagagcacttagtattttcatgcgccattagagaatttagtgggttcactgaattgactgatttctttgttaatctatttacatgggttaagaccctgactaacataaaacacaaccaaaaaatgccagacagagagtgtaatgaaagactgagtgatgtatggtttggggtacagcctatccgataaatgtgcttggccagcaaagaacccattggcaaagatttattatcggaacaaatacattctaaaaagatctaatacaataaaacctgcagtataaacacaaactactctaaaatacaaatcttttccccgaatagttgatctttcaatgatattaaaattctcttcatatgttttattcaagaattttttgaacaagtaaaaccaatgagctgtataaattgccaataatagtgtaattctttgattcattcaaaaaacccccaaagtttatgttacttagaactcttcaacaatttttaaaacatacgaagagaaggaaatatttctaggaaatatattatcaagataaaaatgaaccacctactaaaataagttatcattatgtttgaattacatataatacattattaccaaattcataaaagttaagggcagacatagaaatgatttgaaatgttatacctccaagttcttttacattcaagatggcattctggaatggcactgctttaatactaaaacctaaaattagaaaacaaaaacataaaaaaagaattagcaacttttaaattaaaacacttaggatgctcaaattgtctctttttaggctggttaagatttatttactttttgtagctgatatttatactagaaacacataatttccaaggtaaactgataactgaatattatcttctgccattatcaaaacatagttgttgtggctgggcacagtggctcacacctgtaatcccaacactttgggaagccaaggcgggcagatcacgaggtcaagagatcaagaccatcctgggcaacatggtgaaaccccgtttctactaaaaatacaaaaattagctgggtgtggtggcacacgcctgtaatcccagctactcgggaggctgaggcaggagaatcacttgaacctgggaggcagaggttgcagtaagctgagatcgggccactgcactccagcctggtgacacgccgagactccatttcaaaaacaaacaaacaaacaagcaaaaaacatagttgtgtattacggcaatatataacactatcccctttacttcaaaatattgccttattctttaatttaatatgtaatgtcactctgcaacttttatcagatataagaaagacatttgaaagtatagagaaatttcaaagaaaatattaaatctatgaggacctctgcatctaactttaattcttaaagttaatgtcttataattctttctcacatataactcagcaaccctagaaattaaggtacttaaattataaccatttcatattagaattacatagtatttatgttagtgtcttctttaaaggacatggttaatatgtcatgtatctatttttcttaaaagtacaatcataattatccacttatgcataggcaatcattttataatacatgtaatacaagttttatattataagaaaatattcagagtatacagttctatgattaactatatatttatgacttaactattaccattcaagacaataaattcaactgtgacatatgcaagtgtgtatatacccattcacacacacacacacacacacacgcacacacacacatgcaaatatacacacagattctttctgaaaggatccacaagaaaccagagctaatgactctcaggaaaactgggaatctggaaattttaaataggaggaagattcttttgtttcatttgaatgttttgccatgtacttatatttcttttttgaattaaaagccctatgaatttctaggagttaatgtatcaatagtttctgagcaaccattctacttaaggtttttaagcattatttaatatgtataattttaagattaaaaaagtttctttttcaagaatttatcaacaaagaagacaaattatgagtctttgaggtaagttatgaaaaaatatataaagtattacatggataaaaacaattctttcaaatgggtttgttttgctttataaagaaggaaatcattacacaccttcttagtctagcctatcttttgcacttctttgctgcatgttatcccagtactttaataagctgtacattaccttccacctaaagcagtacatagtatataatgtttgaagaactgactttggagtcagacagaactaggttgaaattctagctctgtcccttattagctctgtgaatgtgggcaacctactagccttgctcgactttctcatctgtaaaacagggatgataatatctacttcatagggttgttataaggataagataatgtatgtgttatgtttatcacagtgcctggtacaccataagcatataatatacgattgctggcattatgtttccattgatgctttttcgttgatgattcaatcattaggtatacatattttctgcctgcctgaatataattacaaacttgattctgggtgctcacttattaatctaagtatgtagttggagatgtaaaagttaccattgaatgaaaagtacttttgttggagtgacgaagatgtcaacagctgaagtctgctgcacagaaaggatggaaaatgttcattgggccctctaacaatcttctaaaacataccccttcctttgtgggcttaatgcagattgacacagtcagcacagcattatggttaatggtgcatgaagtcactgaatcctagtaaatgagcaggaggaaagaggaggcagtcccatgtggctgaaacactggcatgtacctgagcctgcaggaaagcctctccaggtgtctggcctctgggaaattaaggaaagtcagtgccaatcataatattcctgctggcacagaaattcacctgcaggagacttggatgcctgaatgtatctacctacctcacacgggtgttatatggattaaaaagcaatgatggtgaaatcctgaaaatgaaaagctctctgcaaatattaagcagtctattagtggttatgctcaggacaactcaagtgtagattttctagagaagtaagacaggcacaggcctcaactttgaaaaggaaatggttatggagcacatcaccaatgtttaatctgctttgattcttaaaagctgacaatacgcaggctctcaaagggaagtaatatccttccagaaattgctgcacctatgtgcaaaatacaacttttgaaatttattaacccaacaggcagattatgtcactgttattgtctttaaattcttgcaaagtcttcataagttgactactaaaacgtcttcaaaagttcacactaagcaaagtatcctagcaatgttattttattattttattttttttgagatggagtctcgctctgtcacccaggctggggtacagtggcgtggtctcggctcactgcaacctccatctcccgggttcacgccattctcctgcctcagcctcctgagtagccgggactacaggcacccaccaccacgcccagctaatgttttgtatttttagtagagatggggtttcaccatgttagccagcatggtctcgatctcctgacctcgtgatctacccgcctcggcctcccaaagtgctgggattacaggcacgagcctccgcacccagccccctaacaatattatttataggcatataaatgtcccgacaaaatagtcgtaaatgttttctccaaatagaacttgtgtggttagatttatactgcaaaggtatacacagtcatccatgttgctgtctccatattatttttacggtttagcttcagtaattaatgttcaaaagacaaagtctagatagactgattagtccagaaaataagaaaatgtactatttacagaagagaaacaatgttttttctattttagtcattctaaacatttgaaaggattaaatggaactaaaaatctaaagtcatactttcagttcaccagaaggacaaccaagaagggaaattattagacttttttttccctttacatcaggttggatgaggccaagggggagaattaatataatatttaggagggataccaaaggtcaaaccatcaaaatacctttctcaaagggttgctttgaggaataaaagctaccagacagcatttgctctagagaaagaaagtctaggttcaaactcttcctattccatttattaactgtttgactttgagcaagctaactttgttagggaagcattctctggtgtcctcgaactagactgatttttctgagtccatgtttttccagtattcagtacccctcctaggtgattttcacaattgtaactacatatcggttgatttgttttatatttgttctctggctagactgcaaggatccataatgaagaaacaagctacactgtattctgtaggtcagtgcttggcatacaataggatctcaatatgctaagtattaatatctatttcctaatttagctgctataacaatcctaaagttggtatcagtactactgtcccaagaagaaagtgaagtgccaggcacggtggctcacgcctgtaatcccagcactttgggaggccgaggcgggtggatcacgaggtcaggagtttgagaccagcctggccaagatggtgaaaccccgtctctactaaaaatacaaaaattagctgggcgtggtggcagatgcctgtaatcccagctacttgggaggctgaggcaggagaatcgcttgaacccgggaggcagaggttacagtgagccgagatcaggccactgcactttagcttaggtgacagagcaagactctgtctcaaaaaaagtactaagtgctatattcgaaacttaaaaccaggtctcatcaccagagccctacactacactgtagtgtctcctccatataccaacaaactgagggattcacagcattttgtccaattttgagcctaaatactggtaaagtcaactgaccaaaatacacacgtgcctaataaatgcactaatttactgtcctccctgtttataaataacccaacacctaataaacccactaattcattgtcctcctgtttataaataacccaacacaagaaacccaaataagggttttcaggtctatatgccattgctttcttattaatgaaataaaaataatagcatgagtttagaaggtacattttgtagaaataattaataaaatcaggaacttaggaggggagggaaaaagtgttcaactgactcatccatgacagtgtaactactctcttgcttcttcaaacaggaagtgtcctctgatgccatcttcagggtgtcagtgtgctaacgtgacaagggactatcctaggagtccgaagcacagctcttagactcaccagccacatttttgtcttgccttggccttgaattcctcatgtgcaaaatgaggactaaattagctctttgagatgtcctctaaaattagcattccattatttatattaaacaaggagaaggaaataaaagtaaccactgagtcaatcatcaatggcctgtagtatttggctgaaggcttcacggttaagtctccccaggctccattcaaacaatttgatggctgaagcctaagttacgcagtcattttttcctggcctatctaagctacattagtaagactgaaacctcccctaagatttaaccccacaaatttttaataaatatatgacttagtaactctttggggaaataattgtttgcatagcctttcagtctttgttttgcagtccttaaatccaacaaaacctgtgagacaagaaagatgaatttgaagtttttcatgcactgaaagcattcctggaattgtaacaaaattagttttgggaggaaggttagtctatttttattcattgtgtggaacacacaagtatttcacttggacctacagactaaaccctcctccccttccctcaagtctgagtgcacgcacacagatacttgtgtgcttctgaaattcctgggtcactctaagaattgctgaagggaaagacattctacagatctggtggctttgacctgcaccaagggcatgatttatgccacagcagttttgtgatgtttggacaacagactaacgaaattcttctaactatgatttcaacatcataaaaggaaatttaatgtactggcatttataaaacacaatcctttaaaagatatcaaaatctgactttctaacttgtttctcttgttggcttaacacatttgaagctaatactgaagttatttaaatgtcttcttcaaattttcatgaacattttcaatctttttcaaatatggtatatatccctagaagatgttttcaacctttttcaattcaaagtgttcagttttctctaggttattctccatgtaccatcaatatattctcctaagcctttagattccattcctctgcttcaaaaaaaaaagtgaacatttatgtaatctacagtttaacaacccctcttatcaacaaattcctcatacatatacagtaaaggaattcagtctggatagagttcacttttatttctagactaaggtgcaaattactcaaattttctctcctcaccaacaggtcctgctctctggaggatttcttggctctttgagttttgacaatttaagtatcttttaaaaattatgtcagaggtgaaaaattgctgaagttaataaaccaataaagtttgaattctctttctgaagaaaaggcagacattctcgccttgctgaaattaaacgaacacatccttctcatatgttttcattttaagaaaccaactctgaaggtagattctcttttcgaatgttcaaaactcttcaataaatattgcatttttaattggctttatattttcaagacattatagagaaataatttaaaagaataaaggttttacccataattcaatcacatcaataaagtacactgttattcttatagtttttctctagttttttaattcaaatgcatagttttccatggtttaaattcaaaaaataaatgtaaatctaatttttaatttttaaatagaagactgtatatattcttctaatctataatcattttgatcaagttaccataatgtaattaacaaactcccttgttgtatggcatttaaactaccttaaagttttagttgcaatacaaaatgttgcaagaaattgctttatgcatatagtttcccttaagttacttacttaaaataaattgccagtggcataattactaggtctgtgaacattttcataacttttgatttatatgaacaactgctttctaagaaaaatgctttccaaaaaaaagggatatcataacagtcataatgtaacaatcataatgtcacctgtaatacatgtgcataccaatgccactacaatcttaccagcactgactcgtctcataaagaaacagattttggtaaatttaagtataaaactaacgtttacttatctattctctagtaaagttaaacttctggtaaagttgaaacttttccattaatttgtttgccatttattctttttatgaattatctctttatagacttggcacagtttatctgttagattctagatgttatttgtaagtgtggttgaattctctaagagggacagccatatgcttatctgtaatatctgatgcaaatacttccaacagtatttttttatatttatcttaattttagatttccaatggttttaaatttttatatagttaagttccttgatccttcccttgtgaatgattcactggaggcctagtccagctattctgccatcttccacactgaagtctacatacacatgtggatttctgacttcctcaattcttttccaagttacctttattactattggagtttgctgtttatttcagtaccctccttccaccccctttgttcttctttacttacacacacacatacacacacacacacacacacacacacagagagagatacacacctgctatgaacaaccaaaagaattctggacctgggcagtaagtttgaagatgtcagcaatgcctacctcaaactccagcactgaacagttgtggatccccgataactaaagtcagcctgtgggacctcctctgctgcctattcgccaacccttctctaccatcagtaacttgtttctacaacatcttgccctcctttcactataatgaacacacaggtccaaacaccaagcatctaccccttttctcctacatcattacttcctgcctcccatggccaactcagcctcacctttatcattacagagccttctcagtgaatcatattgaaccttatctttcttaagaagtcttctccatgctccagcatttccctgcacattttttcttcctccatacactagcaaacagagcttttccttctcttatcagcgcctctcagcacaaactttgcttccttctacgcttttagaacacttcatcatagccacttgttaataacatcctacctgagttatgacgtttacttatatatggacctctgcattcccacctaccaattttcagggattttgttcatctatctgaatgaactcaatatttggctaacagttgtccaccacaccctatctgcttctattcttatgggcaacattcttaaaactaatagccagagctatcctctaagtttctgatagtttttcagatctctaaaactatcagctctaattcatatcaaccatctccagtttatagcaaagagttgtcgattcaattaaattttctactttaacaatcatgccatcagcaagtacgtttttatttattctttcacaaaatgaaagcattttatttatttttcttgcctgatttactggctagaatctctaccacaatgttgaatagatgtggtgagaacagacatccatgtcttattcctgatctgatcaggaaacaattcagtctttctccattaactctgacaacagctgtagggttttcacagatgccctttaacagttgaggtaattcctttctagtcctactttgttaatagcttttgtcaaaaattgatgctgagttttttttgtttttgttttttgcatatcttcacaggatcatagtttcatcttttggtttattgatattgtgaataaactgattgatttttgaatgtgcaaccaactctgcattcctagaataaatgtcacatgttcatgacatattatcctattaaaatattattgttgaatttaatttggtatatttttgcttataatttttgtatctgtgtccatgagggctattggtatgaagcttttttttttttttttttttttttttttttttttttttgtaatgtctctgtgtggttttggtatcagcttcatgctggtcttaggagttggggcatttttccctcctcttcaattttctggaagagactaaagaattggcagtatttcttccttaaaatgtttggtaggattcactagtgaaaccaactagacttaaaaaaagaaagaaaaggtatcaatttcttaaacagatataggtctatccaggttttctatttcttcttgagtgagatttgatggtttgtccttcaaggaaattgtccattttctctaagttgtcagatttactggcataaggttgttcatgatattcccttattaacctcttactatttatagaatctatattgatgtcacctttcttattcctgatattggttatttgtgtcttttttattttttctgatcagtttggctagagttttaccagttttactgactttctcaaagaactagcttttggttttactaattttctctatggctcttctatttcattgatttctactttgatctttattttcttctgcttatttgggtttaatccatttttcttccagttccctaaggtggaagctgaggtcattgatttgaggcccttcttttctgaatagacatttagtggtataaacttttcttaaagtcccgttttataggcaccacaaattctaatatgttgcattgtcattcagtgcaaaatcctttataatttctcttttgctaccttctttgattcgtgggtcatttagaagtaagtgagtttgtaaatacttgagattttttttttcttcttgttattgatttttaatgcaattctatcacggtctaagaacatattggatataacttgaagccacttaaacttatttagatttgctttcataaaccaggttatggcctaatttggcaaatattctatgtgtacttgaaaagaatgtcttctgttgttgggtggagtattttataaaatgttaatcaggtcaagttagctgttagtgttgttgaagtctgctacgtactggctgattttcttcccacatgatctataaagtattgagagaaactgacgtcgctgattgtaattgtgggtttgtacatttctttttgcagttctgtcatttttttgtttcatatatttttaagttctgttaggtacataaatgtgtagaattattacagtctcctgaataaatgatcccttcatcattatgaacttctttatccccagccttattcattgctctgaaatctacattgtctaatattaacatagctaccccaactttcttttgactagtgttagcatgatgtatctttttccacctttgtatatttaatctatttgtgtctttatacttaaagtttgattcttaaagtcagtatttggttgggtcttggtttttaaaaaaatctattatatcaacctctgtctcttaattaaggagtctagatcatttatatttaatattattattgatgtttaggtttgactgtatcacctttctacttgtttcctatttgtttcatctattcttgttccccttttcttctttttctgccttcttttggattatttttgataattctattttcatctcatttgttgctttatgggctctcatcctttgttttgttattttattggttactttagggtttacagtaaatctttaatcagtctaccttcaagtgttattatacgacttcacatatagtacaagaatcttccaatagtgtacttccctttttccccatgacctttgtgctattgttctcaggcattttacttttacatatgttgttaaccccataatatgtgcttattattgttgtttaaagacatacctcttaaagatatttaaataataagaagtaaatattatataattatccacataatttgcatttctggcagtctccattttatatagatccagatttccatctggtatcattttttttctgactcaaggacttcttttaacatttcttataatgcttatctgctagcaataaattccttcagattttgtatgtctgaaaaagtctagtctttatttttactttctttttaaaagagacttttgctggatattagttgacagttttttccctttcagatgctgctccaatgtcttcttacttgcatttttccagtgaaaaaatgtgatgccatccttatttttattcttactcatgtaacatcttttatctgcttttaaggtattttctttgtactactttgttctcaagagaaaaaaaaaaccaaaaggatgtgtgtttatatgcatatttatatgtatgtataggtgcatgtatggatataaatatatacctttgtttatatatatatatataaatagagacagagaaatactttaagaaattggctcacacaattacagttgctataaacccaaaatctacagtttgggctggcaggctggagacccaggaaagaatcaatacgcagttcaagtccaaaggccatttactgaagaattccctcttgttccagggaggcaagtcttttattctattcaggccttcaactggctggatgaggccaaaccacattatggaggacaatctgtcaaaatccgcagatttaagtattaagttcatcccaaactacccttatagaaatatccagactaatgtctgactacatatttgggcactgggacccagccagttacacacaaaattaaacatcatattctttatcaccggttttgaacaattttattatgatgtgccttggtatagttatattcacgtttctttctctctctctctttttttcccccacaagagatggggtctctctctctgtcacccaggttggagtaaagcagtgtgatcacagctcattgcagcctcaaactcctgggatcaagcaatcctcctacttctgcctcacaagtagctgggactacaggcaagcaccaacacatgcagctaatttatttatttatttatttgtagagatgggggtcttactatgttgcccaagctggtgtcaaattcctggcctcaagtgatacttccgcctcagcttctcaaagtattgggattacaagtgtgagccactgtgcccagccttgctcatgttccttttgtttggggttcagtgagcttcttggatctgtaggtgtagagttttcttcatgttcaacaatgtttcagccattatttcttcaaatatttttctgtccctttccactcaccttcatggactcaaattaccctagcttaggtttaaagttgtcccatagctcgctggatgctctttgcatttttttctctctcagattgtctctatgaacagatacaatacagtgataataacagttttaatgtccccctttgctacttctaatatttacatcagttctgggtcagttccaattcgatgattattctcattatgaatcatgatttctggcctcttcccatccctgataatctttgactgactggcagacattgtgaattttaccttgttgagtgatgaatattttttctttaaatcctatacagctttgtgctgagatgcattacattaccagacaaccatctgaggttttgggacttgctaatattatctgtcatgtgagtccagagtggtactccacttacggctgaccttgccaagtactctacccagttccttgtgagttataagtttttcagtccatctggtgattacaggcatagttttcaaccctgtatgaacaccaaccactgttccctctagtcctttaagatggttcttgccctggccttgggaagtttcctcacatgcatgcattgaatattttgctggatactcaagggagactctgaaaatctttagtgttctctctctgtacaactcttttctctggtattctattctatgaacattagccatcttggtctccccttgctctcggcttcatctcctcaatgcagggagttcactgagctccacctcagctccctctggaactgtgccacagcctggaaactctcaaggcattaagctgggacaatcacagagcacatctcatttgtttctcatttctcagggataactgcgtttcctggcttgaaaattgttgctttgtatatttcatgagctggttgctgttgttgttcttcttcttttagatgggagagtaaactagttccagttattccatcttaccagaacaagaagtcctcactcatccttgtgctcactgccctctcttgagcatattcagtcttgccttttcccctgatgaccaccctaaacctctgactactagcatgctcaagagaccttttcttatagaaacaaattctcttagcactattttctctttttctgtccaccttcttgaaagaactgtctatattccaaagagttaaggagtgaaaacgatggtctacccctcaattcctttgcttgctcttcatcccctcaattctcaggttggtttccacctcaatactctactgaaactgtttctaccattagttattaattaccacgttgtcaccacatccaatggcctttctcagactttagacttacgtttaccttatttgactggttcttttgatttcttgcccatatttgacttaaaggatattatatagaactgtctgacctatattccttatcaaaagcagatgctgtaatgtaagctccaaagagcagggttgtttgtatattttgttaactgatatatcctcagtccttaaatcagtggcagtcacataacagacattcaatgaatgtggaatgaattaacaaaatataattggtgcttagcacctttcttcccgctttctacccattacccctggacaagctcatccaaatctatgactgagttgtctctcaaatctctctagtctgcttggcttttagcatttggatcactgttggatgtcttgtcaaacctcaaaatcagcatgccccaaactaaactcattatttttatcttaaaactctgtcacattctccctactttttttttttttaacaattcaccaaaacataaagctataaacttgactcatatttgattgttttatcttcctttcctcttgaatacccagcataactgtcacttttacagtagcagtaacatccccacaagtattgtccctgctggatcacctctacatctaacaggtctcccccaacagcttctctaagtctctagccttagatcccaacatcccctaaatctctgcatgctgtgccttaacccagtaagaccactaatctttctctgaatatacctatgctttctatccctaactctcctcaccccattcctctctgcttagaccttacccatcatatgagaccctactcaaatgtaaccttaactatgagctttctttgaccctccagattagaaatgatcactctcctcttttaactttcatatttacaccattaatataacacatatcacattctgtcttagcacagagcctggagtatattaaataagcaatatatgtgaactgtttttatcaatacacaacttatcttcctaacctgggtgtaaacttcttgatggcagcttcctccaaagaggcctccaaaaagacattatgccaggttcagaacaatgacaactcaaagaagcttgatatccaaaaaattagccaacctaacaactaattcatcagaaaatagactagtgcacaattctggtaaaacgtattattaaaaaatttcataaaaacaaacacaaaacataacttacaagtaagaaaattatatacagataatcttttacactataattcaaaactgctcctctagcaatagtgctagaagataactctgataagtgaagaaaagcatactttgtgttactcttacacatattttagaagctattttgattgaaaagacttaagctaataaagtttatataacttcattgcacattactcaaaagatattcacagttttataaacaaccaataaagtacctacttccaccagaaatcctaaaccttggataccactaaacttcacttgaacacctgaactggcatcctatctctagctatgtaacaatagccatgtcaccatacctttgatcttcaggtaatttagaaacagaatatggaaaaagattcctacctgtcatataagggctgttataaggctaacagaagactatatagattcaatttactttcatttgcttattaacagacatctgtatccatgcctaaaccttgtgacagactctgggtatacaataccacatatgatgctctagctgcccttaagagattctaacccaagatggggagatgggcacatacataaagcagtgctacaggcactaactgggagaaatacggacaacgcccagtggggagaggagggagtactcagttctgtccaaggagaaaagaaggtagtcagaaacagcttcctgcaaagaggctacacatgagctctgctaatcttctctggggtctctactcattacaatccccttatcctttccctcatcctaaaatcaagcaatgtctctaaccctttaacagctccacagtttcttatctcaattctaaaatctgaaaagctctcaaaacctgcacttttttaaaacttacttgccggcaaaagctgacgtgaactgaagtaaggttcttgatcaacaatatcctttctactttttgtaggaaatcctagttaataattccatcatccaaccatcacgtaagccaggaattgagacagccatggctttctcactctcaccctccaaacccaactacactaggctttgtcaattctagctctcaaatatatatcctacctattccttcctcttcttccccctgtaactgcctcagccaaggccttcatcatctcagttgcaccatcacagtaatcttctgcctccgcctccaactgcgctactcacaatttagcctccacatcatggccagcttgattcttctcaaatggacatctgatcatgtagtttccttgcttaaaatactctgatgtctctgcactatctacacgaaaagcccaaactcctgagcacagtatgaaaggtctgctaagattcagccaccactgaatacaatttgtctcctggcactctattaaacatacactgcagccacacacaaatgcagtttctaggagttgccaatctgtttgacactccttaccttcacactgcccctctgctcctaagtcctctttcttttccaccccctcaccttatttcttgtaccagacctacttatcaacctcaaatctaatgtagcaaaccaaatcatgcatccttcccttccccaggtccaggcaacactgtcatgccccttccttccatgccccatctatttctggatatgaacttaatgtttatgcagccagtatactgagactcctggaatgctgaaatcatcgcttatctcatgtctaacactggacctagcacatagtaggtgctcaaaataagctggctgatgaacaatcttttcaactttccagaaaacatctcacccttctccttccttctcagctctctctgcacagcagctctgttctctatctcttacagctgttcttccattatttcctcttatactcttctttccttcttcattgtcagaagagaaagaggacacatttgggaagtgaagaaaaaccctagccaggatttctcactaataacttgacactgaaaacattttgggcctgataactctttgctgtgggggctgccctgtacattgaaggatgtttagtagcaccactggcctctatccaccagaagccagtaatacccctccccacaaatgactccaaaatgtcccactcagaggcataatctcccctgattgagaaccactgccctagactgactttgcttggctccatcaggaagcaataggggaaggctgatgcatgatctcttgcactgactttcctccaggtgaaaaatgacaaggaaagaagattcagactacatcagtttactattcagggagtgtgtggccaagaaacataggctggagtgacacttcaaggaaggaaagtactctatgggcccaagatgaatccattttgtcatatatcagagttccagatttcaggattcatttgtattaatattttcccaagcttcatttattcagtgccactgaaatgacctgctagagggatataggatacagcaatttaatgctattaaattcatttcaaatcttttttgaaaaagagatagtgtttaaaattaaaataaactgattaaagcattaaactataagtagaagggaggggataaattgcacaggaaactaggacatcttgggatgagaaagaagaagggacagaaccccagcacagtacccacctgtggtcgacacgacgttatcggggctttcactgcagagtttggacaacagactggttttgccagaacctgtgaggcctatgcaaaccaggtcatattctggtcgtgcaggtggtggtcccttgcagcaaagtgctctaaaacactgccaaaagaaggggaaaaaaatgttcctttaaatgacagtatggaaataaaccatagtcacatttaaaatgactgagtaagtattaagaggtaattgaataaagtattacctataaggaagaaaacggtaactttagaacagtgaaacctggagacaccactctagccaagtgatcaaagttaacattcttagttatgaaatgtttttctacttcatgcctcccttcctgctatggcaggtgcactgcaaaaagcatgacatcatcccacagcttgcctgccaaaaccacacaatctgaatctaagcatgaggaaaccagataaagccaatctaaggagtattccataaggcaactggcctgttctcctccaaaatatcaatgtcttaaaagtcaaagaaagactgaggaactgttccatgttaaagaagactaaaaagacataataataaaatgcaatatatcttggactggatcctagatcaaaaggggaaaaaaaaagccataaatgacattattgagacaataagtgaacactgaatatagactgcatattagataagagtactgtataaggttaaatttcctgaatttaatcaatgtactgtggttatgtaagaaaaatcattgttctgagaaaatattctaattatttataatacctctaagtatttagaggtgaagggtcttgatgtccacaattaactggctcagaaaaatctaaatctccagctccatctttatctggtgaggagagtgacaaagccaacatggcaaaatgttaatgactagtgatgctgagtaaagagaatagaggaaaactccttgttctggtcttaccactgatattatttcaaaatacaaaaatttttaaaatcattaaatagagtctctatacataccactgcctttctggcctttgctaaattctttttcaggtcaatcaaccagggtactatgaactgtagtatagtttgctctgcaagagttaaagacaaggggatctgggccaggcacagtggctcaggcctgtaatcccagcactttgggaccagtctggccaatgtggtgaaacccagtctgtactaaaaatacaaaaagaaattagccaggcatggtggcaggcacctgtaattccagctactcaggggactgaggcaggagaatcacttgaatctgggtggcagaggttgcagtgagccaaggtcacactattgcactccagcctgggcaaaaagagcgagactccatctcagaaaaaaaaaaaaaagaaaagaaaagaaagaaagaaagaaaaacaagaggatttgggagacagggtatcatttgtgcagcttttgatctttctacttatcccatatccataggggccaactatgtgccagcttatagagcctgaaacatttagaccctgaatgattcatgagagaaagagggaaagggggagacagggaggaaagaaggcagatccactcacttttgggtcatctggagattacgagagaagagacctataaaaaagcctgtgttgattcatctcactcagataaaatctgagtactaattggctgtcatactctcgtaaatcaaacttgattatttctctccctcatttctcacatctaatcaacaaatctagttcatatgacctctgaagtagctctaggatctgtccacttctgtccagcccaggccatcatcacctgaacaacatcaatatcctcccactagttccagtatatttgctcttgtgccccctattctccacattgcagtgactggattgcttataaagagaaaatctgaccatacgtgcttaagccaccccagtgactttgcccagctctcgagcccaaacccttaccatggtctaccccacactccatgatctgctccagccaagctcaccagcctcattgccctcactcccctacatcctccagccatgccctctcttacctcaactgaggcatctaatatgctgttccttcttcccccaattctggacttagccaacacctcatcatttttaggtctcaacttaatcatcccatcctcagggcagtctgctccaatcctaagattgtgttagcaattcacgtccagctctactgggcttttataaattcattacacagacaattgcagtttcttattcatcaccagcctgtgagaaccatgtctgtcccccttcatctcagtactcccagtgtctagcagagaacatggcatagaatctaccctcagcagataattgttgaatgaagaatgaacgacacttaaattttacctaagcaaagaaaaaagaaaacatagagactaacaggatgcttgatctatgttctctgagccctccacgcttcaagaaaatactgtcaaaataagaaaccgctgactttttcacttcgcttcaatgccattagttagcctagttcccaaaagagtggttttggtgtacaggatcaactttcttggtaaattagagcttctttttgtcctaaattcacttttcctctgttctcaagaggttctgcctgcttctggtaaacaattctatgacccatattcttcatgggtttattcatgctaattgtatttcctctcagtcttttcaagcctgaggagtcctacttatttcagtctgtcttcatcctatgagatgttcttctctgatcttcctttagttccagcacaccctctcccacaagattaatgaccataactactaacagcattctaaacgccaacacatcacttcatggattcatatgaaggctggctgatactgtctgactttaacaagcttttttataaagtctgtctcccagactcagaatgagagtttttctcagagataggtttatttgtgtatgtgtctgttccctcaaagatggccatggctagcagctgttcagacttagaagtggtcttccacattcaattaggacagacaacaaaactagtcacacagtttcttttactgggctgcgttggtcttgtttggggttcaaggaggagagatcccattcctgccctagaggccttcattctcactcagctccttgccagaattcctctggactatctcctggaggagggctggcctgactaccctggcccaaactatcataaaccttaaatatcaaatgaaactgtatgtgaatgattgctagagcatccggtttaaattattcatgtcgttatcactcatatttttgccaaacactccagaatttcatcttcatgttctttttaaaatccagagtagaaaaactttgtagccaactccattaatatctattttacctgtttattctaggtcacctaagccacttctgacataaaagatgattttgcaatgatagcagtgatattctactccactgtcttttctcttctttctttctttcttttttttttttcagacagagtttcactcttgttgcccgggctggagtgcaatggcacaatctcggctcacagcaacctccacctcccgggttcaagtgattctcgtgcctcggcttcctgagtagctgggattacaggtatgcgccaccacacccagctaatttttgtatttttagtagagacggggtttcaccatgttggccaggctggtcttgaactctcgacttcaggtgatccactcacctcagcctcccaaagtgctgggattacaggtgtgagccaccatgcccagccttctcttctctttctttttctctcttttttttttttttaagacagtctgtctctgtcactcaggctggagtgcagtggtgcaatctccactcactgcaacctccaaatcccaggctcaagcaatcctcccacctcagcctcccgagtagctgggattacaagtgtgcaccaccacacccagctaatttttgtatctttgtagagatggggtttcaccatgttgctcaggctggtctccatctcctgagctcaggtgatccactcaccccggctgcccaaagtgctgagattacacacgtgagccactgagcctggtctctcttccctttttatattctcaccagtgatatcatctccagtcccatggtttcaatcatataaccgaatgtcataaggacatccaacatgacatctccccctccgtctccccaagctctttctctaagtccaggctctatagttccagctgttctataagaacccaaaccaaaactgaataaaacaaaagcctccccacaaaaccacaggctgtggaaataaggttctttggaacttaatggctagattgatagttattacaaggcaaaatctttgacataaatcacagactcttagaaatcaacatgtatttgaactgactgaataaatcatcctatgggtaacaggaatagtgtcagattttgagtcaacaagataaaactttcaacagtatgctacttccaatggggaaggaatggtcatgttttctgagtcagttcctaaaaactgtaaagagttttcatttgttttttgttttaaaacttaatgaagctttggatcctatagtcaatttacttaaaattactcattttggcctctagactatactgtaccaaagttcattgtgtgtgtctcctacagcagctcttgcattgttaagagtaagcccctttcactgttgtacaatgcgaaacacaatgctgtcggcagtcctgacagcaagcggcaaactcaggcctcattcccaggccaaacactaaggcattgtgtaactctgttcaagcctcataaacctatccatgcttcagtttccccacgattaaccagtaacattttaacactctctgccgcttcctttcttcaggaggatgttatgaggcctgggtgcaatacatcatgctactaagaaaggcgccatacaggtaaataactgctcattgcgattttcatttttccaaggtatcttaagtgacagttagcttccttagacaagggcctggccacccaatatacagcccagactgtagtacttccaacagcccacagcagcctccacatgctccattctatcccagttcagcccaagacactaaacacacacaacctgtccccactcccctggtagcagcaaatagagaacagagccagtctgaatataagtataccctcttggggggccaaccaaggtcatggtctccactgcctagactgcttcagctcacaggccttttcacacgggacaagttatgacttggtcttttttaaaagaacccagtgtatctactatattatgtcaggacacaggatgtttccccattctgtgtacccacaaacttctagtgctgtatttgaggaaatggtgtgcctaggtcttgagagagggcaaagaccagaatcaccagtaataactgactatatcgtagactttggacaaatcatgtaatcatataatcaacagctgaaataatggattagcttgaaagcagaagcaaaccccttagaaatatgtgcttaaaaaggaaggtgactacaaatattggaaagaaaagaaagcaaaagataaaattactagagtaaaataaggacttgcatttcagtctgatgacctagcaccaaggcagcaagattatcttaaaatgttcccatttctgtttggaacagaaataaggtatttatttccccaacagtgccagacattttgtaggtctagcagagcactgtacacaatcagtacttgatgaataacccctcatgtcaacattgcaaagcactaatcaagcatttaattgtacatttcattttcctctatatttctaccttaatgactccggccaccctccaaatcaccactattccttcacatggtctgagcacttaacgtttctatgccaccctgttcctgtgcacacagaataaaagttcctccccactttcctacttggcaaactcctgctcaaagttctgtttaaagggcacctcctctgagaagtgttcaattccctcagagagaaataatcctttcttccacttcttggtcctgtacagactagcactacagttaatactatgacacatgtattcttttctaagattcactggctgatagaaatatgcacacagacacaaagacatatccattcttggtcctattataggttcaaaaagcttaatcttacagctaccaaggggtggccaggcaccaaaacagaacagcaaagttgtcctacaaatatgtgttactagacgagaatctagctcaaaatcctcccactttggcactggcccctgcattgccagtgtttcctaccatcctgtttcgctaaattcccagccctttgggacatggcatttgtttcaattgatgctctgtttttcatcatgaatacatgattttattctgagcatgatttcaatttgattgaagctctgtatagttgctggaaacttttcttcagtcggctttgggacttctccacagccagactacccaagccccacactgttcccttctcatttcaatactggtctcgccagacagaaacacaaggtctcctatgacagctcaccaggtctttttctatgtggcccaagggtgaggccaaggaccacactcgataaatactttttagattaacgaaacatccatgagttagtacctaaagggaagagaaaagtcacccataactttaagtggatatatttcttacatagttggcttccaaaccaaaaagaggcagctattcattctgacccttctccaactctcataatgaagaaaaaaagaagcttctaaaaagaagtcaatttctagaagtgttttctaacactaagcgttgctcaatgagtaaaacattaagaagtgcttaaatatgtaaaatgacttgatttagaacaaaatattttccaggtctgtaacagtcagttatggctctgtcttttgaaaatgtaaacccagtacaaaatacaacacattacaaaatgtgttacgggatttgtcagagctgcttgagctctgtaggagacattgggaggggcgggtgtcctagtaaattaaaaataaaactgtattgaacagcagatataagtgacttatgggtattaattcatctattccctagaaaagtaccatatgatttcaatttaaagaggaggaaactgaggctcaaagaagttaagtaacttgcctacgtggaacaggattcaaaccctggcagtctggctcctgagctgttttccaaacttctgcaatgataagcctctaatttctgagggcgtgtcattcaaaggaaactttagatccattctgtgttgatagagggcaacaaagagataagaaaatgtacccgagagctattaagtggcagagctggggttcgagccagggttattccactccagagccctagttcatgccctcaagtcagggatcagagcatcagaagtggggtgttctgttcttttgaggaggtgaaagagtgctttaagtaagtttgcctttgtaactgaagagaaaaacaccgggcaaaggaaggcgaagatacaagtctttgtattgcttctttacttgtaccagcaggtttatggccaaagtatctctcattccaggcaaaagggacctgcagctctcttggagttagagaagttgggtgagaaatagcatccttaagattcttgccctgctgaattagagagcaggggaggaggaggagaggagattgactgggatggaagaaaaggggataccaaagtgctgctggcttctctctttcacactgtttgcttctttcatttaacccttttttgtcctctggaaaggataaaacttatgtattaagagaagccagccaggtgcagtgactcacacctgtaatccctgcactttgggaggccgaggtagggggatcatttgaggtcaggagttcgagaccagcctggccaacgtggtgagaccccgtctctactaaaaatacaaaaattagccaggtgtagtggtgtgtgcccgtagtcccagctactcaggaggccgaggcaggagaatcgcttaaacctgggggactgaggttgcagtgagctgagatcgcgccactgctctccagcctgggtgacacagcgagactgtctcgagaaaaaaaaaaaaaaaaaaagagaagcccatgtgagctgcagagatttccaaccctaagcacagcagtaaggaaaaaaatctcttttgaaacagcctcaaattatatgtatatataaattataccttaaaatatatgtgtatgtaaattatatctcaataaagtaaaataaataagcaaatactaaataaaatatgttggaggagagtataggaggaaatatatgaataaactgggttgtgcagaaaggcatgtgaaggagaaggtctataatgagcatgcgatctcttagctaatcctatctttctagttgtaagaagagaaacaaaaatcaaatatgcttcgatgtcttagggtgactagtggttcttgcaaacaagttcaaaatggcatctatagcaagaaaaataacaaacagggcaaaggagtgctgtgaagaggcccctggctgccagacacagcccagctgaagacttctccacgttccaagagcaacctatgttttgaggtggaaatcctgtcatcctttaagaccctagtgggaaaaaaacaacaaattgtttttatagaaggtgggtcaaacctttcagccatgtgggctgctgggagcacacagatgaaggctttggactggaattgtcccagggctgaggcttctggccaatacatcacactgcctcaggacactaaatctgtctttgccttaccctttgtatttctcaatccacattcctttttggggtgaaatactccattatttctgctttgttctgggctgtctcctgtctctgtccctattaactcgtggcaacaaaagaaacaaacagaagcaggggatttcatgcttagcagctatagacattggcctcacggctttgcagaggggcagacatctgagactttgaatggaagagagtgctgctgcgctgaaccagacccggggcccacgtggctcccagtctgcatcagtcatccccgatcagtggctttcaagagtctcggtatgtggaattcaagatgaaccaaaagtgagattttaaaagttagggcatgtatctgatgattagatttaaagaaatgaattcaagattctcatataattcccagctatgcataatttcacatcttctcacattggaaatagatcagaggaataggatttttttcttttactaggaaagaaaactaagtaaaaaaataaatgtttcttttaaaaaaatctaattcttacattgtaatggcttgaagggaaaaaatcaatttttataaaaacagaattatgcaataaaaccagcaataaaatacccaggcataaatgtctgtaacgagacctaacctttatatgccatattcataaacatctccaaatcagggcctcatctaggtcagtttcagaccatgtactatttttttcctaaagagcaaagtaatacaatttaaaggaaagtgaatgagaaactaatgcattttacagcaaatctctttttttgctgattacctgaacagaacatttctaaacaggaagtaggccataaaaatacacaaacacttttaacattccttaccaagggcattttctatattttaaagacttaagaagggtcaggacatgaaaacatttaaaaggagctaggtggtcgggcacagtcgctcatgctggtaatcccagcactttaggaggtcaacggaggaggatcacttgaggctaggagtttgaaaccatcctgatgaacatagcgagaccccatctcttcaaaagaaaaatttatttctccacatcctctccagcacctgttgtttcctgactttttaatgattgccattctaactggtgtgagatgatatctcatagtggttttgatttgcatttctctgatggccagtgatgatgagcattttttcatgtattttttggctgcataaatgtcttcttttgagaagtgtctgttcatgtccttcgcccactttttgatggggttgtttgttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcctgtttttctcaggtttgtcaaagatcagatagttgtaggtatgcggcgttatttctgagggctttgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtctttggtagcttgatggggatggcattgaatctataaattaccttgggcagtatggctattttcatgatattgattcttcctacccatgagcatggaatgttcttccatttgtttgtatcttcttttatttccttgagcagtggtttgtagttctccttgaagaggtccttcacgtcccttgtaaggtggattcctaggtattttattctctttgaagcaattgtgaatgggagttcactcatgatttggctctctgtttgtctgttattggtgtataagaatgcttgtgatttttgtacattgattttgtatcctgagactttggtgaagttgcttatcagcttaaggagattttgggctgagacgatggggttttctagataaacaatcctgtcgtctgcaaacagggacaatttgacttcctcttttcctaattgaatacccgttatttccttctcctgccttattgccccagccagaacttccaacactatgttgaataggagcggtgagagagggtatccctgtcttgtgccagttttcaaagggaatgcttccagtttttgcccattcagtatgatattggctgtgggtttgtcatagatagctcttattattttgaaatacgtcccatcaatacctaatttattgagagtctttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcgtttttgtggagaaataggaacactcttacactgttggtgggactgtaaactagttcaaccattgtggaagtcagtgtggcgatacctcagggatctagaactagaaataccatttgacccagccatcccattactgggtatatacccaaatgactataaatcatgctgctataaaaacacatgcacacgtatgtttattgcggcattattcacaatagcaaagacttggaaccaacccaaatgtccaacaatgatagactggattaagaaaatatggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattaacaatgagatcacatggacacaggaaggggaatatcacactctggggactgtggtggggtggggggaggggggagggatagcattgggagatatacctaatgctaaatgacgaattaatgggtgcagcacaccagcatggcacatgtatacatatgtaactaacctgcacaatgtgcacatgtaccctaaaacttaaagtataataaaaaaaaaatcaaaaaaaaaaaaaaaaaagaaaaatttaaaaattagccaggtgtgatggtgtgcgcctgtagtcccaggtcctggggagggtgaggcaggaggattgcttgagcccaggagttcaaggctgcagtgagctatgactgtgccactgcactccagcctaggcaacagtaacactgtctttaaaaaaaaaaaaaaaaaaaaaaaaaaaaaaagagagagagagagactaggttccacaagtagaccttcaaatggatttaaatatcaccacaaaaatccctaggaggaaagatctcaataaagtagattctttccattcactgtgcttttggaactgaagctagaaaggcttataacaaaaaaaaaaaaaaaaaaaggaaaacaaaccaaaattgtttttcttgtagtccctaaaagtggaaatcctattctattcttcacttaacaatcttttaggctccataaagatggagctcagtcccatatattctactagtcaccaattcctatgaatctgtccaactttgcctctactatttccctgttcctcctggatcccagtgcctttctttgttcaggacatcaccacagtcctttggataaccacactatcttttctcctaactggtgtcattagttcaggtcttatcctactccaattcagtctccagaataccatgtttttcccgtgatttaaaatctttctatagctacccacagctgtcaggataaagtacagactccttatctgggcagacaaggagctttatgatctgacctttgccttcatttctggcatccaatagttgttatggggaccacaggaaataacgtctataacagctaaaacatggtttgacacacaaaacttaattgataataatattaattattatttttcccaccaaatacatggccctcaaggcaatcctatgcacctccatgcagtttctgatccattctctttccggctccatgtcagtaaaggggctgaccctctgcctacacatccttcctcactattttcctctggctggctcttagttacccttcaaaattcagctcaatgatcatttctttcaagacaacttctgtgaccctcactctgatttagatgaccttctccaaactccctgagtatcttttctatttcactgtcataacactcatcattctgtcaagtacagttgatttgccatccatcttcccccactggacttagagcacttgaatgcaggcactacttttaattcaactttggaacatgagtgtctgaccaagccacatggccagatgtgctccccagtgatgtgcgtggctatgattaaaagcatggttagacaagcctgaaatcaaaccctatggcaatcaggacaagttacttcactgatagctaatctagaaaatagggatcatctcacaggattgctgggagtagcaaataaggtactatatacaaaatgctcagcacagtactcaataatcaataggtgttattatcatcatgagtgctaatattagatttttcagttacaatagtgttttcccaaagaaaacttatttttatgaccacacatcaggattcttctcatagtagataattaaagataattcagggtttaggcttattttaacaccaatttggtcaaagatctgatatgatatgccaaatcccaatggtggctaatgacacagaggcagtccatttggtttgcaataataacaacaattaaaagctcgtagtatgacatatagtgggacaatcgttggattattttcttcccctaaaggtgaagaaaacccctaaaaacacactttcaagaattactggtctattctaacagttaaatcgactctttttgaatataaatttctatgtagacctagacaaaagcataacagagcagaagtgtccgtaatccctgtacatcctcaaatcacactgctttaactgctgacaaagacaaatgtttactatggtctagcgcggagaagccaatacggtgagcaaaatgctatctcgcctcacacatcaacacacgtgccagacagattctgactgcaaagtctgttattggtgatgagagaggcagagagggcacagctggatatttcagatccacagctgagctggcagcagtgggagttcaagccatcttctcactttaaaagctggaatgaatctgtgagagttatttaaaggtgtgctttattaaagaggcactttctgactactgtcaaacttcacgagcaaaagctgaacacacagataaaggcagatctatgtggggtcacctatcagatgtcagctgatctctttcagcacccacaaatcacttattgaaaattaaataccaaaaaaaattttccttcaagattaaatgtagcatgtggacttaatttatattactaatccttttagtatttgctttatattattccctgaaattagtacaggcacaaatgccttaaattatgtttcttgaatttatagcccaaattacatagattatacaagtaccatatacagattcatgaagatattagagaggctccatgggccttatacatttaactagagctttactagaataaagtctcagtagcatcgactttttttttttttttttgtcaaacaaagcactcactctatcaaaggagttcttaaactaccaggaaaataagattcttgaacatcccaagtgtttcttaaaaagggatgtcctcattttccttttgtacaaaacagggttcagattgcaaataacagaaaagcaattcattggaaggatactgataattcacagaattgatgagaaggctaaagaacagcaagaactaaggcagcccaaggtaacactattataagtttaggagttgccacttatgctaactgcttgccaccctgcaccaaactccactgcagccacgagaatgacatcagaaggctccaaccccgggcattgtgccactgagctggagaatctaaccagccaaaccttgctggctctcatgctggggccctggctaccaggttgttgaggaaaaaattgctgccccctaccatcagcaatggaaggagggaaccctgtctccaagttcttgtgggattttctcctaagcagggcagccaaaaccagtatcaactatacatttggtccactggcccaacagacagcagaacttatctagtactacaattgaaggacataaaacagaacatatttattcatcttccaattccacagactgattctgactgaatgtgccagagtcttgggaatggctaagagtcagtctgaaccaaggcaggtgacaggatgagggctggtagaaaccctggagtgaattttcctgagcaaacatgttttgccctcttagtgtcccacttgttatttaatactcagctctcctattctacatgtattcccttctccctttctattttcctactgatacattattacatgtaagaagatgaggctggctgtgaatgtagaggaagcaaatgcctggcagttcttatgttcatacttgcatatttttgctttcctttcaccttcaatgtcttatggggagaaaatgggacaggacatacttgaagccatgtgtagcacctagcttttgttaaacacaaaaactccatgggacagtctgggctattgtttgtcactagcagtgtagatagacagaaactccttaaggatgtgtgactagccattcttttctttctttcttttttaaataaaaacattctggtttttgacatgtttgtctaagtaaggtacaatccctcaagtctcccttttccaatttgcatatcacaccataattgtgaagcaactgttacaacaagaataaaaaaaactactcatctggaacatgcaacaaaaaatggagcaatcatatttatggttagcaataaataaataaaggtccttggctaacaaactcagctttcccaaaaggaaaaaaacctgaaggctcacagtaaactatcatgttaagaaaaagcagtgggggaatgggagtgggagggaaaggattaggtaaaggcatgtattttatagaaaaggacattaggcctcatttgcttggtgaatctgtggaaataatttatgatattctatacaaggaattatgactccatcctgaacagactgcttatctccccatggctcttcacaagcaagaaagggcatgctcatgactctttgactttagtgttaacattgattttataattacaataatattggataccaaggtcctcaagggaattagacatggacagtatttgccagagataaaatattcatcaccaacagagtatataaaatgtatctgagaggatcagggctcacttgggacccacacaagaggaataagacatcaccagaaaaatgcaagaattctctgatatgtaaaaatctgaaacaaagaatgtcagtcttaacaaattctgcacatattaaaataagacctcattgtcacataatctgggggcattccagtagggcagagaataaaaaattgacctgaaattttcttagagggcttccaaagcaaatacataacaaggcccacagctctctttttaatcctattaattttaaatttcttacaaatcacaaacttctctttgcctaaggtttacgtctcaagctaaccattttttttgtgcaatctttagggttttctacatacaggttcatgtcactggcaaagtcaatgtgcaaaaatcagttgcatgtctgtacactaataattaacaacctgaaaaggaaattatgaaaataattccatttataatagcacgtaaaagaataagacacttaagaactaacttaaccaaggaggtgaaaagcttgtacaataaaagccacaaaacattgctgaaagaaattaaagaagatacaaataaatggaaacacatcccatgttcatggacaaaagacaataatgttaatctgtcaacactacccaaatggattcaatgcaatcctatcaaaatctaaataatttttttatggaaataaaaaagcccatcctaaaattcatatagaatcacaaatgacaaaacaatcttgaaaacaaagaacaaagctggagctccagacttacacatacagatttcaaaacaaacgtccggtaatcaaaagaacatgttattagcataaacacagacatatagaccaatgaaatagaatagagatccccaaaataaacctttgcatatgtggtcaaatgattttgggcaagggtgaaaagatcattcagtgggaaagaacagtcttttcaacagatggtgctaggaaaactggatatgcacacacaaaagaataaagttgtacccttacctaatgccatatacaaaagttaactccaaatgaataaaagctttaaatgtaagacctaaaagtataaaaaacatagaaacatagaaagttttttcttagaaaaaaacacagggcaaatgcttcatgacattgaatttggcaataatttgttggacatgataccacagacacagatgaaaaaagaaacaataggcaaattgaactttatcaaaactaaaacatttggtacaacaaaagaaaatgtcaatagtgtaaaaagttagtccatagaatgggaaaaaatatttttaaatcatatctctaataagagatcaatgtctggaatatgtagacaactcctaaaactgaacaataaaaaaactgttcaaaaatggacaaagaatttgaaaagacattcctccaaagaagatatacaaaaggctaattaagtacatgaaaagatgctcaatatcactaatcatcaggaaaatacaaatcaaaactacagtgagggctaggtgtggtggctcacgcctgtaattccagcactttgggagtcaaggcaggtggatcacttgaggtcaggagttcgagaccagcctggccaacacggtgaaaccccgtttctactaaagatacaaaaaaattagccaggtgtggtggtatacacctgtaatctcagctactcaggaggctgaggcagaagaattgcttgaacccaggaggtggaggttgcagtgagccaagatcaccccactgcactccagcctaggtgatagaatgagacgttgtctcaaaaaaaaaaaaaaaattacagtgagatatcattaggatggccactgtcttagactgttcctgttgctccaacaaaatacgtaatttacaaagaacagaagttcattttctcacagttctggaggctggaaagtccaggatcaaagcactggcattttgtgtctggtgagggccttctgctacatcttcacatggcagaagacagaaggatgaaaagggcctagctagtttcctggaagcattggataaaggtattaatcccattcataaggccatagcccccagacttaataacctcctgaaggcctcaccttttaataccatcacattgggtcttaggttccatcatatgaattttggggaggacatgcacattcaaaccataacagctactatcagaataatggaaaataacaagtgttggcaaggatatggagaaattagaacccttgtacactgttgggaagaatgtaaaatgatatagccactgtgaaaaacaatatggcagtacctcaaaaaattaaaaatagaattatcatctgatccaataatgccatgtctggatatatactcaaaagaactgaaagcaggatctggaagagttgtttgtacactcatgttcatagcaacatcactcataacagctaaagcatagaagtaccccatatgtccatcaacaaatgaatggataagcaaaatgtgatatatacatataatcgattactatttagctataaaaaggaaggaagttgtgacatatgttacagcatgtttcaaccctgaggacataagactaagttaaataagccagccagccgtaaaaaagacaaacacagtttgactctacttatataagatagaattagtcaaagtcataaagaccaaatgtagaatggtagttaccaggaaataaggagggggatacaggcagttattgttcaatgggtatagaatttcagtgttacaagatgaataagagttatgaagatgtatgctggtgatggtggggatataacattataaatgcatttaataccactgagctgcatacttaaaaatagttaagatggtgaattttatatgtattttacaaaaataaaaaaaaattttgaaaaaaaatcccacaatttataactcatcccaaacctattcctcctgaaactttcctccttagttaacaacagctccattttttcagttgctcaggccaaaaactctagaataatccttggcacccctttttctctcaaaccacacatccaatcaatcagaaaattctgtcagcaatagcttcaatatatatacagactccaactacttctcaccacctctacccttaccaccccaatctcttgctttgattattccaaaagcctcacactggctccctgctttcactcaaacctccgtatagtctatttacagcacagtagccagagtgatcctgttaacatatgtcagatcaagtctcttttccactcaaaatactccaaaggctcccatctcactcaggctaaaaattaaagcccttatagcagactaaaaggtcctataaaatctgcctccttcctccttcctcccccactcctaattatttctatgacaacatctactactatttcttcactcagtcagttactccaagcaacctggccttcttgcagttcctggcccacgcttggtaacatccaacttcaggacctttgcacttgccattccctctgcttagaaatctcttgccctagatatacatatggttcatagtcactcctttatgttgtttgggtctttgctcacatatcacctttcagtaagacctgccctgattactcttaaaaactgcacatgtaccctaaaacttaaagtataagtaaaaaaaaaaaagccaaaaaaattgcaacctttcccaccacaacatgttctaactaccttacatgttttcccacagaacttactgtcttcttacttactcagtaatttactatttatttgtttattgccagtctcccctcactagaacataagtcccatgacggcaagattttttacaattgttttattgaattatttcctaaccttttatcattggacagaggttgatggaattctatattctagccgcatttttcttgaatggaaggaacatgcatccttttaaatcacatcctattaaatttggcaaatcttatacttttatgtgactcctcctgtgttttgtcttcctctagaattataacactaaggtcatgctaatgacaaagagttggggtggggggcgggtctagacagagttttaaagttttctaatctttacaagaagacacaagaggagaaaccagtcagtctgttgagagaaaaaacagaaaacgtaagtgtcatgaaagtaagaaaacttaagtgtttcaagagggaggaggtaagcaactaagatgaatgcttctgagtagttagatcagaacacacagataaccattgtatctggaaatatggaggatattggtgatcttcacaagcaccatcttactggggtggtgaagacagaaatcaagagtatgtatgtaggtccagtgacacttttcatttgacatgtttcacgtaggacattccttccattcccatggcttctactattttgatggcttctgaatcccatatctgcttcaacgtcctgctctggagagccaaactagagtttttaaacttcctgttaaacatctctatctagatctcccttaagtactctcaaactaataaaaatccaatttcagtatcaatcctaccacccacaaaagaaacttgttccttctttctatatttcctatttcagtaaattgcagcatcatccaatccatcatccaaagcttatcctcaatcctgtgtctctcacaatgtccaaaattgatacaagtctcttacttgtattgatttcacctcttaaatatttctgtaatactctaatccaggggtcctcaacccccaggcagtgaaccggtactggtccatggcctgttcggaaccaggcctcacagcaggaggtaagcagcaggtgagcaagggagcattgtggcttgagctctgcttcctatcagatcagctacagcattagattctcatagaagcgggaaccctactgtgaactgcacatgtgaaggatctaggttgcttatgagaatctaatgcctgatgatgtgaggtggaacagcatcaccctgaatccatcccctccaccccagtcgatagaaaaactgtcttccacaaaactggtccctggcatcaaaaagcttggggacctgtgctctaatctattcctattgttttacaataaagccttcatttttttttttttttccagaactgtaactacttcgacttatgtactctgcctagcacatcataggtgctcaataaatatttgttgatttcctgaaatagctcacatggctctgttataaattgctcagatctaggtttataaaattaatgctttcccttaaaaagcttggttgaatttttttaaaaaactgaataattgggggctaggatgatattaaataattgggggcatggatgatattaaatacagttatttaataactgtaaataaaaacatacaagttctgttggatgtgggtgtcccctgggagactatggtagtgaacactaaaatcctaatcgccatgcattggaattattccgactattactttctttagttccttcttatccacccagtcttctttgaaaacatgtttccccttcataatttagctctatattgtctaaaagctataacttcaatcaaagaacttaagcatttttaaagccaacaaaatacatgacatcaattattatcagaggcatggacccactgcgatgttcattttgaacaagacgagataagtcattcctggaagaacataggcaaggataaaagatgattcaagcctaatatgcaaggctcctcacctctccatcatttttatgagacccacaacatagtcttaaccccaataacctccatacggcctcaccaagaaaggatagaaaagacctcagaagtattttggccctaaaacatttttgaatcaagctagagaaagttatgaaactcagttgtcacacttgacttgcatccagaaacacaattcaaatgaagcatgtagtctaaatggctgatagttttcagctggctgtactttccagccacctaatatgaaaaatctaatctcaccctaataaaaatcttagacctggcaaaaaaagaaacatatagctttgtggtaacgtgaggagaggagggaggtaacagaaatggtagaatgacctcacagggttttgacttttaaacactaatatttatagattaaaaactgtctgaaaggttaagcttggaaagaatctacttcagatacctgatacagcacaggcacaaaatgaaccatgtttgatctaacttgtaccaagggagaattttacctttagctttaccaacttcccaagaggacttctagtcatgctccttcaaatcccaaaggcctgcgtagtgaggtatgccacaaagagtagggtgtctcagtcctcctctactagtagatggaagtcacaaggagatatctcgagacattcaggatgtttatttactcagaaagtaaatctacattccttttgtccaacaggcaatatcattcttatttctcaaggcccaaggtccataactacttctccccacttaaggcttacactacattctgtactctcaaaatacttagttaatgttgctaatgtactatgtacttcactatgtacaagccaaattaagccacctgtggtcaatatatacctgggcagcaaggctcaagatagatcctatattcagacatcatcaatgaaaatacagaaaaaaatcaacccagactttactgtatttatcctttattcattaagaaacatgcaaaaagctcaggagaattttaaaaggttacaaaacatggtgatggtttaaatagctactacaacaactgaaggccccacagtcatttcacaaactagagaaggaaataatttgctccttccactaatctgacagttggcccaacctctgatttcaggagaccttttttcttttatctctagtccacttataagcacatatgaggacacacacttaatttttctctattttttctcatgtctaaagtaatacctgtaatgaataagttgatcaatcagaaatgtgtaaaggaaaaaagaaatgtcccttcatattcaaccctcctagagatgatcagtgctcaatccttcaacttttctatgcatatactaatatatatatacatctttctcttttcttttagtacaaaaatggaatcatagtatgcatacagttatacaactagctcattattttcctgacaactatgtattagtcccattttaggatgagaaaacagacccaaagaataggtgatttggcaaaggtgactcagctaataagtgatggagtgggaatcaagcccagaaatctggctgcagagtttcagtgctccccttccaaatagcagaaaagctgtagcccatcttctcctgtgtgctaccaagcaaacctgtgaatatgctaggacatattcatcaaagcagaaaaggattctacctgactctttttaatgtcagcatagaattctattgtatggctaccccaaaatttatcagtctccatttggtggctaaatacatggttaattttaaactatatagaatttagatttttagagctagaaaataccttaaagagtatgttttatgacatcaaaagttctcaacatagatgaacttactaaagccccaaatcttgaagcacattcatcaaaaagatcacaggattgcttggtagcagacaggagaaggtaggctgcagctttttccactatttagaagttgaacactcaaatttgagagccagatttctgagtttgattcccactccaacacttactcagccacatttgccaaatcacctaaaaaactgggccacctttgccaaatgacctaagttacatatatggtcctgttttctcatcccaataatgggactaatatacagttgtggtcaggactaaattagttataatgtaaaatacttagagtattgacttacaaataaagcagtaagtggtaataacaataattattatttatgccatactagttcaagcttaccttaaaaaattattaaaatttctgttctcggtgtgggtagaacagaaaacacaaacttttggttgttatttgagattttggcatttacacattcagtgctctttcttcattattctttaattattaaaatataaaactgtgattaaacagctgcagtgggatatattgaattataaagtatttgagtatattaaactgaaatagaattctaaatagaaatgtgaacatacagttatgccagaattgtttgttacctatagaagcctccttcaaatgagaaatggaagaaaacaagaaaataaaaatcatcagtgccactgcattttcattcatatgagtttcacaataaaggatgaaaactttaaactctgaagaatatactagtcaatatatattgattcttcaatagtaaaaacacctgggatatttttgggaaacagataagttcatttcagttcttcacaacacatagatttgtacttcctttcatattggtggtatttgttttcagtttgttttttttttatttttttacttgaacagactagactgaagtgtagtagcagagtccaaattgtttgaacatctttcagcagcaagaacacaatgttatctggcaattcattgtaaaaaagcagcatgaacttgtctgggtgctctccaggtaatgagaaatatctcatgaatgccagggaaagaactttaaatgactgctcttttaacacacctttcaggcaaatgtcttaaggccactgtcacagaaaagcacctgattgggagggggatgcccctacttcatgatcacactagcttggaagataattaaaactaatccttttacctgcctacatttcttacaagcactctgttcagcacagtacataaaaaagatctccatgttttgcaccaagattcaatcagtacttccacattttggggggaaatgcaagtccaaacaacagctcattcacttatttaaaacattcagctattttaaaaggcttagaaaacagagcataaggagctgaaattgtggcaataatcaatagcttaccaaccaaaaagagtccaggaccagatggattcacagctgaattctaccagaggtacaaggaggagctggtaccattccttctgaaactattccaatcaatagaaaaagagggaatcctccctaactcattttatgaggccagcatcatcctgataccaaagctgggcagagacacaacaaaaaaagagaatttataccaatatccttgatgaacattgatgcaaaaatcctcaataaaatactggcaaaccgaatccagcagcatatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcatgttaaaaactctcaataaattaggtattgatgggacttatctcaaaataatatcagctatctatgacaaacccacagccaatatcatactgaatgggcaaaaactggaagcattccctttgaaaactggcacaagacagggatgccctctctcaccgctcctattcaacatagtgttggaagttctggccggggcaatcaggcaggagaaggaaataaagggtattcaattaggaaaagaggaagtcaaattgtccctgtttgcagacgacacaattggatatctagaaaaccccattgtctcagcccaaaatctccttaagctgataagcaacttcaccaaagtctcaggatacaaaatcaatgtacaaaaatcacaagcattcttatacaccaataacagacaaacagagagccaaatcatcagtgaactcccattcacaattgcttcaaagagaataaaatacctaggaatccaccttacaagggacgtgaaggacctcttcaaggagaactacaaaccactgctcaatgaaataaaagaggatacaaacaaatggaagaacattccatgctcatgggtaggaagaatcaatatcatgaaaatagccatactgcccaaggtaatttatagattcaatgccatccccatcaagctaccaaagactttcttcacagaattggaaaaaactactttaaagttcatatggaaccaaaaaagagcccgcatcgccaagtcaatcctaagccaaaagaacaaagctggaggcatcacgctatctgacttcaaactatactacaaggctacagtaaccaaaacagcatggtattggtaccaaaacagagatatagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatcccttccttacatcttatacaaaaatcaattccagatggattaaagacttaaactttagacctaaaaccataaaaaccctagaagaaaacctaggcaatactattcaggacataggcatgggcaaggacttcatgtctagaacaccaaaagcaatggcaacaaaagccagaattgacaaatgggatataattaaactaaagagcttctgcacagcaaaagaaactaccatcagagtgaacaggcaacccacaaaatgggagaaaattttcgcaacctactcatctgacaaagggctaatatccagaatctacaatgaactctaacaaatttacaagaaaaaaacaaccctatcaaaaagtgggtgaaggacatgaacagacacttctcaaaagaagatatttatgcagccaaaaaacacatgaaaaaatgctcaccatcactggccatcagagaaatgcaaatcaaaaccacaatgagatatcatctcacaccagttagaatggcagtcattaaaaagtcaggaaacaacaggtgctggagaggatgtggagaaacaggaacactcttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacatatgtttatggcagcactattcacaatagcaaagacttggaaccaacccaaatgtccaacaatgatagactggattaagaaaatgtggcacatatacaccatggaatactatgcagccataaaaaatgatgagttcatgtcctttgtaggaacgtggatgaaattggaaatcatcactctcagtaaactattccaagaacaaaaaaccaaacaccgcatgttctcactcataggtgggaattgaacaatgagaacacatggacacaggaaggggaacatcacactctggggactgttgtggggtggggggagggggcagggatagcaccaggagatatacataatgctagatgacgagttagtgggtgcagcgcaccagcatggcacatgtatacatatgtaagtaacctgcacgttgtgcacatgtaccctaaaacttaaagtataataataattaaaaaaagagaaaaaaaagaaaaaaataaataaaaaaaatttaaaaataaataaataaataaaaagaaaatagagcataattgtgtatcaaaatgacaagtcctcatcggaggcactgcatccaaatttgcttacctcaaactttgagaagcagccaagatatgaaaactctagagaaggaaaaacttatgccatgactggcaataagaaacaggctatagaaacaacaagtgtttacaaaccaattgagggtacttaagttacaccaggaaggataataaaaaaaaaccatctcaaaaattagttgatataatcataaaccaacaccctaaaagggttacctgtactagggttaggcagaggtcagtgttgctctgtcctcacattcatggtatgactgagagaaaatacagggaatatcttaacttaggtgccacagaaaatacatttcaccctggcaataagcacttcagctgttgatggcaaactttttattcatctttccatactctatcacagataggcgaaaacaacaactcaataaactgaaccataattatacttcttctgcagtgcttcttctcacactttattgaaacatcacttgttatagtaacaaaaagcctaccttctcaactaatcggatttactttcaccacttttttgcagctcagttggatgatcacgatacatacaacacctacgccctttgtctccaattaaatccctcaaattcagtgggttaggaaaaaaaaaaagagttgagtgattctcatttatctcaatagctttccttggttttaccctcagttcaaatctatggcttaccagagagaagaccagagcgcaatatctccgtggccttagtcctgactctataatgaatcacttttagtttcttttcccaggtgcacctctttccatctttctcaattccttcaccctatacttcaccaactaccccacacgctcctcaccctacaccttaccaactaccccatacccaccacatcaccatgaaaggaataagcttttgtgttttcagagtctgagatatgaataagattctttccttggtcaaacttcagttaggcttccgaaccttctcctaaacccatctgtgcacttctttgtgaaatcccattttagcaaagagcctggctaagtcagttcagcaagaacccccatatctaatttgatcatccttctcctccaccatcccccaggtgatgtctgatcaccccagccagtcttccgcaagaatcctgttaggttggtttagccagagtcccccttaccccttatgcttcttcttagtaattttccatctactgatccccaccctgctctttggctatgaattcctacctccccatgctgtacttgaaattgaactcaatctttcctcttgcactgcaagaacccaatgcagtggtccctatacctatggtgatggtcctgaatagtcttcctggcctttactgagcatcattgaataatttttctttaacatgtaaccctaagtcacaatggaccatctccttgacctcctaactttagtaactagggcctcttagaaaacctcaagtcagaaatttaaaattatatagggataaaaatcaagagagcaagctatgtaactggcaggaaattcaaagcaagaaggaattccctcacagcacaaaaacatgggtaccaactagagtatatggcacaaataaattcgaaatttgacattttaaaagtcatatgaatgagctctctctttagctcaataatgactcctgtccctttaagaagtttattatttaacttatttcttaggcaagtataattaagaaacaaccactcatattgtagaataatcaaggcagaaaaattatatgtatttgtgtgatacagtattatggtaggcagaataatggctcctccaaaagatatccatatcctaacccctggaacctgtgactgttacgttacatggccagggggcatcaaggttactaatcagccgaccttacaaatattattctgaattaatccaggtaggctcaatgtaatcacaattgtccttaagcagaaaggaggaagtcagaagagtcagaatcagggagatggcattgtaagaaagactgactaatcactgctggctttgaaaatgaaaaggggccaatagccaaggaattcaggcgacccctagaagctggaaaaggcaagaaaagggaatctcctctaaaggaatgcagcctggctgacatcttagtttcatcctggtgagacccattttgaacttctgaccaccagaactgcaaagtaataaaatggtgttgttttaagctacttagtttgtggtaatatactagcaatagaaaactaatacaagtgggatgccaaaaaatgaataataaagacctagctcttttcagttatataaaaggtcatttcatatgcaattatccttaaagtatttggaggggagggtgttgtacttttgttttctttgtacctatttacaaggtttcctaaagtcaaattattatctgaaatatcacctttcatgaataaaatcaatagaaaaaagtcttcatagatttctgatgtgccagaatatatccaatacataagcaatatataccagaagtcctagggaagcaccatttttccattataaggatagaaaaagttaatgtaattattccccattctatgccatgatttcagggggttccctattttccatgtacttatataaagctcccaaattatctttaaaataatcctagcttgttttctcctcacaacttggcctcatttactctcctgaatcaacagtaagtcccatcccactccacccttactatactcagctccccactcccccctcactgttaaatacacatttcttggtgtaaacctcagaggacacaaatcggctttaataccaacagaaaatataattatccctaatcagatacaaagagttttaatatatttcaaaaccaaactgaataacatttaacttctcttggtcacttaccattaacattaactatatagcatatcgccaagaatatcgacttttttaaaaacaaaatacttcgcagcatcacaactcccctttctcatctattggaatagattctggataatcaactattttatatttaacactatttgatgtctttttataagcacaaattaaacaaaaataataatctcttgtttttctttccttatataaagtctttgaaagtatgagaaaatatccaatgactaaagtcaattttataaaattatattttgggagatctccatgtcacatacacaagcttctacctcccctcagtaacactggttttaagattcttgaagataattttaatcatgacaacatttttatgtatgtgtagaaccatcagctagtactattccatacaaggaatcactcactgttggtcaataatgttttcagtaatccaaagtgaactgaggaaaaccaagaacaaaaagggttggttggttggtttcccataaaactaccttttttcaatttaaaaggacttatttattcaaagattataatgttcctacaggcaggggcaggagggtattaaggtcatgaaatgaactcagtaatagtccctgagggttgtttttctaatgtccttattggcaaactaagtcccacctttgcccaccccgccaaggtttttttgtttgtttttaatattatggttctataaaatccaaaaatctggaagctgctacctaaacaactttgaaaatttgagtggtaaaggacatagtgttaagttatatacaattttcttttcgagagaggaaatcaatgtctgtgtttgtaaaatgttaaccaaaccacaaaatatctttttgtgataattatattaataacagtgagggtgaagacaagactgaacttttccatccatgaagacacatgatgaaaaacaaatcacatataactattatctacgccagactccattctatttgctgtaattcccacaggagacatgcaggaattctgcactgcccatgttttcagaaattaggactttgacttttccttccctctgcacgtttctgctgagaagccagtcttaaactgtcataaataaggtaagacttttggcagatgcacactgcttcgaattgctcatctgtacctatattgcctaaatatgaatctccattatccccttggcaattacattaactccagactgtggccttcttaaaatccagacaaattacccaatgcccatacttctttctagaaactaaacataatgtacacactctaaagtttccagtcaagtcttgcactttttttctcaacctctttacatttcagtgcagatgaataagattttaaaacgtaaaggagttgatgcttaaaagcacaccgtaggtattgtggatcaaaggccataattaaaggatcagttctgaacattgtgctgattttggagcaaacaaagctcatttagtagttatcgctcagaatccaatccaggtatttgtgtagcttgtgcactgtttttcatggaagtacctggaggaatgtatagtcatttacgaagaatcatctttgctatcaattcccttgccttttttttttttttccttgagatggagtctgactctttttgtccaggctgaagtgcagtggcacaatcttggctcactgcaacctccacctcctgggttcaagcgattctcctgcctcagcctcccaagtagctgggatttacgggtgtgagccaccacgcctggcctcccttgaacttttccaactccttggttgcacactcctcaaaaatcccaacaactgcaatggcatgaagagcgctcactttggatgaagtactttccaagcactttgggaggattattgtttttaatcctcataactcccctgggaggtatacactttacatcaggcccccatgacggtaaaggcatctgctcagagatcgcttgcccaagatgacactgctaacaagatctgggatttgaacacgagtctaatctgctttcaaaacaatataaaccactgcattgcactgcctgttagggaaaacccatcagggaataaaaaggtattccagctagtttgttccaaacagaacaaaagtttagggaccacccttggcaaaataacaacgtcccagaatcattgcctctccttactggctggcccatctgacacttaccgaagagcagttctttgcctttagagtataaccttacagaagctgagggctttgttagttaaactattatgctagaatcccaaccagaaactgaaacctgatatcgtgttcatgattaatcattcaacaaatcttatttgagcaccaccataattaactgttaagtaacttaaattctgctgtggaggactaaatatgtgaaagccatgttcctgtcctctaggaactcctggtcaaaggcacagtaagaacaaagactgctccagaaacagtaactaaagttacctgatgaccgaccaactctctaacttccttgtccttttcctcaaattcataattttctggtgaatggagaagaaagacatgaacactgtttaatacttaaaaagtatctagtggaacagactaaattgtcctccttcccccttattcttcttctggtttggccctttctcctccacccccagaatctgtattttttctttggctaatctagattaatgataccagattaagagaactggacaggaaaaacaaaacaaaccaaacagtggcagtaataaatagattatattgatctggcccaaagtctatgtctgtttaatgctagtagttacatagtttatgtagagttgcaagggggtaaaaaactaatcccagcacctcaaataccataattaggacttctcgaagcttgaaaagggtgccagtaggatcaaccttctgagtttgtactcttcattcattcaacccatattgactgagtgcccaccagtgccaagaggtagatatttatagtgaacaaggaagatatgcccacagccctcattgaagttatagtctagaaggaaagtcaatagtaaacagagtcagaaatgcatgtttaaatactgtcaatgagaagcactatgaagggaaagaacagggtgcctcttaaaagtttaccagattgtataccgttatacttcaaaaagctgagagggaaagaaatctaagaggtaagtgatcttatttagatgaagagttaggaaaaccctctgtgggggataagaaaacaaaaaatatcttagctgaaataattaggagttagccagacaaaaaaaatgaggagaacaacgtttcataaagaaggaactatatttgtgtaagcccagaggggaaaaagaacttgatttgtcatagaaattgaaaaagctagcatggtcaagaagtagccgtcagggaaagaggagaatagaaacacaagaaaatgtaagggcagccaaccttatcaacacacctaaaccagaagtcttcaaatgacttctaataatgtctctgatacaaaatcataatgaatatacaaagcccagatgtaaaaaagtaagcaattaaaatacaatgcattttcaaaattctcaagtgaccaagatttgtaactggaaaggctcgtctagtccaatgaaccctacatctttcaaatgagaaggggaaccccacgcccatgcgtgagatgctgtcatcctctctgaatctcctttctcaaagcacccacgttcctctagcagagaggagtcttgcttttcctgaagggttcttctacaccacatgatgacaatatcctatacaaaagggacacagaagccactggacagtaggtgcacaagatgtggcacgatactaactcccatggcccctttcaatatacaaatgtatgtgggtatctgtctgcacagggagactaagagaattttaaaaagaggccaaactgcacttaaaactcctccagaagagatattttacttcacccccaatgttacctcttcttaaaaacatgacagttacaagcatctaaacacagacagagcatgcttctatttagtcttattcctgctctacagaattgttcacactgcacctacactttctgaccaaaccgcctattgagaagacaatctgcagttacacaaatgagaaaagacctctttaaagtggcaggttgaatacagtcatttagttccactttctcctaaaactgcactaaaatgattttaaaagacatttttttaaaaaagataaacacacttggacataaaaaataactacattttggaaactagaaagcagaagaacaagtggtaactggtccagcagacaagaagctgactctaaacaggcagtgaaagaaaggtgggccacaagacagtttgttccctgggattcccaagaagctcaggaatggctggaatccaagatcccttataaatgggcatgaaggagggactaaaaacaagaggattggttcagatctctttaaagaaggacttaagagttctagatcctctctccgatttcacaagctgggcaactggctctgccaccctggtagaaggctacaccttttattttctgtactgaagatcactaggcacatattaaagcaggagtattgtacagaaaaggagaattaagtaaaactttagcatagtgaatattgagagcccaaggccccttttcccccttgcttcccccaccactgaggcccaggcttacattctccaggtgggagcctgaaagattcttctttggaatatctaactaccccaagagagaaaacctaaagatatgttattgggagctctctgataaaacagccaaatacccacgggagaaacacacagtagataaatctcactcttgcacacagaactctgaattagcttcaaatgccccacttttaaatataaatagacaagaactgccaggcgtctaagaagtcattaatatgaaagacagaaacctaacacaggaaaaaattttttaaacttggggtatgcagaactatacaatgagatgaaaatctaatacatatatacatgcacatgcgcacacacacacgcacacacacacatattcacacaccaaagcacaccatgaaatttcagaagactggaattgccaaacaggattaaaaacaaaatcatcaccaccaccagaaaaagtacttcagatacaaaatgttcaggatcaaaacaatgatgctgctctggatagcaacagctagaagcttagaaataaatggcatcatgacttcaaaactatgatggacaattatttccaagctagagttctataccaactaaaccatcagtcatgagtccaataagcaaaatctcaaaaaaaccgacttcccatgaactttggagtaagctaaagaacacaaagacctggaagccagcaagcatcttacagaagaaagggtcccctcaacatgataattcagggggccccccagtgacgacagccatgcagcagggctggtcaacaaccagtccagattggcgtagatcagaagctctgagagaatgtcaccaagaagatgaactagatacaattttatagcacacctatttgaaattatgaagaggagatttatacaactcaagagagacagaatattgactgaatgatgaggacgtagcaaactaagtaaatgacaaaataggacaatgactaactcaagagaaagtagagtttaataaagaagaaatcataatatgacagcaatgaatggcatttataaaggcataataatgtaaacacatggatttacccaaaatgagaacattaactatatgggcagaatgaaggagtagggggaggtaaagatgtgtgttggggtgaatggagagagaaaagagcgaaatcctcaatttccaaagcagaagccaatagacaatgcctaaacctgaaaaatcaagaagtagctatataagtacattaactagaatgatggtggtaaatataaaaagagaaagagagagagagagagagagaggctaaatacagtagttgaaatggagaaagctagagaaagagaagttagagagggcatttgaagggagggaaggaagaagaagttcaccattgaccactggttttcacataataagttctataagattatttgatcttttagaaaatgttcatatacaaccctgataaaaataaaaactaaataataaaaagccaagaaatatggactagaattgaatatccatttctgtctcccttatactattagaaaatgtatacctgtattttacagcacaagtagtaccattctttttaaaggactattttgaggtcgtctttagcttaaagcacatataatgaaaaaaaaaatcattcacctcaggtcatttcttttacctagacattggccagacatgctgtataaagagactaatttttgaacagttacttgcaaagtcaacattcttccagagtgtttgaaactgacagcctttcttattttttatcttttatttattcatagcctatcttctccctcaaagaagtaagaaagctatctttttcttacatggcaactttctcttcaaaatataaagatacacagtgacttagaggattatagaatgctaataaaacagaagagctaaggagttctttgaaaaaggaagaaaaggtgaataaatggtagaaataacattaatttcttctttgtgtcctaatatttggcttgaatacaatgccaacttttttttccttaatgtcttccatgaaagctgaaaaggcaaagaggcataacaagtaaaattaacaaaaatatgctttttctttgttattaagtattcttctaaaaagcaagacatttttaaacgtacccacttcaaaatatattgtaagattctgtgacacaggcatcattaccataaaatcctcccaatcaaattataattttctttttcatgaactatatttcttaagcaaggcaagaacattttattaaaaataatgcctattatctattttattttactataatccactcactttccagccaatttgctccgaatattctcttggaaacttgtacttcaagacaatggcttcactcattacgttatttcaacaaaatgataaatgtattgtgaaatatattatatttgattatcaagctaaagcattgcaaatggccatcacagaacccaaattcacccataacattctatcccccagaatagtcctctgacaacaaatgataactgtacatgacaaatcctttgaggcatctgggccttaaaaattaaagggccattctgactaaagtatgttgattttccaaaggaagttttgttgcagttgttgctgctgttgctattatttgaattgactaatcctcaagtaggttctagccaccctgaagaatatttacaaatacaaatatattagaattgaaagagaccttatatgccacatagttcaatctcttttccttgagatgcaaaactgtggcacagagaagttaattcagttgacaaacaactcatggttaattcagtctcatagaacccaatctagtgctttttctgcaataacacattacagagtctgcaaaaccagcacaattactacctgacactgtcagcaaacaaaatgaaaatacacatattttaataagtagtttttgcttatttttgcagtcacacataagatgttatatctttacacaaaacgaaactaggattatttttattgttcaaaagacagactgtccaattatagctattactgaactagaaatgtattttcagtttatcttcccaaatcaagttagtggtttgtttggtatgcacaaagtattccaaaatgtcacagagtgggggctattgcagggttttctcctgcttccaccagaccacaaagggcaacaagtttggaggggacaggaaggttgggagcagaatacaaggagctgtagagctgttctatcggttcaggttttaagatccatgaatagaccctactcaccgagtgaaagccctgacaattttatctgagcattagaaaataattccttgggcagttaaaagattggaatatcaaagagctgacattagttttaggcagcgcttaaatgaaacacttttttttttttttttttttgagacagagtttcacttttgtcacccaggctggagtgcagtggtgcaatctcagctcacggcaacctctgcctcccaggttcaagcgattctcctgcctcagcctcgcgagtagctgggaatacaggtgcccgccaccatacctggctaattttttgtatttttagtagagacagggttttgccatgttgggcaggctggtcttgaactcctgacctcaggtgatccgaccgcctcagtctcccaaagtgctgggattacaggcacgagccaccgtgaccggccaaatgaaatacttttatactcttatcttacttttaaaaagaatatgataatcagagagttcaggaaggaaataaagaggagtagataaagtccaaaatgaggaatatgcttatctggagcacacctacttaaccagaaaagagtaatttgagtaggaagaaatgccaagtcactaatttgtttaaggatcttggttattggttgattccattaggaatgtgtctggctacaagtaacagaaaattcatgttaggtgctttaaacggcatcaccaaacctaaagggccagagagtaaatatttaagacctgcaggccatatagtctccgtcacaattactcaactctgtcatagcatgaaggcagccacagtcaatacgtggctgtgtttcagtaacactttacttacaaaaataggcaatcagccaatgggtcataatttgccaaccaatggtttaaccaaaatgtcaatccctggtttaaacaaatgagacttaattaaaaagaagctggccttttttgtaaggtagtaagaagggcacatcagctccagatgtcacatttctgtttaagaagaggaaaagggaaaaggaaggtagaaaagggaaaaggccacatctgtcccttttcacaggaaagcaaaaactttccccacagaacctcaagcagaccccctcccccataagatcactagtcagaaccgagcaacacagccacatctagttgtaagagaagctgagaaaacagggaacacaggagtctaagtggcttagaccaatcatggttcattcattgcctggggctagacacattgctgcctcagaccagggtattttagcaagaaggataaatggctattgggtgtacaatgaacagtgtttgtcctgttggactattttttctgttttctctattggcataatctgctcaaagaaaatatgctttcttagctgtgaactaattagtcaaatggagattgagaaagattaagcatgtttggtggtaggggtggggaacaaataagagtgaatctactgttagctacctaaaagtagtgatttaatgggggggagatgcagagtgagaaatctgaatagcagtcctgccagcccagttttatgaccttagccaaaacacttaacctacccatgcctctgtttctccaactggaaaaataaagttgttaaattagatgtctctaaggtcccttgacacactaacatcctgtatctcctttaaatatgttgtctgatcaagcaaacatagcataatgtatccagttaaaatttcctcctaaaaatagtaatgcccaaatcacaaatgtggaggattcccaggcagaataaagttttaaaccaaagaagaaaaaggattttattgaaataacttttcacacattgctaaaacactggcattccattcaacccttccaatttctaagaaaacacacgtgtaagaagggtagttaacttttttaaaacactataaatgtgtcttgtaaaaattatactgtttcttacaacaaacttaaaatagttctcaagtccaaaatggtaactgttctagctagacgactaactgaggatgctcgagtcaccccctccactgccacaaccccaaataagcattgcaaaagataaggtggcaggaagtagatttacttttgagatgctctctcaaataaccgcccttttaacaatgcactggaaattaatcaaaacacagtcaggaccattgaggttccttaagaaacagacttttcaaaaggaatccaaatgaataactcttttagcagtttgaggaaaacaggaataaagaaggaagacaagaagagaggcaggaagggagagggagagaacgttctggaggaaaattttgtttagcaaaaatgttcccatatttttttgagaagtcttccagttttatatccatatagcagagataataaaaatcttcaataaatgggtcataatttatccaaaaaaataccacaaactaagtgaaagctctaacactccaagaaattagtgcagaaaattattttaacttagtaccattaacccaatattcaaagatttgaagatggacaaaactgaaaaaatccatcagtttattgtttggaaaaaatgtaatcttttgagatttaatttagttgagcaacaattgtttttgctacaacttatcagatatacttacgactaaatttgaacacatatatgagagagaagtcttttaaaacaggccaaaatagcagtcccaaacagagtaatcaaatgattactgtatggcaagagcaaaaaagaaaggaaggaaaggaggaagagatggaaggggggaaaaaaggagagaaggaaggaagggggcttgatagaaggaccactacccagagatgcaggggctgctgcaggttaataagaagccttcagctccagcacatttaatagagaatactttattcactaactgatataactttgctacagccactggagtagataagagatatctttccagtaaaaattctgcaaagattctgccctgtactagaacaggcagcagttctcaatcctgacataccaaaggggttagcaggagtttccccaaatgcccattctcagacagatgaaagaacttcctttgaaaaatgctggagcttttcacctccgcaaagcttttttccctacatattgtcctctgtggccatctcagcattttcatcagctcccagcctcttcaccatttgtcatttgcaccaacatacaataggaaaacacattttccgacatgcctcagcgtgtccaggatgagatgcaccctcactactaagccgcattacacgaaaatgtgtgaaatgcattgcttgacccacttacacaaaaagacgcacaccatgtttaacacgaaacgtcctgaacacttcctgtggccatttccattcttctgacttcatttcaatgattgagaacttaagaaggtttgggtcatatttatttatttattttaaaccctcatgtctctcactttccttgcaggaacctgtgactcttgcatagcatagtagctgtgaccccacattggaaggaggtatgatcaaaggcagcctggccagacttgggaaaacatttccactgagaatggacatactgcctgtcaaaaggttattcccaccgcgttggggcagcagatcacgttactccagagtaacaacatgaaagggcaaaatctggccatagtcacccacatacgtgtttttctttccaacaagggcaaatgggagacaccagccagagcagaacatccttcttatcacttgagggggcttgggggtggggaggaggcctttccctaatcaatactgctcctaagccgcagccactgtttaatgccttttatatttttcttttcattcagaaacagctcacattcaacaagacttttctgtcttaaagttttttttttttaaatccaagcaatcacaagctatattctgtggaagacaaaataactttggaggcgtaaatcttaatgtcaatgacaggaaggctttggtgaaccattaccataaatctgacaaacgctaatttgatgggtggctgtatctgtctgctgcacggccagtctagacagtctattgagaaatcctaaaacacaactgtttgttccctgtaacaccatctggatatggcaataagcgccgacccagcgccattcacacatggatcaaagcacatgctaatgctatcatgaagtcatacacataaaaaattcaatctgagaactcgaagcaattttcctaagtcttcagcgaagaaaccccagacttagtgcgactcaagctaagtgcgcgaaggggggagggggggaaaaaggaactgaatatttaatgagcttgggcttccagaggaatgttaggccacccattgtattggaaaaggctcatgtcacacttcagtcatggtacccgtcagggtgcccctttacaaaaattgatctgaagacctttgtaattacctgtttcagtcaggggtggggggctgggggagtggattcatgacaagaaataaaagaatggatccaaggtgtaaatctaacattacattatattggtctgagctggcacaaattttcaatattgcatacaatattaaaaacctttctcattaaactgcactgtggcattagatcaaagaatcaagggcctcctattgaactcctttaaatattacaaacataagagcaagtctggctgtgcataaaatagaaacaaagccaattttttttgtccaccctcatcctatagctggctggagagaaacattgcttgagaaatctattgtaagtcaaacacgaagaaactttacttctcgcaaatatttaacaggcataaatgaatactagtctctagaatttcactttgacagaaatttttcagtaaatatgttactccttcaaaactttaagctactctttcaaaaagtatcactcaacagcatcacttcaattgcaaatcatagaggcagtggtttcatcctcaccaccctgtgatccaaacttctcaaggaaacaaagttcttactacacgggggtgttattccactgtgtacttctaaagtaactttgactcatgtgcttcttggctggcttatattgtctatcagtatctgatggaagaacataactaacaaatatcttataaatttgttattactatacttatctctgtttgctgggagacactgcatatgttatatcccaaatttccacatactcagcataagctatgcgcaaattcccaccagcacattttattttatagcagttataatagttgtctctatattatgggtatatgtatatgtatgtgtacacacacacacacacacacctaattaaatccccaaaatgtactaatcattccatggagggtgagtaaaaaaatataacagaaaaatctgttgggaattacatgctgtaactaagtgcttcagctagcacaggttgtggcttatgctgcaaatttctagtttatacagtagttaagagaatgtatataccttagacccgtacaagttaagcataaaatgataactgaaacagaacccatctacttagactacccagatgttttatctctttctattctacctgctaatgcctttaaagacaatagagaacaaaaaacattaacattacattttagttttttaaatagtttaaggtaaaaacaaaagccagattaagtctctaatcaatcattttacaattctagatagaaattaggtaaagaaataggaaaacgagataaacagttaagccacagttttcttaaaattcagttcgatttaaaaggaagatttatcctcccaaagtattttgtaaaacaaaatatatttatcttttccaatggaattttagtaagacaatgcttttctttttttttttttttaaaaagggagaaaacactaccaatttcacctcccatcctatatgaaatcttccctaaaaatatcttaaaataagagaagttcaggaaatataccaattgcaaatttactgtgaaagattccattttaaatgatgatcacagatcgttagttatatttagcctagagagttaattattataatctgaatcacaaagacaaacagaagagcagcctatttttctgtaatgcatgttcctaagggacctgcaaaaaactaatataagaaggtaaaccacccttccctaaggatagcgttattccctgactttccaaataaaaactgtagagatattagctttcttcatctacaagttagttgtatatgccaagatatcttagcagagttcaaaagtattccatttgcaaggcatacatgtagacctgtaggggtaaaaagaaataaacatgttcatagaaatgtacatctcagatgattcaccgtaacgatcagatgttaccctcggtagaattagaggaaaaaacactgatgcaaagtttaagtgagaaattataatcattattgttaaccattttatatatttatatagccattttacaaatataattaaaaatcggtatgtcattctctatgttggactaaattacgactaagaatttgttgtctaccagtaatggctttctttcaggctgtggctataattctgttaagtttaaaagggggaaaaaaaatcacccaaacattgcttaatgtaactaatcaagcattttcaaaattaagactgggaatgaaatgttaggcagtatttgcagggattaaaaaatgttgtagtagaacagtactgccatctaccgacaacttttaccagtgcctagggagtgtttccaagagcaacctcccatttatttgtgtctgacccaaggaagacttcagagagacactgttcaagtaaccagaaagaagtaacattcagattggccacggttttacctctgacttttaaagacttaatattttctctctttctattcaaaaagagcatggtttttttaaaaaattttgagttgttaaaatatagtgacccacacaatgaatacttcctagtaactaacatccagccgagaagacggctatgcctattgctacagaatgctcatgctcctacagacaaatctccttcaatgcagtaatacactgtatcccgtatccccgatgcagaattagattcactatatcctctaatgacaaaagcagatcacaaaatttcataagcaagattggatgtatttatgtgtatgtcaatcataaagcatccatattaccacccaggaatcactttatttggggtcactgtgggtccaagtctggcactggattcccgcggtagcataaaaaccccttagggtttagttggtggggaagtcgtggggcacactgacatcccagatttgacagaactcagtaaaattctatacataccaaagacggcaatggcatcaccagcaggaagagccattgcacaccttctataatgctcaagataccaagtagatgctttacacaagttctatcagttttgtaacttaaaagtagatgttgagtggggaaatatgcaatataaagactctttaacctatgtgatggagcagctgaagagcacagctagtcttctaattttgtacatggatgctgcatcccattaataatgtaaaatatatatataattttggtctatggattttaacgttttacggaaaaactgctactgctgttttttttttttttaagacagtaatctgaaaacaggttacagacagaaaacatgtaaatgacagattttaaaaaggatttagtcggcactaacatagcccttttaggccacataattgaagaactccaaggaaccacaaaataaactgaaaaccccagacataaagagatccacttattaattaaaagcagctctctttcgctattaaaataaggttggccatgcatactttattgctgtcacagtctcacatgaggcagtattcaaaacacataaaagtaaagttgaatagttctctatgtagggaatggagttaagtcatgtctgcttgcacaaaactgttttgcaaagcagccatatatagaagatcagggtggaagaaaaaaaagactaaaatgcatcaaatctcaaattcaatgcctttctttggtagggacagtgaggtgtgctatggacaacatgagttgaatcaagaaaggcctaaaactttccttgttttaaaactagaactagaaatcaagacaatcactgcaaagaaagagacagggaactaattaaataaattacatactaattaaatacaagttatttgggaactttttttgtaagtctaggttttgtttttaaacacaaaaagtctgtatcatactggtttatctgtgagaagaggcactggtcacaaaaaagagagacggagaaagaaagggggaaaaagaaaagaaacagaatgacaacagtaactaccaatatttcaaaatgtggtttttaagaatttccaaaaatcacacttccaaaaatcacagaaatgttgtggctaaaaagttcattcctgatactaactgttctttaaaagccatgggcaaccatatggcaaaatctagaactaaaatgaaaaggacaaaatgtgtccttccatatttaatattcatttcttgaaatggataatctagtggtatcttgaaggaataaacatatttctttgcaatgacttgctgaatgtcagagcataacaagattatttacagtctttaagaaaagtatggaaacaagaaattcctataacagattatttaaaaaaaacactaccaccttattttatgggttactaataatcatgtaactctttcaactgtagggtaactgccatacaattacaatgcctagttatttatgtctcacagattatatagtactaaagaaagttacctgttaccatatgtagacacttgtggttggcagatgtggaaaatactttaccataaagatcaaaattggcttaaaaattgacctagcatatgaacgtgatttatttatctccactcccctcccccacctctgttttgtttgcttttcctgtggatgaaagaaggaaaaatagaaacttctaaagagatatacagctttccagagtcaatggtttaatctaagtggagtcagctactgaactttattcagctggtttctccccagagcacgtcttcaccgaagtttctgtttgacctgtttcatttccttggaaaattctggcattaaatgcagctattactggtcttaagttagaaacattcttcttgcttgattttttaaatatgataatcaccttaattttttaatataataagcaccttcacactcatcctatgtttcatggtactaagagaccttcggacgccgcatgctagttccactttcctacaagtttgtttactagtgaaattaaacagtcaatcccatttatctctgaaatcagcagtgtcccctagcaagagataagagacaatgtgtgttgtataatttactgggaactaattcatggtgaccaataaattgtgcagtcctcctaaagcaccccctttgccgtggtgagatccgcagtgccgactctcgtcctggcactaagatagataagtcctaagagtgaaatcagtagacatgtgtcttttttttttccctttaattctgaataaaattccagaatttagggagtgaaaaacacttccccaacccccgccaaaaaaatctgacattttctttctgccgaaagtctaatttctctttccccaaattgcttcaccatatggaaggaaagaatctccaccttttatcttcaatctgtatcacagtttgggcatatacgagaattttgtgttcacttttaattttcttgctagttaagaacaactaacaactttcttgtatgttaggactcaaaatacgtacctcaagagttgtggtacatttcacacaggtcagaagacaagcattatggaaatgaaatgattttatgatgactttgctttaataggggttttacacaggggctttcctgggaagatgtccaggcaaattgtgtccaaagcccagaatgaagggaaaattcaccttgatgtaacatagttgaagagggatttgctgatttgtcattttaaatgaaacacaaactccaattccagcccagttatgagagcattcctttgtcctcttacttaagggatttttctttttcctttctttcctttatttctttcaaatcctacaatttgagaaaccactcaagaagatggggtgtgtatacacacacacacacttcatacatacatctgtacatgtacacacacatccattttcaaacaagcgctaataagagtccagttggctctgagataatatatccaaaacgaatcccactcttcttaagcataaacttcacacaaataactagatataaacaagccacatttaataaggataaataaaatctctgtcaagcttacaacaggaccaaaaaaaagtcatgggggccagagaagtaatttttaggttatttggcaagaaacatgcacacacacacacacacacacacacacacacacacacacacacacaaaaccctcatgcacatgtgtgcatgcacagtgtgtgcgcacacatacacagtttttcgtttggaacatttttgaacaatgaaaaggcaagagaaatttaagcgtcttgggaaatactcttcctgtgccaaataagcataaacaaaataaattctaaaagcaaattttaaatactagaggatggaaagtaaaaatgagccaagctggagtggaaatatcaatcctgaaagaatcagaaagcaagtttctcttgaaccccaatgaatcttgcatttctaagaagcacaattcagttacttgagctgtcctttgaacaaaaatttaaacttaaagaatatatttaagaatataattaagtcagctacctgggattttattcaaaaagtgatactgattattttccccaaaacatctaggaatagtgtggcaataaagtggcactgtgtttcaaaaggagccccccaaaaccttcaaagctaagattctatttagtcaatgatttggctaggactcaccacataaaaaacacaacacaacaaaaaacaaacaagcaaacacacttgagcagcctgtttggatattgtagtacttgttccacagaagtcatcagagtgttctaggagcttctcgtctaggttaacactgacactgctggtcagcaataaatcaaagctatgctcgtcatacaagcacgtaaaatcatcaccttaaatggtatgaaagtatttgtgctgttagaaggtagggaatggggtgaggggaggagcaaggataaggattccttctttcccattccactctcgggttctcttgatcttcccagggtggaggagcagtaggaaactgttcacccacccagttactgtgggaaaaaactggagggctctagtgaaaaatgggaaaactcttccccacacctttatctcaagccttggcttaaggtataatactttttattttttattttttttgagacggagtctcactctgtcgcccaagagtgcagtggcacaatctcggctgactgcaacctccgcctcccgggttctagtgattcttctgcctcagcctcccgagcagccaggactacaggcacgcgtcactatgcctggattttttttttttttttttttttaagagacagggtttcaccatattggccaggctagtctagaactcctgacctcatgatccgccagcctcggcaaggagacaagttacttgatagtcaaactgggccttaaaattatcacgcatcatgttattaaaaggcagtgaccatggaagggtaaatgtcctccctcctcctttcatgagaacactaaaccatcctcccaccatgtaaaaaaaaaactacttatattttttattaaaatttacatcatgtaaaaaaattatgtccaaaacggcttggttaaaaaagaccacctaggatatgtttgtgttcagatttgttaaaatgcagagatttaaagaactaaaattctttattaaagaatattttcaataatttaatggtagctttcttgtggcgttttagagttcgcacacagtaggctgtggtttaggagctaaagttgaatgcgatcccagagtttctttaaataggtcattttagagatagaaaagggtctacaggttgattgacaattgacaaactatttggcccactaggcataaacttctattagatagattattggggctttcacagataaccttggtaacagcattatctaaatatgaaaataacaataaaataacaatcaattttatgattctcaaatcagagctttaagaaaatagatccaaatagcatatgactaagaacttactatgtatcaatcaaatggcataaaaatacttgcaacatggtcatcttgaaaaatttacaatctacctccacggtctgtctgaacaacaaacttaacacaaggcagaatggactgaatactgagaataaatggcaattatgagagcgccggggttgggaagagcttccttgacttgagtactggaggcatgtcaggagcaggttataagaatgctgtggcacttgagcagcaccttgaatgttggctgcattcagagcaaaaagtacgcatcagtacaagcaggagaataaaaattcagggcatcatccacaaacagacatgccagagcttacatcatattaggatgttgtgtgcttgtggccatacaacgcagggacacaatgaaagttaggttttagaaagttaagactcagcagagtggagtgaggaggagcgaaggcaatcacaaggaggccggggtaaccgtccaagccagaggatatgtgggctgaactccaaaggcggcagtgggaacgcattgtggtgaccctgcacgcaactgaaaggagataccatctgactgcatggcaatgtgaagaagggggatgagacaaggatgacaaggcagatggcatcacaactgagataaggcacaggaaatgaggaaatggaactgatggagggaagaaggagaaggatttaatcttgaagaatccaagtatacgaggccagcaggacagacacgtgcaataggcggaattagagattaatcagttgactgattaattgatttcacatccactatccaacagactttcaatgactcaactatgggagtccagaaaattatacggaaaaatataaataactataaatcagcatctgggctcaacattcagatactggattgtgaaactcaagagggatctagggactgaaactgaaaacctggacatcatcagtgtaaaaatgatagttgtcaccaccccttgagagtgggagtggtgggaagggaagggagagaatattcatttttttactttataacaaacttttattgtttgaatttttatcaacagcacatactactttttgtggtcttttaaaagccaatgttttaaaaaaaataaagcaaaaagactgaagccataggaacaggcagtatcacaaattgacttctcaaatatgtgcagttaatgtacacaagcactcaggtgggaactgagaaacacaaaggtgatttcaacccaagtcctgtgtgaatctaatgggaaaataaaggcactggagtcaaacaggattcaaactcctctcccactaatagttacataggtgaattcttaaattccctcaagttcaactatttttctctaaaaatgaggcaaacaatacctcatagggttgctgtaaagatgagacaagttaacgtaattaaagcccctaaagggtagcatttggcacacagtaggtactcaattaagattccctgatttttcatccttctgccaagatggggaaactcaaaatttcagtcaggtttaaaaagagactgaaaagaagtgatcagagggaccgcagcagaaaaaaagatggcaccatgtcatggggactagcggagagaagcaaagcgcctttatccatccactcaacataaatgtactaagcattaacacctgctggagtggataactatgtcaaaggtggtggagatggtgagaagtagattatttgacaactaggaaagaggtccttgccgacttgcaagaagagtcccagcagaacagcaggagaagatactacttggccagagggctaaggaatgactgggtggtgaagagtgacagtaggaagaagtgacagttctttgagaaatttgtaactaagggaatgagaggctcttgtgaagcgaaggtttcaggaaagttaagtagctcataggataaaaggaggaaagtctgtggaaagggagaaagtgatggcagggaggaggtggcagagttcattcacagtgtaaggccctgaagctgacaagagggtgcccaaagtgaggaggctgaccttgggaaggagtaaggacacaccatcgcatcgggaagcaagtgtgagaagtaggctggaaatacagacaaaggttcaggtgtaaaggagagctgaagaaattcaattggattaccatctaccttctcattgaaaaaggaagcaagattactagcaaaataaggaaagctgatggaaatgggaccccagggtgaagaaggatcgaaaactaaaaagactttcccaggagcagtgaggttccagcagagggaggtggcacacatcaatactaagcatttagcccaatgtgattgggctaatgtgatttcctccagtgattttcagtggcctgggatatagacacggggggagtgggaaggcagtcataatagtgggcaaagcagaagttaaaagggcaagggattctaaggatgccagtgagccaacagctgacacggtggactggggaggtcaaggcctgaaggttgagcagggaaggaaggatgagactgagtgacaagaaaagcggcaggtggaaaatggccgttaattggatttaagatgaggaacaagcacgtttagaggaaatgaaggaatgagtaagtgaaagaacagaaggctgtgactggaagacagctccaagcttgaatccttagaaatgaggcaattccaggccatggaaagggttgaagctggctgattaaagggaatgcagaaattcctggaatcgagaggccaggcctccagccattcatgacactggaagccgtggttagctatgataatatcagaagaccaagctaggcaaagaggaagagatccaaaggagaagaaaatggaggaaacagaaaaaatataactttctgaatagactaatttcaaagactgttaaaaataatctttctttagaaataatgccttgcttttagtctaagttattaaaaaaaatgagtaaaacctttaaaatccacagcagaaaaagccatttcaccatttatatgtcttcaactgaagcaaaaatcaaggacctgactctttgttcttcaactcaacacatctgatacggtgtggctatgtctccagccaaatctcatcttgaataattgtagctcccataattcccaagtgttgtgggaggggcccagtgggagataactgaatcatgggggtggttctcccattctgttctcatggtagtgaataagtctcatgagatctgatggtcttataagggatttcccctttcacttgtctctcaattctctcttgcctgccgctatgtaagacatcccttgcttttcccccatgattgtgtggcctccctagccatgtggaactgtgagtcaattaaaactttttcctttataaatcacccagcctcaggtatatctttattagtagcatgagaacagactaatacactatttcaaacaagatggcaaagtaactggtaacaactgaaggaaataacgctgcttctgtaagcactgaggccaagttgtctgagctcaccttctcccttcacacactggggaaggaggaggcctgatgacaggatccctacacagcttgctcaagcacaggtgagccacagcacatcctcctgcagcaagcaaggtggcatgactaacacaagacctaacctcattgcctttacacagctctttcatatccattacctctcttaatcctcacaggctctctgggaggcaggtattactatgagcggctttttatcagtgaaaaaatagagacttgtgggccagaagacttgctcaaacgctgagtctggcagaaaccaaggccctcccactccagaatttagccctttccactaaatcccaccaactgaatgactgcaagggccagatgcacaggagacagcgcagttcagaaaggcctgaatacttctgggtcattctcaaagtcacacagggcagctaaaacataaagcaagataagcagcatcagcaggtattccttagggatacttcacttacaactgaaagaaaagataacttttccacatttgagcacattgaacaattgtcagtgtgctcacaattcatgagaagacaagaaaacccagagtctacagaaatcaaaagtgacagaatcatcatttcagagctgtaggtacaaaacagtaagtggtctctgggtgtgcagaaggagttaacattttctacagagtaacaccttttctgagaagagactggactggcagaagcaggagataagaggatgggttggaaaaaaccacaacatcttctcaaaccaagagaaagacaagatagaagtagagaaggaaacttgggacttgtatgtctgtaacgccagaggaccctgggcaccttacatgaaaattatcagaaatgcaaattatcagatggctaatttctaaggtcacctggtgccaaacacattacaatttcagtctctgcctcacacatctcacatccctaaaaatagaggcaaaggggacaaaaattatcttcagaaagcctggtgtccactaagcctggcaatatattctatgacaagccacattttatcacagaatactacaatctgaaaaggttccctgagatacatactgctaatctaaagaagtgttgaaccaaaattgtaactaaatcaccaaattctgcataaacccagggggtagaataggttcaatattcaggactagctcaaacaggtgaatttactcagataactgatgaaatctcatcttctaaagtccttattaccacgaggactgacccccccacccccacccacccagacaacaaaagagaaagtcaattaataattatgatataaggttattctcacctcccccattactgtttcttggagtttttatgaggttttgcaataaaaatttatagctatctgaaatagttctaacctcttccacaagtagtttgcttatttgttcatccttttcctctagcccatgtaaataaaacacaaccttcactttcatggtaagaaaaatattccctttaatgaatttcaggaatcaggaagaaaactgcgctagtctcatggatctcatgttaaggattctaagaattctttacttaagagatctgttttccttattcctcaatctcctttaaagaagctgagcatttttaaaaggatatcatagtattactttaaaagcaccaaacatagcatccctgaaaataacatgtttcctgtcgggagaagcatgttaaggtgtctgtgagagatttctggggtttattctaatccatgtttctggggggcatctgggacactctaggaacacaagggcccctctttccactttggttgtcactagtcacacagattttcttactactcactgcttgactgagtcgtctcaattcattaaacattctctgagctattggcaagacttcaaccatggtgacatttcctttacactagatcatccaactatagccttcctagaaaacaatgcttggacagtagcaaaagcctgttgggtcagctaacgacatcaagttataataagatctcaaagtttgtctttctttttaatttttgttttcttctctagcagttacaacatgcaccttgagatggtaatagtcaaagtattgactgaatgtgcctgccccctggtggctggtggggtgaaggacacactgtagaaatccttcgggtacctgcatcagaatcagacacgagagatatgaaagcaagcacacaaatcagaatttgctgtagtggagtattacgaagatctggtataaaatgaaataaaatagagtttaaaaaaggaaaacattactaacaaacagttttagagacaagtcaccaagatcttagcttgagatacactaacccaggctcctcctgccaaattatgagcaattattgtgctaagtatctatgtgcacctgttgttgtcctagcttcttccaattaaattataatcttaagattattgttattcggaagaaggagtctaggttagcatatctcaagctaagagcttggaaactgaaacacattttaattgtggtcattgctccacaccataggggctccctctgggacatggtctcaactggctctggccgattctgatccccaccggcaatctcacttcccgttctcccctttgaggccaaattgtccatggtgactttaaacctggattcatagatgccttcaggacagggaaaaatctaagcctgtgaggcagcaatacggggagtaaaggagactgaggagagacctgtggtgactaggaacatggcttcctacaggcattcaaactccattgtttaaaattaactctacattgcccaaaaaacatttttagagcagtgctctgctcacccctgtaatcccagcacttcgggaggctgaggcaggtggatcacaaggtcaggagttcaagaccagcctggccaatatgaaatcccgtctctaccaaaaatacaaaaattagctgggcatggtggcaggtgcctgtagtcccagctacttgggaggctgaggcaggagaatcgcttgaaccggcaggcggaggttgcagtgagcccagatcgcgccactgcactccagcctggagacagagtgagattccatctcagaaaaaaaaaaaaaaaagaaaagaaaagaaaaagaaaaagaaagaatgaaaagaaaagaaaaggtgaaccaaaaaagcacaaagaaggaagaagagaatgtcctgaatggcctttcccaaccaccaaagacatgcacccagatgcctcaatacggtctcctcaaatgccatgggactacgtcaaaaatatatatatatctttccaatgaaccagctcctgctcttgattttcctatttctctcaaagaaatgatcactttcccagccagctggacttggaaaaggtgtcatctggaccctctcctcctctgtgaggtatgagcaagtcttccctgtaatcctgtcctctccctctgtgcgccctcatccaggttctcactccctagggcctttttcttgttcctatgcatccagcattttcccttagagatcccagtataataaattactcaaatatgtgcagtcctttgtagttacaatgtgcttttgccatattttctattttagttttatttttgagtatataacagcttggtaggtaagcaaaaaaaatactatttctattttacaggagatgaaagaaatattgagaggaattaagtgatttggccattgccactacagaatctcactaatagcatttttacctagatcagtagcccatttctctctcctgctctctgttcctctttctctctctccctctttcccctgctctttctggtctccagcactgtataagccagttgcttggggaatgtttccacgtggatatcccacaaacacattaaactcatcatgatgaaaaccaaatgcacccttggctcctctcaacttgctgctctgctgttctctagttcagtgaacaaggatcacccacctagaaacctggaagtcctgactcctcattctccttcactgacccatccagtcaccaattttcaagtctacaaaactattaaactgtttctcgaaaccaagtttctctcaatccccactgcccacttctgccaccctcatccagcctataacatccacttctctgtctctctcataacactcttatctgcacagccccagtcaatccatccctcacacttcaccttgaataatctttcactctgcttcttacaacattttgatgtctcaccaaaaccctcaaaataaaaaccaagctccttaacaaggctggcagagctcatcagcttctctgggtggtaactccttatcttagcttaggctaccatgacaaaataccaagaccctgggtggcttaaacaacagaaatgtattttctcacagttctgcaggtcggaaagtccaagatcaaagtttgagagggttcagtttctgatgagggctctatttctggctagcaaaccattactttgtcctcacatggcctttccttggtgcatgagtgtggagagtgagggagctttctggtgtttttaaaataaggacactagtagtatcagattagggccccacttttaagacctcatttaaccctaattccctccatatagaccctatctccaaacgtagtcactgggggacagagcctcaacatatgaacttggggagacacaattcagtccatactccctctccaatctcaagtgaaggcctgaccacttagcagtctacgctgcggccacactgactgctcatgtgctgtctctaaatccaaatccttgtggagccctctccagaaccctctccttttccttaggctccctataccttttgcttaactaacccctcactctttaagtctcagcctccatagtcttagttcttccaaaaagtcctgcaatctgacctgcaagccctttcccctctgggattagaggccctcaccaaatgttcccatgatcctgaccacatttgcctgtatcctttactagattcttggctctttgacagcaggtactgaggctgtctgttcacggctgcaaccctaacataacccaagagcactattaatacatagtgctctttcaataaatatcattgtcaaatgccattctcaaaaaggtaggcagaaaaacaggaagggaaggagagaccagagtaagcaatggctccttactatctatggaaaaaagtttccagttgttctgacattcgaagctcccttccactgggcctcaagaccctaagttcatatttgaaaggctgcacaggagaaagcagagccttatgctgcatttgggggtaaaaatagaaccaacaggtagaaatatgggagaaacagggcagagtgggaagggcaggggtgcttaattaaagacgcatgcccacctaccaggaaagccacaaaattgcttctcagaacttgtgttcagggacctctccggtctgctctgccttcaagacacattcttttctcctctgatttcctctattcccacaagagccatcaattggagtctaccctcagccccttgttcggctgacactcatgttcacccctgccctcatacaccatccttgtttgcaatggcttcacaacacccagttctatgcttctcctagtccagccgttttcaatgtgtgcatggactcctgagggtccccaagaccctttcagaggatctgcaggatcaaaactaatgtcatcatactaagacattatttacctcttgcattgtgtttgcattaacattgatggagagagtgagtgagtgaaactgctggccctttagcacaaatcatgctggtggcaccaaactctaccagctgccattgtgttttacataaaaatggccttgatgaagcagtaaactatcaattttattaaatcttgacacgttactattctgtgtgatgaaatacatacaaaacatttctgctctatgtaaaagtctaagggttgtctcaaggaaaagtactcgtgaacctaactaacttctcttttcatggaacaccatttttacttgaaaaaatgacttacaggcaaactataattattcgaacttgggtatttcacagatattttcttaaaaataaatgaagtgggcatgtcaattcaaggaaaacaactgttagtatttgttgccagtgataaaattcaagctttcaaatgaaaattaaattcttagaaaacttgtatctgccatcatgaacttgacatatttacaagactgatattgtgttaacatttggaagatttacataactagatgaaccaatattttccaagaccaatgtgtaatattacaaagtcatgcctgagcaaaagagtctttcaaggtccaagagagactactggcttttaacataactaactagaataagttcactgatatggtttcaggttccacatggcaactagcccctaaggaactaccatttgattgtttagatatagaatcacagaagactactcacaattatcagaaaaggctattaaaatattcttttccaacttcatagctgcgtggggttgaattttcttcacatactttaaccaaaacacacaacagattaaatgcagaggcaaatatgagactctagctgccctctattaacccagacattaaaaagatctgcaaagaggtaaaacaatgccattttctcactaatttttgttttggaaaatatagttctttttcatttaaatgttattcatattaacatgtaatgggtttatttttatttattttttgagacagtctcgctctgttgccaggctggtacaacggcaagatctcagctcactgcaacctctgcttccctgattcaagcaattgtcctgcctcagcttcccaagtagctgggattataggcgcgtgccaccaagcccggctaatttttttatttttgtagagatggggtttctccatgttggccaggtctcgaactcctggcatcaggtgatccgcccgtttcagcctcccaaagtgctgggattacaggcttgagccaccaggcctggcccgttactattgttatttttaaatgcattagtaaaaaaaaaaaaaattttaattgctagaacattaaatatcaatacccacattaataaaagctatttgggagccttaataattatcaatggtgtaaaggggtcctgagaccaaaaagtttgacttcaccaggtgtttgaacactacagatcccatcttgcccatgaagcttccctagacatccccaccccaccgtgctcccttctgcatcctacaatagcatccactggtaaggccactattttaataatgatatggttgctttatactaatgaattatgtttttgtacaacagtctcctagtgtccatgtttaagaatttaagggactttgctttccaaagctgttaacccaactagctctgtgaaagtgaaacaaaattatggacttaaatttctgtctgtgtcaaaaaagagtaaaatgcaccctctagtggacttgtaagctcacagaacacaaaataaatttattggattgtcagaagaattacaactccgtcccagaaaattcagattataaaataataatatatgagcatagggaaattaattttaattttttgataatatgtttttaaaagagctaagaaaatgtgaaaccaaatctagtttgaatgtagttcataactaaatgcaaaagtaaacctgaggtcacacacaaaaaacttctttcttaaattcctatgaattgattatacatcggctatccaaaataatctgttcaaattatgtcttattaactacttataactttaaatacatagaagcattaacatggataaagttgggattattattagttcaatttccaaatattaaaactacactcaacttacaacctgggcattccaatggccttcacaaaatctgaaaaaggacctttgaaggataagaaccaatgcttggggtatacttttaactctgtatgttaatgttaaaaggatttaattctatgcatctttctctaggatgacataagaaaaacagtgtaaaaatacactcaaccttatcagataaaataatgtaatgacatggaaagaagtctgaaatatatggttaaactaaaaaatgtagtcacagaataacgggtggcatgatctaatttatgttttaaaaaatgtacgcacgtgtacccatgtttatgagcacatatgcacgttaattctatagttaaaccttttttttttttttgagacaaggtctcgctctgtcacccaagctgtagtacagtggctcgctcatgcctcactgcagccttgctcctgggctcagcctcccaagtagctgggaatataggcatgtgccaccacacccagctaatttttataatttttgtagagacagggcttcaacatgttgcccaggctggtctcgaactcctgggttcaaatgatctgcctgtcttggcttcccaaagtgctgggattacaggtgtgagccaccaccccgggctatagtaaagtattaacatttgttatttctggcaaggaatatgcattagtagcaaaaataatggaagggcatttgactatacttctatactgttaagatgctgtgagcatttttaattcaaaataatcaaatatggaatttttaaggaaattacagttataattaattcaaagaactgtatgaaatgggaattgttatttcatcaactaggacattaaaaggtttgagtaacaataagaaatttgatatagctatttggtttttaaatcattagactggaaaagaaaattttttaaatggctttatcaccagaacacaatgtctgattcctctgatgataatgcaagctgaagtggtatataaaatcctctctgccacttttaaactctggcagagatagctactccttccaactgatagtgtctgatcggataactatgttcctttttaaactctcaaattctataatttctgaagtgctgagatactgtcatagttatggaagcattttctagctttgagtttttatagatctagcctcagccatacagcctggtgggtacaggtactttaagtgaataactggctttattaatctcaactggaagtggccgagttgaactgaaactaaacacagacacacacacacacacacacacacacacacacacacacaaatcagtagtattaccaaactacaaccactaaggagcatactcatccaattttaatttgagcatcagacgcaaaaagacagaaacaatatgtatgcttcgtctgtcattctaatctgaacacacaatgtcttcaagtcaacaacttaggtagatggagcagactggccaaaaataaatttctattggcaacacttctgtgaaattctactggtcctttataatgtgccagtgtttcactctctaatcatatattgcccagtgcatacattcatttaaacaaaatccttcttttcttcaagtaattaaaactctttaatcttttatctattttaagcctacttccattaatatttgtatttagacatttgtctaaagtgaaaagtgtcccaccagagcatgctgaaccttggtatcttccttgtgaataaaatttagctggacacatagccactcaactacagaatgcagtttccagactcctttgcagccaggtatggccgtacgacatcattggaacatgagtgaaaatgatgtgtacaaaggaattgtttgttctccttttccactcttttcacttctgatatggtttggctgtgtccccacccaaatctcatcttgaattgtagctcccataatccccacgtgttgtgggagggacctggtgggaggtaattgaatcatgggagtgggttttcccccagctgttctcgtgatagtgaataagtgtcaagagatttggtgggtttataaaggggagttcccctgcaaatgctctcttgcctgccaccatgcaaggcatgcctttgctaccccttcccattctgccatgattgtaagtttcctgaggcctcacctgccatgtggaactgtgagtccactaaacctctttttctttataaattacccagtctctagtatgtctttattagcagcatgagaatggactaatacaacttccctattggtagagaagtaccctgaagtattagaacattatacaattatcttaatagaaacagcatgctgacaatgcatgatcagacaggtagatcaatatagacaccaaaaagggggaatacatctaagtacatacagggaataacaaaaagcagtagcattttatgtaaattagtattgtctatttaaaaggaaagaagactattaataaagtcagtaaaaacgcatcaagaataacacaatctgaaacctggcacagagaatgcaaactgtgtttttaagactgttaccacctgagggcactacttcagctgactagaagaaatgcgggtgatcctttgtagaatttgtcttgaatttgccaaaccttcaaaaataattttttagccaaaaatgatcactgtcgtatctacggttaatgtagcatgtcaaaaagcgggaaacagatggatgactcaccaaatggggctgggcaaccaactaaccatatgagggggaaaagcaaagttgcatccctacttcactacttactctaaaataattccactgggatttgaattttaaatagaaaaaacaaatccacaagagtaccagaggacgtttactataataataatttttaaatctttatatttttaggggcagggaagagcattcaaaggatgaaggaaagcatctgaccattctttccatatcactaactccccaacatccttcctggcattatggttaccccacccctgagtttaacaaagttaaaaaacaaaatgggaatggaaaacgagggagcaacccagtcacttaatttttcatgccaaagtcactcaattttttataagcccagattcaggggttgaccctttgtgccctggaaacactgcacgtgaccccagcactgctagctccagcttctgagcctgaaatactctttagcctaaacctggccctaatacacacaacaatcacaaaaaacaataagaataataaagaacccagcaaccgttggaaccctgaggaagccgacggtgagtgaaaccttcccgacttctaaaaccagctccaagtcaagtctgtgaatttgagtctcgcaggatgcccctttcttcctgtatcactccgccagagaatattttttaggaacatagagcactagaatgagtggctatctctaaagccatcttaagtttatattcttcagcagctgactcaataacctgactttgacattaagccgacttcacagaccaactgtcacttcaaagaacaagaaaaaccttgagtaaaagttaaatgaaaagtgttttccaaatcactcgcaaaggaaacagatcaggttgttgtaataaagaatgtaatcaactcatttcatgagctaaaaaggtatcctcagaaacaggaacgcttgactcagggtagactgactctgtcaaaggtttggggcctgatgttgacgactggcaaagaccgagatgaaatgaactcattttgacattcaagttagagttttctaatctaatccatagcaatcatcctgaggtaaaataccaaggtgccacttttatagtcattgatggggaactaagccattaatgactcttctaagtaatacagcagttagtgagtgacagaatcaagactcagatgaggtcctctgactctacaatcaaaggtgtttgactccatccctctagcaccctccatggtggaaacgacatttaggtcaatttataacatccgaaaaagacagactagctgtacaactattaatagataggaaattgacttatctttgggcaatggcaagggaaaaggcttttatgaatgccattttttttttttttggaaaagtaactaaccctattatcctaggcattggattttaaaaatgccatctgaaatatacagttcaggtatctcttctgaagtaaaatattggtatgtatcagttggaaaagactcttttccaccccccaattgttagtgtagctaagatgatacacttaagacttacacgagtaaagaatcacctcaaagaaatgctcagtaagtctttggtttctctggattggcataagggagtctgtgtccctgtagaagaggctgccaggggttccccaatatatattctcctctcttttgtagtgagagaactgagtacataggcttatgtgttttccagcctcacttgtagttaagtgtgaccatatgtctatgttctgaaatatgaggacaaaaagaagttaaattctagaatgtttccttaaaaaatgggggcatattttttgctcttcttcctttctactgtctgaaacgtgggagtgatggctttagctcaaataaccattttggacaatgatgtttaagccaccattgcagatggtgaagcaacgagatgggaggctgggtcctggaaggttaggaatccccatactagccctagactatttacctgcaagtctgtttccctgggacagaaataactttctaacttgtttgaactgttgttcactggagagtagaacttaattctaacacatcatcggccgggcgcggtggctcaggcctgtaatcccagcactttgggaggccgaggcaggcggatcacgaggtcaggagatcgagaccatcctggctaacacggtgaaaccccatctctactaaaaatacaaaaaattagccgggtgtggtggcgggcacctgtagtcccagctactcgggaggctgaggcaggagaatggcatgaacccgggaggcggagcttgcagtgagccgagatcgcgccactgcactctagcctgggcgacagagcgagactccatctcaaaaataaaaaaaaaaaaaacacatcgccaataatttttttttttttgctttgtaatattcaagtcatcagttggctcaaaaggtgtcattaaatcatcaaaattttaatttacttcaaattaaaaaatattttccacaagcacatgtctgagtatacatgcaggtagagtggggacacttgcagaattaaaaaggatcaaaagtcccactgtaaggtacatcaagtatcgttgatccacgcttgcacagaaacctacttatgtccttttcacaacacctaaaagattgtgttgcctaacatactgtattgcaagtgttcgtttaggagtttaccaacaccattcccactccctgccatctagactaggaagtttctggttcaccatcaaatcctcaatgcctagcattgtgccaggcactcaaaaaactgggtgaacatgtgaaagactggccttcgcaataaggacccttctcatgatttgaaatcctctcaaaatacaagttgaggatccctaatccgaaatccacaaagctccgaaatccacaaagctccgaaatctgaaatgctccaaaatccaaaattttgtgagcgtcaacatgacactcaaagaaagtgttcattgaaggttttgggatttcagatttttgaattggggatgctcaaacggttaaagtatctgcaaaaatccaaaagccaaaacacttctgatcccacgcatttcagataaaaagtactcaattggtactagttagatatggtactaaatgagttctgaaattactcacatcccatcagtaatctgacaataaataaacagtcattttaacaaagtctccaaacttctgaattattaatgatgcttaatactatataatgatacttaatcaaagtcccaattcttaactattttactaaaaataagcctgcctatgtttataccgttctgtccataaagaaagaaagaaaaaataagccagcagaacaaccagtaccagaattatatttagattaccctggtaacctagattacctaaaaaaacctaacatctaaaaaatccctaatccagattaccagagtaatctaaatataattcacccaatggttgtggtagtaaaaatatcaccctgtatgtcattattattcagaatcataaggaaataaaccactctacataagaatattctttctaaaatgtaatatactcagcctttttgtcttttatttctttacctatagagataattatagttactcataggttcttttttccaagaccacatgatttttaatgtgcttctcaaataatactctctcaatgaaaggtaaaataatagtgtttattatataatttgctaccttcttaagtagaatacattcaacataattcaactttttgttatgactcatgagagtaggtcatcttaaaaataactaattatataattccgtgttgaatccgattccttatataataggcatgtgtagacaagatatgtagcaagcacctaaggtttaaaaaacatgagcacatcttgaaatggacaaaaagtcatattaaatgttctcctttttcaagatttcaggatgttgcagaaagaatgccataacttctgggggctctgtcatccactgagtttgaggaccaactagagcaataattttgaatctgtatttcttttaaggctaatcttaatatctaagtcataaaggacttgacagaagtataaaggaatagcctcacgtatagcctgagacacatacaaaggcagaaatcgggctgaatgacctagtcaaacactgcacacagcctgggtaaacacccaattcacggtgtccttacctgcctcgattagcaagatggcccagcaatgcctcctgagggacctatgtgcccctcttcttctcctgcatcacttttaacctgtacacgtacacacacgcacacacacacacacacaattaagttataagttacatgttaaatccagatggtttgaagggctaaatggtaaagtaataatgataacagcaataataacaaatatttagggaatatatagggaagtatttttacaatcctgcatagggaaaggccttctatacttttcttcttcaacagtgccttgattggtcctaggggaccacttactcccactcagtccacgtgatttgggccgggatgagcaacctcaaactccgaagataagcatggatgtaggcctggccaatcatagtctcatacaccctcctggtcacagggtctgttcatgaataggacacataacctaagccaagacaatcagaggaaatgagactctagaataagacttctgttgaaactactgggaacaaatattttcttggaagggttgctgagaggccagaatgcaaacgcagagctcccggcagccatcttgccaccaggaagggaagcctcttctgaagatggagacagcatagaatgaggcggacctgaaaacggggttaggtaagcaagtcaactgaatgatgtcgctcgtgcctctgaatacagaactgcctaaagttgcacttacccctttttttcctaggtcagtttacagtttggggctgcaaacaaaaattataacgaacacacctccttagagcattccaaatgaaattaaaattgcaaaatgcacaaaggaaaaaaaatctctttgctcataccttttcaatatagagaatataaatcaagatctgaataccaatccctagatgtagacaatcttaccaacataaaaatgtgattgcctgtcccagtatgaaaaacatcctcctgtaaacattgctacaacaatttttgaatcatttaattatttgaagattacatctccaagtatcaacaataatagaatattattacctgcttaggaatagacagattcaaaaagattttaaaaggaggtggcaggccattaaaaacaacatgacaaatcatttctataaaactattattagtgtcatgaaactgtcctggtagtatcttttgagaaaatatgcaccaaagaattcctgaaaatatgctgctaaaccttgattacagccttctgtaaatagatgtaatctaggaaaactcaaaagcctgttatttgtataaatataacatattcaagctgacaagctgaaattatccgccctttgtattctcctcataagcacagactgtgttataaacaaatccttgctagtctaggcaccagttgaaatccccccctccaaaatggaggctattgataaaaggcttttaataagtcgtagtacagatagaaacacatgtatgtggtgactgatagtaaagtattaagttttcttataatactaaaaattcaaatgcttagagtccagacaagacaaaagcagggaccaaggaaatggttattgatgaccatgtaatgaacctgaaggaacgagtcccaaccaaagggggcagcagtcactcatgaatacatcttcccaattctgatttttcaaaagaagctagaaaacaaattttgtgtgtaatctcttgatatcaaaaacatgtggcccattggcctctaaagtattttgcttgacacacaatttcttaacatttgtcacagacatttaagatctagagatttcacacaaaattttgcagtgactgttgccaccttgtccaagatgtaagggtgagagattcggaccaatctctaaagaagctcaaagttaggactgagcaagtatgggctggaatttgagcaacgatcaaagagcaagtatcccagcagttatgcacaaatctctaattcttagattttagacaagtcatcttccctctctgggcctgtttccataaaatgacaaaactagattaagtaataatatgaacgtttccttcagcaatacaattttatcattctataagaagtccctaaaatagcatccctataagtgaaaattctagatttcacccataactaataatgtacaaaatagtttacaaaagagaaacacccactacctgtactattcatattagtaaatgagtgtgtaaaaataactgacaaactaatgtaattcacagacctgtgtattaagtagcttcatgaattttatgaagtttttcatgtcaaataccattagagaaaccacgctcaacctcaaaagtctcacaatcacacagaaagggtctttatctgtaggaagtatggaacagaactactgaacaaaatgaatgtattttaataccactccctaaaacacgggaaggaattctctcctgtatacacccaaaagtttttctaaaacgggaaaaaaaggtgaaatcacaaaatcaaacacaataaaggtcaagctaaagaatcatctagactggcagcaataccataacttcctgttataaatataaagtaatgggctttcaaatcagaaatgcaatttgatagaaaggccattctaccaggctctggaaattgagtccaaggtggacactatctgcctctctccagcactgtccctccccatcattatcaccattaatgatttccctaattccacacattacgtaaacaaagaaaaaggtagccataaaaaaaaaaaacatcagaaggttaatcatcagcatttattaaaaattaatagcactactggtgttttcagcatttttaaatttgaaaattttaaaattaaaagtataattttaatattaatatcaatattaattttcaatgtgtgctatttctaaaatgaagaaaatactctaataatgatcccaagtaaattttctttatgtaaccagaatcaattcagcgggagaggaatattcttctgtctgggtataattatgtttggggctgcctgcattaacttcaatcttccctcctgacatctttataaatttaacttcatgataatgttctattcctttatcctacttctttaaaataatctctcaaagaaatctttaagaatgttttataataatcacaagaaattagtaattatggatttgtaattagtaaccactgaatcttagcaggaattacgaaaaagaaaatctatggaatagtatgtgtcaaacaaatagtcacaccttgcttgccttattcaactgggcagaaatcagacttcagtgaaaacttttaaaaacttctttcaggttaaatgagcagacactttttgaattaacagaattctaatttttaaaatctcttaaaagagacaatctgatgtattaacaaaagaacaaaacagaagcttggtgatctggactcaggtaccagctggtgctactgctgactggctatgatgtaacttcaggcaagttcaaaaatgctccctgggtcctaagcactcttgctctgtgaaatcaggatggggacttcttttttttttgagatggagttttgctctgctgtccaggctagagtgcactggcgcgatcttggctcactgcaacctccgcctcttgagttcacgtgattctcctgcctcagcctcccaagtagctgggattacagacatctgccaccatgcccagctaatttttgtatttatagtagagccgagggttcaccatgttggccaagctggtcttgaactcctgacctcaagtgatccacccacctcggccttccaaagtgctgagattacgggcacgagccactgtgcctggcctaggatgtggacttctgaagtccatcataattctatggtaagcccctttctgataatattgtatccaattcacagggtaattaaaatagttcaaagagttatcaacactgcacccttttgtcagttcttcattgtatatccacccaggggaagtgtcattgatagatttctgagccttaatcccttaaatcataacaatatcccagaaatattaggtgtgtcctagaaagtctataaagatcttcactcactttttttttttttgaaacaaaactgccttcccttcttcctcctgttctttttctctgtcaaattaaaatatttcccttaaggtaaacttcacaaataagggtctacaaactcctctatgcgcccttattctgggttttcttttcactaacatgaagctattctcatctacacgatccctccgacaacttgcccactccctacatttcagaagacactctcaaagctcttgctctgtagccccgacctatcccccaagcttcagactctcacagaaactatgtgttgtacaaagccacatggacatcccatggatgcctcaaactcaacatgtccaaaactaacctcccccaaacatgttcctcctcccaaattctctatcccacttcacagcacctcatgcccaccaccatcccaggcacccagccagagacggggaatctacctcaccactccttcatctccctgactcaacacacatgatacacagacaaggcttttatctcttacatgtgttttgaaactgcccccttctctctattcctgcgaccatcaccaagttcaagtaacttttcttttattcacatgttttcatcaagcttaggttctcaccacctcctgcttaagaggcaaaacctctttttatatacaaagcatgcatacacacacacacacacacacacacacacacacacacacacacacacacagagtacataaaacatatacacagtatctctgtggtattaaaatgtcataagggagagggtgattaagaaaaaaatgtctaaaaagcccaggatggtcggggaagcataatgatgaaaaggttgagaaatgctacagttattggatttatagctccttatcagcaaagactgtataaatgtacatgataaaatctctaagataaataattcaaattaaaataatttgcatttttgttttctccaaaaatttcttttgtatcttggatattattgaatgtaatttgccctctgccaaagggatgatgccactggatagtcatgaagatgaataatttcctattaaaagtaacctagaaattaaggagttaaagttttgttttttttttttaaggaaattgttttttaaaacacattataaaatatgtgtgagaaagtagctaggactgaattaagattgaatagttatttatgtctgtttcctgtttagccttttgacaatgttcagccccatattttatagtcggctttggataaggcttcccagaataaccttgatgtggggtcggctggtagggaggaccccagaactacatcctgcaattcacaccctatgaacgcatactctgctaaactcaacaacttcaaaacaaaaaacaaatgtcactgtcccatttcctctgcaaagccctgttttcaaactccaaaacacaaagaatgggaggaaaggaagagaaaaaaaaaaaaaaaacccgaacacgtttagaaacaaaggcacattgtgagataacattaagagtcctttcatattttttaaattcagctaaaaattccccttcaaaatctgaaaaatggaacaggtgagtctatgagagaaacaaatatcacattagcaacgtatttttgatgtgtatagaacatccttactcaatataacatactaatttatggacaaatgcttgtcaggttgggcagttataaaaatgaaaacctcaaatcacagaaaaaaataaataaaataaaatgaaataataaaaacctaacaacagcagaggaacttccatgaatggggagagctggtgaatgtgaaggagaaaaagatgatggagcttttttacagcacgaagacaaaaattcctagctttggaagtgggtctctgaaacatgagggcatatttgattaaaaaaaaattaagaacaataaagggaagaaagctgatggtaaagaccagattcttaatacaccatcaaaaatggagggcttctagtaacctgctatgaactaaattgtatctccccccaaatgtatatgttgaagctccaacccccagagtgatggtttctgaagatggagcatttgggaaataactgggttttgagaggtcatgagggttgtctcactcagaatcaaagtcaaaccaacaaaactatctcttaccatgaccaacaagaccatctctcttcaccatcctatcccaccccacctccaaccttacctatctccatcttctctttctcggactcactctcctgcaaccatagttggcctcctggctgttcacttactaaccaaggttgctctgattcagggcctttgcaatactgtctcctctgcctagaaaggacttccctccactgtctgcatggcttactcctatagcttcttcccttacagggaaataaatttctctgactcccatcccatacactcttttttctcactgccttattaatcaccagagcccttaccaccatctgacattctttcatttacttatttgctaattgtaggtcttctctactcgaatgtaagttccatgaaggcaagaattttgtctggctcatcagagcaatgtcttacacatactaggtgttctttaatatttgctgaatgagttggtcttgctcatctctgaactgttagtgcctggtgctagctgtgtatatgttgaactaatgagtattcaaaggaagcaagtcatgggaatagatgaattcactccccaagacagaaaaagagaaaaaggccaagcatggaacactgagagactggtaatacttaaaaaaccagactgacggctgggtgtggtggctcacgcctgtaatcccagcactttgggaagctgaggtgggagaatcagttgagcccaggagtttgaggtcaacctgggcactgcagtgagaccctgtctctaaaaaaaataataaaaaataaaaaaaagaatcagtgatggaaaagaagccagtggaggaaacagaagaagagcaacccaaaaattagaagaaaaattaggatagcgtattatggaagccaaaggaaaaatgatcagtagtatcataacttggcagacaggatgcgggctgaaaagaagtggatgcatataaaattagttgagctgaggtagtagagtccaactaatgacccagttgcagttggctaaaaaaagtggaggtagaactttctatgtacatctcttttagaaagtccatcagtaaagagaaggaagagtcaaatgtgcaatggcagggaaatagagcagagaaggtatttttcagaatagaagatacttgagtcaacgaagaaggaaagacagaagaagatataagaggaagtgaagataacagagaaaaaagttcagaagggaacgggaagagtagaggtaaccaattaaccttgggaataaggaaggagagagataggtaacaatatacagaaacacttgaaggagagtaaaagtgcaagaattcccatctctagtttctaagtgaaggagttcatgaggtcatatctgagagtaagaaaggagaagtgtggttgtggttaagagcaaaaaaaaaaaaaaaaaaaactttaacagctgtaggagaaaagaaggaaatcaatccctagttgtctgaggaatacacagaattcctaaggcacgacagaggagccaggagagcttgtaagtaattaatcagtatcaaagccagccaacagggctatagcagtttctgtcacacagcaattggcagcctgccaggagaaaaaccgagttagagtggctgtgcctgggactgcatctcaagggtcctgtggagaatatattcaatgactggtcatagggtgtgtcagaccatttttgcattgctataaagaaatatctgagtttgggtaatttataagaaaagaggtttaattggctcacagttctgcaggctgtacaggaagcatggcactggcatctgtttctggtgaggtctcaggaagcttacaatcatggcagaaggctagcagggagcaggcctgtcacatggcaggagtgggagcaagaggtgggggtcgagggaggcaccacacacctttaaacaaccagatttcctgagagctcactatcatgaggacagcaccaagaggacagcatcaaatcaaccataagaaatccacccccacaatccaaccacccctaccaggccccaccttcaacacgaggaaccacacttcaacatgagacttggggggacaaacacccaaaccatatcacagggcttctggctaagcagggaaataaaagcagcaggtttgggtgaggctgacagaattggagaacaggaaagagatcagattttcaaaatcagcatgatgatgagaagcaagtttagttaaagttggagaagaaaatacctgattgtgcagtctctgaagtgggaagaacaaggttcagtaagttctgaggagtagaaatgaaggtcgctaagagacgaaggtctgtgattttggtggtcttgatgagagacatgatggtggagagagggagaagtacagggacatgggtagtagggacgggaccaaaaaaaacaccaagagctggtgacaaagggccattgaagatggagcagagtccacaggtcctgggggcagcctggagggagaaccatgttggctgtgaaactaactggaaatcccacatcttctgatcccagaacaacccagctctggagagatctagacttacaagtaggcacagtgaaggtcactagggtcaccattttagtctacctgaaacacaattcactctctgaaagaagttataaaaagcaaggtccacctcctaacagtgacaggctaactttatttaactaaatatagttttactatatttagtaatctaacttcaaatgctttcaatcagatgctatattaaattgaatcagcctatcttcctaattattaagcatggcttggaaaagctgaaggaaacacaacactgctaatttgcacagaggcttagaaagtgattcacttgaaagcccctcccctaattcaggtaagaaggaagaagataagtaaacaatgatgtaaagctttaattactggctcacactttttatgataaaacacacactgcaaaattctaaggtggccaaacaactcttaagcatgctttgaactttagtgcaaagaaagagatacgtctgtaggcttttgacaaacatctaggtattttcatttaattttcccactcttgtttgttgagtatgtttttccacaagcagaattaaattaaggaaagccaggctttttaaaaagtaattgaatattagcattagtcaacagcaacagtttgtaatatggtatttccactgcagcacctagggatggcagaaaacggaggctgctgataaactgtactggcatcttatctgtacccttactagatttctaaagtttatttaaatggttattctgtatctgtgtctcataaagggatgtcatcagaactgccacctaaggagctattcctaaagacctcagacctactgattcagaatctccaagaataaggatccaacaagtagattttaacttcttcagtgtccaccacactgtcctgtttaagaacacctgtagtgtaataaggtaagcatgaagtgtccccaattaagaacacaatcagctttagagcagtggttctcagccttgtctgcacaatagaatcaccctggaggacattaaaaaatcccaatgctaggccacaccacaaaccaattagtacatcagaatccctggggtaagacctagatattggccttttgctgcccatgggattcccatagtcaatcaaagttgacaaccagtgaagcagaggaccacgtcaaacaactgtttaatgaataaatgaaaaagactaatttaaaattctctgaatttttccttattgaacacaagaaatgatattccatgctatcagcaacatgcagactaggatcaaagggctatggaccttatagtaactggagagattgtctgtgagtcatcaggcagacaacagaaaccaaactaagcaggtggcaatgtgttaggaaactcctgaatgcatttaacatttagtaaaaggatctcgacatcactccaggcaaaaggaatgttgatctagtagttaaggtaaattttctttatggaagagactgcctcattaagtcaccttgtgcaatccagttcatttcttcaaacctttctgttgcaaaatagcatcaagaaagttctgaagtccaggttttagatacttattttgctctttttaaaaggaaaacacttgctacttagaagttcatctatgcttttgctccctggactttctgaagtttcagcaaacaagtctttaataaagataccatgcatttaacaaaggacaagatttctctcaccagtttaaccaccgacagggttcatgtcacaggatgagggtcaatcaggattggtcaaagtgatgtctaaaaggaagaagctgaggcaaaattaacatggagttcatttgggccaaggctgaagactgcagccagggacacttccaagttgccttagggggtgctccagagaactcaagagagaacaagtttgttttgttttgtatttttggagacaaggtctcactctatcacccaggctggagtgcagtggcccaatctcggctcactgcaacctctgcctccgggctcaagcaatcctttcacctcagccttccgagcagctgggaccatagaggcgcgcaccaccatgcctggaatgttttttattttttgtagagacagggttttgccatgttgcccaggctggtcacaaactcctgagctcaggtgatccacccgccttagcctcccaaagtgctgtgattacaggcataagccatcatgcctggcccagaggtcaagtttttttttttaaaaaagcaagaatcaggagaggggacaattacaatcattgttcaccaggaattctcattgtcttacaaaaataacattgattattggctatacattgttgaactataggtatacggcattttatggcttctcggcagcagtcagcatagcactcaaatagcaagtggcttcaagaggtaattatttagctcaaggggagtgatatgactcctgtttcattccaatgcctctcttgggcctgaaaatttaaaggggctcacgttcttcaaataatggattatgaagctgggtcataccacttccacagggcaccaagagcagcccaagtaatcaacatgtaaccccatgtaatcaacaccagcccagggagctgggagtagaggttaggaagattgaagaactgataaaaacaaagtaccaccaaatgaaaatctgtactcactcaattcaaacacaagtgggttccctgccaagcctcaagagaaaactggaaataggttaattttaaagttacagttagttatgtaattgacttaaggaatcagattttttttttttctttgagacagggtctcactctgtcacccaggctggagtgcaatggcgtgatcacagatccctgcagcatcgacctcggagctcaggtgatcctcccacctcagcctcccaagtagttgggactacaggtgcacaccaccacgtccagctaattttcccattttttgaagagacaggattcgtcatcttgcccaggctggtctcaaactcctgtgctcaagcaaccctcccaccctggcctcccaaagtgctgggataacaggcattagccaccatgcccagcccagatgatacattataagtacctacataaggttaagaaaccagtgagattattttcctaaactaaaagaacttccacaaattttggcaatctttgaagatcactaacaagtttcttaagacatgggagcattgcaagataggagcttgggggtgatgaaatagagccagaaaaactggactctattctgcataaattttctttcaaaattaagacaatcttttgcagattaaaataaggatcttcaaactctgtttccgtggatcactgattctctgtgccctgaacagagtcattctactacccaaaatcagataatgaagatcctttgtcaactaacacggaggaatagttaagaagattgttgtcaatttcatgatgcactcacattttgtaaccttgggtacttgctatatagcttgtctacacaagcctctattatataaggagtctgacttattacaaaattatacattagctattcgaagcttattttttaacattttgaggtgtcacaggaagaatgctaaaacttctaggggctctgtcaccactaaatgaatttgaggaccaaccagagcaacagtctgtagtctgtattttcttttatgactaatcttaatacataaatcataaagaagttgacaggagtaaatgcatagtttcttttagtagaagagctctaaatcacaaagaccctcatgatggttttatgaaaagggtcctttcaattccctagcacctagcctggtgcctggcatgtagtaggcccttcataaagtggtttgacctgaagatggagacataagcactgttgtgtgtccttacacgagttacgtggctggcacagccttgctttcctcatccagaaaaaatcaacaggggagaggggcaggggataaatgttatcacaaaattgtttacctaaagtttaataggaacttatcatttgcaaatcatattagtgaaggttgctttttgcattagagcaactgtgctctcctttctgctttggacactagcaactctaaattggtttccagtctttcacagctccgtgctgtgctttcaaatcctcactccagtcccgttgtgatctgaatgtttttctatcacgcctgtttagagacaaggtctggaaacatggcacagagtatagctaaccaccttggccaattataggcatgaccctgtaaccttgttttttcactgctccaatccttcaattccaggaacttatgttcccaggaaaagctagttactgaaatggacacacgtataattagtttagagaatgttccaaactctactccacgtcattttttttttatccttgcatttactgtttgttttaatggctggaaagggaagtttaaaaggaaagtgccagaaacaaaggagaatgtttaaaacatacaaatcaccctataaacataaaaaataaaaaacaaaggagaatgcttaaaacatacaaatcaccctataaacataaaaaattttaattcactggtagtaaaagatgcaaattaataattactattaacttaataaatccacaagatactttatcttaggtagtaaagattttgtttcgtctccctttaaattataacatctagagttgagataaggaggtgaagaaaaggatagtttctctcatactaagctggtggaagtataaataacaggttgagcacacctaatgggaaaatccaaaatctgaaacgctccaaaatccaaaactttttgagcgctaacatgataccacatatggagaattccaaagttgaactcatgtgatgggctgcagcataaaacagtcaaaactttgtttcatgaatgaaatatttaaaaatattgtataaaattactttcaaacgctcaaaactacacaaatacctggaaattaaacaatctcctcctgaatgatttttggggttaacaaatcaagatggaaattttaaaattcttcaagatgaatgataataatgacacaagttttcaaaacctctgggatacagcaagaggaaagtgctaagaggaaagtttatagcactaaatgccaacatcaacaagtctgaaagttcacaaaatgacaacctaacatcacacctcaaggaactagagacaaaagaaaacaccaaacccaaagctagcagaaggaaaaaaaaaaataacaaagatcagaacagaactaaatgaaactgaaacacaaaacaaaagattaataaaacaaattggttctcttaaaagacaaaactgatagaccattagctacactaaccaagaaaaagaagagagaaggttcaaattagttcaattggaaatgaaaacggagacattaccactgacaccacagaaatacaaaagatcatttgagactgctatgaacaccccatgcatacacactagaaaatttagaagtaatggatagattcctggaaacctacaaccctcctagcttgaatcaggaagaaatagaaatcctgaacagaagaatacacacagcaagatcgaatcagtttaaaaaaaaaaaaaaaaaaaagccaacaaaaaaaaatcacagggccaggcagattcacagccgaattctaccagacattcaagaaaaaattggtaccaaccctactgaaactatgccaaaagactgagaaagacggaatcctctctaactcagtctatgaagccagtattaccctgatagcaaaagcatgaaagaatgtaaaaaaaaaaaaaaagaaaaagaaagaaagaaaactacagatcaatttccctgatgaacacagatgcaaaaaagactcaacaaaacactagcaaaccaaatccaacagcatatcaaacagacaattcaccatgatcaaggtggggttcatcccagggatgcagggatggtttaacatattcaagtcaataaatgtaattcatcacataaacagagctgtaaaaaaacatgatcatctcaatagacacagaaaaagcattcactaaaatccagcattgctttgtgataaaaaccctcaacaaactatgcatagatggaacatacctcaaaataataaaatccatccatatatgacaaacccacagccaacatcatactgaatggggaaaagttgaaagaattccccctaagaactggaacaagacaaggatgctcactttcaccacttctgctaaacgtagtactggaagtcctagccagggcaatcaggcaaatgaaagaaataaagggaacccaagttggaaaagacgatgtcaaactctctctgccaatgataaatgaattcagtaaagtctcaatttaccaaatcagtttacacaaatcagtagcactgctatacacaaaaaacgaccaagctgagaatcaaatcaagacctcaacccattttacaataactacaaaaaataaaatacctagaaatacacttaaccaaagagatgaaagatctctactaggagatatatatatctctgtcccaaaatccaggctcagcagaaggatcaaagccaacacttcaccaaagaggaacacacccctaggaaagccaacatttgacttttgacctgagctgctaagataaactgggccaaatttctatttattaggaattcctatttggaagcccagtcgtgcttgtaggctctggatctgaggtgctatgaatcaggatcagagccagtgaccatgtggaatgtggagccaatttcaacataaataagcagataagttgtatgatgcatttttattataatcatatattactttcaaaattaaaaacaaatgcaaaaacttttggtaagaaataacccaagtatctgattgcatgtcagagaagaggatactggtttcctgttggtgaataccacctgcatctattccaagcccacacaaagaaagtgctggaggcaaaacagggataggtacttgttttcagaccacaattgttggtttctgctttcctgttggtttttttcagagctgtctataaacacaggagtattgacttattactgccataacaaaaacaccttgtatttgcaaaacatacttaagtggaggtacgggaactgttctgtagacactggctaagtcagacacacagtcatagaatcacacgggctgctgagctcaaagcactttataaatcaacccatccaggccaggagcagtggctcacgactgtaatcccagcactgagggaggccgagaggcaggaggatcgcttgagtccaggagtttgagacgagcctgggcaacatagttaagactttgtttctacaaaaaaaaaaaaaaaatttatgagtgaggcgtggtggtgtatgcctgaagtccaagctactccagaagcctgaggtagggggatcacttcaacttgggaggctgagctgtgactgtgccactgcactccagcctgggcaacagagtgagaacctgtctcaaaaagaaatcaacccatcctcccgttacagatggatactcatggagggacatcaagttttcacattattcacgagctatgtctgtctagccccatttttttaggggatctgaggcaagagattcatagagaaaaatcaaggtgctgggaaaagagcaattactaatccttaaagaactacactctaagagagtccaccttctcttgaaaggaagtcctagatcacaagctgatcctaattcaactataattcccatactgtccctagaatagctccagaatgtacaaattccccagggcacttaattctacctggggccaaaaaagtccccaatgcagctcaacatcctctggagtaatggaaagccaccagatcagaaggggaatggaaggagaggggcatgaaatgaaaaacagattctccctaagattcagtgatcaagccaaagctgccaagaaacatgaagatcacaggcccaaagcacccaccctgagcccctccaggctaagctgaggtggggaaacgggggcagtgtcatggaatggggagaacatgatgccagaggtggttgcctcaggctctgtaaggaaaacacacattttgaaacatgaacaaccatatagacaaattcaaagaaaggggcaagactgtattcagtctagacagctacttcaacccttgttgtccagtggagacactttcaatccagccaagctatcctcttggctctcaatttaggacagagaggcctacgttgaatgattagagcctaatagggtgcacctatgatcattcatcttggacccagtattcatcaggcctctaaacaaagaacagaacagcctggggtcaaccatgggcactcacccatttgaataggcaggactcactcaccccacatacacacacatactcatatatgcacacacacacatactgatatatgcacacacatataaacttaaccttggggttggctgctgtcaaacagttctgtcatccattcctgatgactcacaccagagaaatagatatataagtaaactggaaaactacaaatcacccctaaatcatttctttccaggaatgaggatgtgatttttcagcaactcaacatttctattagcttatttatcccacacatcttctccttcccaatactgaaactagttgaaattccctgaagtgacggcaagtgaaagaaacaggttagagatgagtggaaaaaagaaacagtccaggattttaacagattttcatggttgggaggtcatcaacattcagacacccaaaaatcaacaatatctatagacccctacactgcaggggaggtaaatgactacaataactcttctgtatctcagagaacatacaggcataaagaatggccaagtaatgtgctatctgacaaataggacaatcagcagtatacaacattatcacatggtcttacaacatcacagcaaaattataacattgctttacaatgagcaaaaatccttttcgttcctggccagcaacttgattgtaatacagatacccaatattttaagaatcatggaagaggatgcctacccaaaacacttagaatttccactacttttagtggtacaactgattctgtgaatacagacaaacaggaatgcaggaaatgctagaattcattcgtcaacctgaaataatttcccccaaataaaccctgaatgtgttagaattcaagagtgatgcaaaccattgtctaagcccatagtctcagaggaaagcacatttattaaagcacgttaatgttcccttggccatcctagcgtgaggtatacagcatgcgcatctttaatggtgccactctggaatgcacatcctgcactctgcactcttctttctttccttgtcctactcctactcagagccactctgagcttaaatgcaaaccagcttctctgtactagcagaaaaggaagaaccagggtagatgggatgaaagtgtgattccttcaaccattatcataacaattacataggtactaagtcaccactctatttgacattacagattcattaaaatgaattccataattccaaatcgttttcttttgatatgtctatgctgttcagagtctggtctgtcacttttggtacctcaggaactaattcaagagttgaacaagtcctagaagctccattcatattaacccaactcaaagaccacaatgctccaagtagaaataaatcccaagagaccacagggttctagttaggctgatttaccacttaacaaagaaataaaagtcctactggtttcaaccctgatttgaaaaaattctttatataatgcatatttttcctatctcaagagggcagagtgctctaaacaggatgaaactctctgacaatgactcaaggggcattcttctgaacacagaatcacagacatcttccacgctacagtccagccctcttgttttacagaagcagattaggacaagtgacaaatgtgtccaaagtcatatcagcacttacattcctatactcgatcattaattgacaccaccaatcccccaagtatcccaatctcagaacttggaatatagcctggataatgagtaaactccatgcttctctgaataggcttcaacagtatgagccaaagaaaaaaataaattagttccccccgcttctgatctaaacccctagaagacaggccagtaggtagcaggtcttgccctcatttgtgaggaatgaggggctgcaagtggggaagtgtgagaatgtcagaaggtaacttcaccatgagtttccttgtagacccagtaagagacacatggtacaactggtcattagcaagacagcattgcctgccacatccatcctatgggaagataccaggactatgatattctataggcaataacactttcttccttgccagctgcacccattaacagaccacagtttgtttttaagtgatctagtacttacatttcacaatccagttgaaccatgggaattcactgggtaggatttttgataaggtatctcacccggctcaaatatattaagctaactcagaaaggtctcctaaaataatcggtagattcctgaagggtcaggatgctgtcctgattctagggccaaccactttacttaacatatagtagatattcaatagttatttgtcaaactgaactggacatatgttgggtatgttaatattgggactaaatatgcaaaaaaaaaaagagagaacttcagaagtctgggttttattattacaatttgtaatgatgtagcatatgtactgaaaatatccccagagaatatctagtcaagtcctttatattcatacagcagaaaattgaggctcaggacagataagtgaatgcttccatacttacctgttatatggggtactgaaccagatcttacacacacacacacacaccccatgaccacaccgttttttcgggagggtgggggtcacttgctcttatcatctaggaatgaacaagcgaaaattccaatgacaggctggtaaccttggttctcatcaaattgaagtttcacattaatgtgttccagaggataatgtgctaagttaaattaatcatccaattatttagttaatagactaagtttatctgggataatgtatgttttcaatataagaccttttctaaaaatcattaaatcaatggaaaaatatgaacatttgaaataaatactcacatgtaagttaagggccatttctcggaaggatctggtatctcaacctctctcatttaagaagtctattttcctaacctttctgtatataaaacatcaccctcccacacacaatcctagattaaaatatatattcctgtctctcaacaacattttcatccccaagatccaagccaccatgtaaacctctggtttcaatgatgctttatagccaagactggactcttaagaagcagaattgggagcagaatagtgagaatttcattcaaactcaatgtttttcagaagagaaggcccagattataaaatattttaccccaggtcattcaattaaacagcagggcctgaatcagaacgtgcctttgtgatccacaaaactgtctgcctttatggaagtgattttgagactctcaaagaacctattactgaaaaactgcctcttccctaaaaaatggatcaaactccagttacctattttcattcctgttaataactatatttctacttcatattttatgtctagaggttgctagttttgttatttcttcttcttgtagctaataattattgtctcctatctctattaagtaaaataatggcaaagtatactgatccttttgccaagcagagctgagagccccttcttgtactcctcatatgatctcattaaaataaataattttcatgttccaaacttttaaaagttttatttaatttctaaattcacttattttttccccacaaaaaatttccatttgtctttctttcgtattaaaggtttagacaggaaaccagataatgaaattcagtggaatgaacaggcactttaattctgtttgccgggcactggcaacaaaaagtatttgggaacataataggcacaaagggagtcactgggcagtaaaacttctggcttatcttctcatccaggttgaattcatttggatggggtgggaaagtaggataacaatatggcaaattttccactttgttgccaccattggtgggaaaatgttaaggcagagactgcaagccctgtggcatggtacaatattttagagtttttttctttatggcacaatattttagttttttttttaaagtataatcacaggctgaagtgaattatgcatttataaaaactagaaatgcaaaaaaggaattctaatatcattagtggttttgtaataacacaactgtaattaataatttgcatcttgaacctgtgcagataaagctgaagtcaaatggcagttcgaatctcccagttaaccactgtcactgttaacaaataaaaaaagattagataaaagtaagacacaatgaagcaacttttgtttaaagatttttctacccctacagtgcagagagaaaaacaaaagggaatcacataatttaaaaagataagggtgaaggggaaagggagcattttaatcacagagtgtaaaataataaggaagatgcatgtatgtatgcttcccagcccattattgtctataaccctatggttccacgaagaaaggaaacaggaaactggagcaagccatctaatgaaccaatgaggccaaaagggtaaaacagcaaccctctccatttggatgacttccaaaattgcatccatccatctgagaaatgatcattgaatgcttactttgagtgaggcaatattctgagcaacagggatagagcagtgaaccaagcagagagcaaccccatccatacaacccccatttctaatactgcttttaggctgcaaaaatgtatttccaacatggcacctccaactcacacatctagttgcaagatcatcttctttgctccccaaattactccttctatgtgtcccctgtctcagttaaaagcattaccatccactcatttcttctgaccaccaaattgttgtcatgttaaactccaacctctccatttttacctctaccaactccttcagtatatcacagaatacctgattgctgaatatctacaaagtttcttgactctgtctccaccttttcattccctgtaccattagggacctaatcatcttttgcctagattactgcacaagcctcctgaggattttaggtcttccctctgaaagctgctcaatacatcctccatttcacttgatgaaaatcatatcctttctcctccctaaaaaacccccatatgaatccttgactcctctcttcattcttccgcacatccactccatgagaaaattctattgattcagtctccaaaatacatccatattctgaccacttgtcacctctccccttatcacactgttcaaaccaaattcatctctacaatgactataatacttcactggcctcccagctttaacattgccctaggttagcctattctcaaaacagcagcgagagtgatcctttaaaaatgcaagttagtcaatattgttccctactcaaaaccctatgaggtacccccacagtcactaagagtaaaagccaaagtccttaaaaaggcctgaaagccctagatgatctggcctcttatttcctaacctcatctcctctattctctcagtcactcaccctactctttctgcttcagccattggctcctaaaaattcctcaaacacagaattgctcctgtcttaggacctttgcataggctgttccttctgccaggaacattcttccctacatatccacatggctaactccctcactccttcaagacttttctcaaatctcacctcctccatgaagcctaccttgaccacctatttcataatgcaacttcctcctatatactcacaacccctttatcatgtgctattttttccccaaagcaattatcatctaacatacaatatgtagtttacttaccatctttattgtttactgtgtctctccccattagaatgtaaactctacaaggggagagattttgtctttgttcagggttttatgccaactgcctcaagtaccatgccatagttaaatgttcaacactgactgaatgaatggactgatcaccctggttgcaggatctttgccccaaggtcatctttttcaagcacagctcatgacatcaactccctgctgtaatttttttaaataaaagtataaatcagacttcccctaaaaaaacccaactctttttgctgatccctttcaacatttttgctttaatatcacttttaatgttcttagtacaattgttatattttacaaaatactctttctggaatgtagtggttgtttggccttctgtatgacattttaactcacctagtttcctttagaaagttactgactttaaaagaaaatctttttgagcacgagtgctgccactttaaagactacttacaggacattttaggggacataaaaacaatcctaaataatcacaaatattaaagtaagagcatggtacacttgcaaaaattctgccagagataaggttcagccgatggtaacatccatgagctgtattcaggcactttgcaattgaatgtatcatagtgattctttttaaattgaagagggactccgaattatttcagattttgcacttttatggtactttctatcatgccctttcaaatttatataaaaaatgttaactattgtagctaagtttgccaagaaaatttcagtgaaacaaaaggtttttagactcagattttctgtttatgtttacaagcacatctattccatatatttagaaatacttgtatttagacagacatacttaaagaaagccccttaacacattttataaaacactacaaactgactttgtgtatgagttttagaatgatggctgacacttacgaagcagttactatatatcaggttccatattaagcctcgtttaacctccaccacaaccctgtgaggttggaactattactattcgtatttacagatgagaaggcaggggttcagagatgttaagtgacttgcccaaagtcacagaactactaaatatccagttttttatttcagatccctgttctaaacggctccatgtcaggcttactgctttgcctcacacttaaaatgtatgaaagagaaacgactaacttcattaactgccagttgcagcaacatcttttgagcctaagcaccttcactagtcccagagtcatagcagccatatttgaacaacagaatcccacctcaactgactagaacagagttaggaaaatccacctcctcgggaattcagagttggaaatgagagcagacctctccccgtggctgtacataatagatgaccttgggaccagcttctgcctgctttgtaggcaaagtagcagaaaatgtcagtttgttgagaaagaagcagatgtgtagagaaaaatcacaaagtagagacaaaaatcccagagtcactaagacctcctgggtttggttccaagtcttcctgagtatgggtatgtccctgcttttggatttcatgagaaatcccagaaaccggaaaaatctattatctctctgtatttagtggtttaagtgggttcctgttacttcaactaaaagtttggttattcaatactcagatctgggtttatacatggggctgaaaaccaaataatcttcactgagcaaaaagaaaacagaacatagaaggatttgaaatgctggcatttagaaatatagtcaattaatctaaagaacaaagtatctttaaaataaaattgtgatagtctcaagacatcaggaaaatggttttatcttggagagttagaagatgaaatgaacttacaggaaaaccatgtgagatactaaaacacaatgagcagcagcaatagaagatgacccaaaaaaagcaagcttcttgccatcacattactaacaataaaatgcacacacacgtgagaagcaaaaaataattggctctattttcaggcagacaaaaagtaatttccatatattccctgtatctgtgttcaaagattttaggcagcagaatcatctggatatttattaaatggtggattcctgggtctcaacacagagctacagaatcactccctggggatggagctgtgtttttgtttttgtttgtttgttcgttttgaattggggtctcactctgtcacccaggctggagggcagtggcgggatctcagctcactgcaacctctgcctctcagattcaagcgattctcctgcctcagcctcctgagtagctgagactacaggcatgtgccaccacacccagctaattttttgtatttttagtagagacggggtttcacattgttagccaggacggtctcgatctcccgaccttgtgatctgcccacctcaacctcccaaagtgctgggattacaggcatgagccaccgcgcctggccagagctctgttttaaagcaatgatcctcgaaattgtttgtttcagcatcctctgcattaatattctgaagctatatacttatactcacttatccatttttaagttgacatctagtttgataagttgcataaggacataatttccaacttgttataaatatccagatttataaataaaactgttaatcattcccttacattgataaaaatctctctaggtatcacagagatttgaaaaacattactttttttaaaaaaaaaagaacaagcctggtggtgacaaaatctctcagcattagcttgtctgtaaagaattttatttctccttcacttatgaagcttagtttggctggatatgaaattctgggttgaaaattcttttctttaagaatgttgaatattggcccccactctcttctcgcttgtagagtttctgccgagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaatttggttccattctccccgtcactttcaggtacaccaatcagacgtagatttggtcttttcacatagtcccatatttctcggaggctttgttcgtttctttttattcttttttctctaaacttccttctcgcttcatttcattcatttcatcttccatcactgataccctttcttccagttgatcgcatcggctcctgaggcttctgcattcttcacgtagttctcgagccttggctttcagctccatcagctcctttaagcacttctctgtattggttattctaattatacattcgtctaaatttttttcaaagttttcaacttctttgcctttggtttgaatttccacctgtagctcggagtagtttgatcgtctgaagccttcttctctcaacttgtcaaagtcattctccgtccagctttgttccattgctggtgaggaattgcgttcctttggaggaggagaggcgctctgctttttagagtttccagtttttctgctctgttttttccccatctttgtggtttcatctacttttggtctttgatgatggtgatgtacagatgggtttcattgtggaagtcagtgtggtgattcctcagggatctagaactagaaataccatttgacccagccatcccattactgggtatatacccaaaggactataaatcatgctgctataaagacacatgcacacatatgtttatggcagcactattcacaatagcaaagacttggaaccaacccaaatgtccaacgatgatatattggattaagaaaatgtggcacatatataccatggaatactacgcagccataaaaaatgatgagttcatgtcctttctagggacatggatgaaattggaaatcatcattctcagtaaactatcgcaagaacaaaaaaccaaacaccgcatattctcactcataggtgggaattgaacaatgagaacacatggacacaggaaggggaacatcacactctgggaactgttgtggggtaggggtggggggtagggatagctttaggagatatacctaatgctaaatgacgagttaatgggtgcagcacaccagcatggcacatgtatacatatgtaaataacctgcacattgtgcacatgtaccctaaaacttaaagtataataagaataaaataaaataaaataaaataaaagaacaagctccttttcagtcatatatcctcttttaattttttcttgaattcatacatcttttccatatccccagcagaacttcaataacatatttttatgcttgtaaatcttttactgatcactctatcatgctccccacaaataaactgtgtacataattgcagtctcacattttacatttcctgtggccgtaagttttcaatatttttaaattttctcttatggactaagttcctaaaattattattggtccacaattgatcaaaattaatatataataaatgttgacaaatccataatgtataaaaagtaaaacttttcagtaatacatctcttaatgagatggataggttatatttttatttacacaacatagaggattttttaatttttttatttttaattttttttgagacggtgtctcgcactgtcgcctgggctggagtgcggtggcgcgatctcggcccactgcaacctccacctcccaggttcaagcgattcgcctgcctcagcctcctgattagctgggattacagatgcctgccaccacacccagctaattttttgtatttttaatagagacagggtgtcactatgttggccaggctggtctccaacgcctgacctcctgatccacctgcctcggtctcccaaagtgctgagattacaggcgtgagccaccacgcccggcctgaggattattatttatcactaggatgagatacagttcagcatcagttctattcctatttttcacattttttaatgtagatataaaatatacgaaacctgctctcataaataaaataggaatagaagtttagcgactgtaaaatcattcaattctttggacttcttcttaattatgtaacaaaaaattgcacatgaattatcaatatttttaaagatcagctgacaatttgagtatattttgttttattgaaagcaaagaactgaaaatggtttgttatctggtaatattagagtcattcactttctcaacactaacatcatattttgagtttttcctttggcttgtgccctggaggtttttatttccaaggccaatgcaccaagatttaggatgagagagtagcgcctttctctcctaactgaaaatagagtagtcgtgaaaggggaagcgataaaggagaatccacacaaatgaacaatgattttcttagactcctatcactgctacctaccataacttagaatgcccacgtatccccaggggcatgtgtatcctggtttcgacacactaattggagctctgttcattcatgcattcattccacaaacatgtattaagcacttgcaacatgccagacacttatctaggcactggagatacagcaatgaacaaaacaagaaatcccctgccctcatggcccttctaaaggaagcacacaatctgttaggtctgtgttgggtgctacggccacctgcctgagcctcctgtggcctgctcttctctctactctaaagaactgtattcccactgtaataatttgaaatgccaactagactggattaaggaatatctagaaacctgtaaggcattgttttggaatgtgtctgggatgatgtttccagaggagattggcatgtgagtctgagcggactaggtggggaagatccaccctcaatgtgggcaggcaccatccagtctggtggatggtggtgaagacagtaaagaaacaggaaaaaggtgaatgtgtcattctatctccaggatctggaatacactcatcccctgccttggacaacagaactccagggtcccaggcctttggactccaaggtttacatcagtggctccccgggttgcctggccttcagccttggactgaaagttacaacattggctttcctggttctgaggccttggggacttgaactgagccacactaccagcatcccatggtctccagcttgcagatggcctgttgtggaacttctcagactctataatcacataagctaattcccctaataaatcccctcttatagatctaaacagttgtacagttgtccctcagtatccaaggggaattggttccaggacctccttcaggtatcaaaatccacagattctcaaatctagatataaaatggtatcgtatttgcatataacctatgcacatcctcctacatactttaaatcatctctagataacttagagtatctgatacaatacaaatgctatgtaaatagttacattgtttgggaaatactgtttagggaatgacaaggaaaaatatctatacatgttgggtacgaatgcaaatttgttttcaaatattttcaatggtggttagttgaattcatggatatggaatctactgaccatatatatatcctttttattctctctggagaactctaatatgctaacttagtcaacagagagccaggaagtacttactacgtgccagaacattagctaaacccaaaagaatagagaggatgcagactggtcctccacagtatacaataagcataaaacctctcattcagattcaccttatataatacattaagtcactgtttaaataagtttatgttctacaaagcaaagaccaaatcatcaccagggtcaagcagattctcctctgcctatgtaatattaatctattggctgtgcttaacatttatttatttatttatttatttatttatttatttatttaaattggtttttttaagacacagggcctttctctgttgctccggctggaatgcagtggtgtaatcataacttggtgcagcctcaaactcctgggctcaagagatccttctgtctcagcttcctgaatagctaggcctataggtgtgtgccaccactcctggctttttttttttttttttttttttttttgaagactaggttttgttatgttccccaggctggtctcaaactcctggccttaaagcgatcctcctgccttggcttcccaaagttctgagattacaagcaggagccagcatgtccaaccttacagtttgaaacataattttgttcccaaactacggatatgagtaaaccacatccttggcagtgactgcgttctaggataatttttaatcattgacaaaacaaattattcttcctatcaagaaaaaagtactagttctgaggataaaacactacatgtttgtcaagaaaacaaagtcgaccatccatgaaaagaaagtgcacaaaaatgtacaattcctagggtggaaatttccatcaatcagatatactcttggtgaaaatcaagggtcaccatgtcacttaagttgcaaaattcaaagtattttaagttcctaagttaaataaccccaaatgtttcttatcaagaaaaaaagcctctccacctaaacacatagctacaatttataattaccaaaagaaacctcacaatggccctttgtaaaggatgatcctcatgtagctaaacaatttcccactccctcttctgtggtgccttttaaaattatcattataacatctacagtcagaaggtaaaaattgttttttcctatatgaagttaatatagaatacataattagaacttattttccacttgtggtaattaatatgcttgcaattatagccactattccataccattaatccctaaaagtaaaggcagctagcagagtaaggagacctctgagacacagaagaaagctggctggaccacatgaaagtggaactcttaaatctgccttcaaaagtgcaacagtctagccacaagaactacctagtatagaattaacattctaatccaaatgagaggaaaattctaaggttccatcttgatcaaaatattatgattataaaaacattccaaagttcagcaaaccgtactaaacttacatagtcccatatctacctctaaatatgctataaagatacaataaaaaatagattgtgtagtgaaaaataagagatatagtaggctctaaatagggtacagtccatgaatttggggtaaagccagaaattaccagcctctgaaatttaggttaattatgaacttaaaaaagcaacaccaatgatgggataaactggcaccctgtgctcctgctgagatgcactgagaaggatacagtgtcacctatggaatattcctgtccaaaatgtttaatcttaacctaatcacgaagaaacaattagacaaatctaaactgaaagaaattctgcaaaataactggcctggcctcttcaaaaatgtcaaggactaaaagacaaaaaaaagttgagaaattattccagattaaattcaataaattcatattgaatacctactgtctggataacggcagtgtgtggtggctaagaatgtatcaaattctgcctcaaaatcctatctctaccagatggaaaagacatctaaccatgccatgtcctggtctcctctcagtaaaatgaggatagtaatattacagtaccttcttcaaaagattataccgagttcaatgagttcatctataaaagccttagcacagacactgctcaacacttaataagtgctcggtaaatgtcagtggtgatcatgaccatgatgatggtgaagagccaccagatgctgggggaggggaacagagagactaacatcgtcacgtcctcactgtgcttacagtgagatgtgagttacagaaaaatgaccaggcaattctaagatagtgcaatagatgcactttggctgatgaaaggctctagagttcaaaggaggccgttaggtctttctaagcaaggaatgctggcattggaatccaggtaatgacagagaggtgaggcaactagggtagaagagatcaaacttgaggactgctaggatcgtgaggcaggggagtgctgtagattgagtctagttcctggcttggcagctgaacgggctgtggtgccagtcactgagaaaaaggagcccagggcatgagcaggtttaggggcagcaagagagtcggctgacgctgggtcagactcaaccagaagggccacccaaggggacttgtgctggactcacaaaggcatgtggcagagaagtcctgatcttgagagaaaaggatacattctgcattccccagaataaaacacctaaagcaaacagattttatcttgttcttgcctggactctaatttcaaaacatgataaagaaaaatacagcagtcctatcaatcttatgtatttcacagtgtaactattttactgtaaaaatagaaattaggagggacatttgtggctctcaataggttcattaaacctaaaattgtaaattcccctgccagaaaggtggtatgctagccagatgttctcactctaattgagaacattattttgcttactaaaggtaagaaagaaaacatttaggtcaggctcggcggctcatgcctgtaatcccagcactttgggagactgaggcgggtggatcatgaggtcaggagttcaagaccagcctgaccaacatggtgaaaccccgactctgctaaaaatacaaaaatacaggcatggtggcacacacctgtaatcccagctactcaggaggctgaggcaagagaactgcttgaacccgggaggcaggggttgcagtgagcccagattgcgccactacactccagtctggatgacagagcaagattctgtctcaaaaaaaacctttataaactctcatttcctaggttataaaacacataacccctcacttctacccacagaaataaaactgccaggaacaactctgtgtgcttatgtgcctatgggcaaaaatacataaactatattgatatcataaagaaaacactagattcaatcttggcccatagagtctcaattatcaatccaatcagaagctgaagctggatttgccacacaacacaaaaccagtcttgctgccacactatgtgctcattcagtgtgtgcctgacaatggctacgggcaacactgattctctgcctacacactgtctttgaggtacactgcaccgtctgttggcttaatctcagatcaaactgccttagctcatgtacttgtgaaaaagatgactgattgtccccaatatccattctatatgcccccttaggagtagaacccctagagtcttggaggcttactagagttcacctttccaagcttctttggtagtcaggtatcatcacgtaccttaagttctggcaactgggatgtgagggcaagtgatgtctgtgatttccagatcatgcccccagaaggaaactacttggcctccactttccctttcccacagaataaacaaacatacgggagtggtgaacctcctgcagcctgcacatgagcagaagcactgaggcaatggaagaacaacaagctagaaagagcctgagcgcctgactcatgaagcaaagagctagattccaaagtgactactggcttaaatttaaaattttatattattattattttatttatttttttttttgagacacagtctcactctgtcacccagactggagtgcaggggtgcaatctcggcttactgcaagctctgcctccccggttcacgctattctcctgcctcagcctcccgagtagctgggactacaggcacccgccaccacgcctggctaattttttttttttttttgtatttttgtagagatggggtttcaccatgttagccaggatggtctcgatctcctgacctcgtgatccgcccacctcggcctcccaaagagagacagattcttgctatgttgcccaggctggacttgaactcctgggctcagcctcctgagtagctgagactactggcacacaccatcatgcctggccagcttggatttttatatgagaaacttattctgcttaagctactattattttggtctttataaaaacagccaagccaacaccttaattcatttccactcaaatcattaaaatgtgtgattatgcagaatttatgtaattaaggtgtgtctcactttgttttagagttttgcattcctttataatgactgcagacatctcagcatcccacacagttgacaataaatgcttatgttggaatctccaaggggcataataaacaggtacagttaataccactcttctccaaatggtcatatattaaatctgctctttaatttgttgctagaaccagtatttgcagagtgcaagacttccgatctatctgacaaatttttaaccttggttttatatatgatgacaacattctacacccagcattaggactaggctacactggttttcttttttctctagaagaggacagattgtactaaggcctaagatcgtactaaggtgcttatggtaggcagaataatgtctcccatagagtcaattaccatcacaacccaacacgttcatttcctaatcccaggaaactgtgaatatgttatcttacatggcaaaaggaactttgcagatatgattaaggatcatgagatggggagattcttctggattattcatgtaggcccaacttcatcacaagcgtccttataaagagggagacatgagtgtcagagtcatagaggagatgtgataatggaagcaaaagctagaagtatgccattgccagaaggggccatgagctgaggaatacagatagctgctagaagcacaaaggggcaaaaaatggattcctacccagaacgtccagaaagaacacagctctgccaacaccttgattttaggccagtgaaacccacttcaggcttctgacctccagaattacaagagaatctatgttgttttaagccacaaagtttgtgataatttgttacagcatccataggaaatacagtgtccttacatgtagcactgtatattgtaataacccaattgaattagggtaggatttgtccagacctaaagagctaaatgaaaataagcaattttaataatatataatcttattaataatattgttactaatattatcagtagtaataccaatagtaacatacaattgttttgcctttttactgtaatcacaaaggtagctctccctgcctccctccccccgcaaaaaagaaaaagaagtcacagaaattgaatataagtaggtacaagcaaatcttgtaactagataaaaggatgatttctacccactagcaaatgactcttcatctcaagatgaaattgaatgccatttttactgctattgttttgaaggatgaatgctttctctgctagtaaaacgcgttcaataatttctgcaggccgggcatggtggctcatgcctgtaatcccagcactttgggaggccgaggcgggcggatcacgaggtcaggagattgagaccatcctagctaacatggtgaaaccacgtctctactaaaaatacaaaaaaattagccgggcgtggtggcgggcgcctgtagtcccagctactcgggaggctgaggcaggagaatggcgtgaacccgggaggcagagcttgcagtgagccgagatcgtgccactgcactccaggctgggtgacagagtgagacttcgtctcaaaaaaaaaaagagaaaagaataatttctgcaaaggccaaagaagaatttaaagagtttttaaagctcttcttgataaccaaaatctgtaaccatgcaggacattcccctggtattatttagttcaaatctccatcacttgtttcagttttacgcagctgttgggtacagaaaaccaaacagtcacccctgtggcttccgtatgcttcaaacagtaccattcctggagaagggcaagattcactggccctagcttcattcatctgggccgttcaatgttggccaaaagggtccacaacccacaggaaggtcactagaagctaaaattatcactgctcccttaacctgcttcttgtcagcaccagctaattgcccaccattgtgcttctggctccatgatggtgttattatagttcccaacgcagggaagtctcagcacaacacctttggaaaatgcttaccctgacattcctaagagcattccaaagcaatgcccttgtgtgcctctctggcctggagctcaaccatgcctgatggtagaaggttcacttcaagatcacattcttaagcatggcctgttttcactgccaggatttcataaaatcatagaaccacaattgtactataaactcttggcctaaatttacgtcccctccttcctcctgaacagaaccaaatgaatgttgcttaagatccaaaacagatccatataacaggactccttttgtttcagaaactaaattacttctttgtgatacatccctacattacattagaataacactatctcctgtgctgtactcataggaagtggagttatctccttggaccagatgcttggttttaaagattgttttgtttgtttgtttgttttttatctgcttccctctgtctcaatttgttctgggctttggaagccttcatatctccaccactgataatgtctaagtttttctacctataccttaagtttcctgccacatcttcctgagttaaggccctttaaataagcatcactgcttttcagggtctggagaaaggtctgtctactccaaacctcagtgggaaaggtggacggcatgcactggataccctttgttgtctctgagtaatgatctttattaaaccttttaatggaggcatacatttacctgtatatcacacacttaacctaggaagctttctgtcctatatatgttccaatttggtcttgctcacttcagatatggattcctaatatgtaaaatataaggctttttgctccttaacttctaagtattttaactcactgctatttggcagtaacattaaaagcaccaaaaaaaacaactcagctcaacaatctaacactatttctcatcccaaaagctaacccataatctttttaggtttcctcttctactttttgttttactcataactcagcatttctttgcaacaggagctaataagagtttgtttttgtttttttttttctggtttatgttatctgcaatttacaagaattttttttttctcctccctgtgttaatctgccaaaacaaaataccttagactgggtggcttaaacaacagaaatttattttctcacaggtctagagcctggaagtcccagatcagggtgccggcatggtcagtttctgttgagggatctcttcctggcttaaagatgtccaccttcttatgtcctcacatggcagacagagagagagagaaagcaagcccttcggtgtctcttcttataagagtgctaatcccatcaggagggccccaccctcatgacctcatctaaacctaattatctcccaaaggccccatccccaaacatcatcacattcggagtcagggcttcaacacatgagttttgtgtgggacacaattaagatcatcacactctctccttttagggccgatttttatctgccttggaatgaatccatgaccagcctttcttcattaaataagcagggacagagactgaacacctgttaggtctcaggcccaggctcagtgctaggtattcaaagaggaatacatacaatttctgatatcagcagttccaatattcccaagttctagatggaaataccttattgtgctggcttactgcagcagccatggaaatatgccagtcagagctccctttctggagaagcacaactaactgccggcctcttgctgccacagcttcaggtctaccatggcattcgtgcagaaattgtgtttctactgggctgcgagccagcgcccaagtgtgcagaggtactggaatcactgctgttgttgcccagtgcgaaactccagcaacaggcaactttgcttagggaagccccatccatccagccaagacttctcaggaatacatggcattgtaaaattcttccccatccctccttccttcccactcttccttcacagatgtcagacctacagcatggtctgaaggctctctctaccttttgtggtttcctccctctttccacttcatagacattccccaacttgcattcaaatcccagcttggcaactgcttctcagaggatctgggaaaacagactcaggaattaacttcacttaaaataactaaaaaacatgtttagctttcaagtaacctgttcatctaaccggggacaaatactcatctgagacagctaaagcaaaaggtgatagaagaaataaagaaaatctgctttttcttacattcaaataaaggcaaaacagaaaattattctcactataacttaatataattgggcatacagctatggagcatttgccaagtaccagacgttgtgcaaggtattgtaaaggctataaagacaaacacaagatagactccctgccctcaaggaacttacaagctgcactcctatcttttattcagaatttttacatcattcattttaaacaaattccttaagcattttgtacacacatacatatgttcttctgtacgaagcagatgagtaaacaagattacttcatgtaaatatttttaagtccttacttagaaaataatttggtctttaaaagtaagtatcactatatttccatctagagtctccaaatccccaccctaggcctctaaagggaaaatgtcaagacattttatcacttaatctgattagaaaagtccttcatgctcatctacatagatacatctccaaaatcccaagttaagaaatgagctcaaggcatttgggtcaactgacacaggctggtggaaaaaaaaaaaaaacctcaaacatcttaaaatattcatttttgttgttgttgtattgtgaaatatttacatacaaaaagtatataaagtaaatatgtagtttaaagaataacataaaaaaacactgtgcgctcaccattcaagttaaaacccagaatattactataacttttttttgtttttgagaccgagtttcgctcttgtcacccaagctggagtgcagtggtacgatctcggctcactgcaacctccacttcctgggttcaagcgattctcctgcctcagcctcccaagtagctgggattacaggcgcccgccaccacgcccagctaattcttgtatttttggtagagacagggtttcaccacattggccaggctggtctcaaactcctgacctcaggtgatctgccttaagtgctgggattacaggcgtgagccaccaggcctggcctactataacttttaaagcactttttcttccctccactgctttagaacagtttctcaacctcacgctattgacattttgggcagataattcttaaccagaacattttggatgcttagcaatacccctggcctcaacccataagatgacagtagcatatcaccaccatcaccaccagttgtgacaaccggaaacgtctccaaacacttccatatatcccctggagggcaaagtcaccccttgttgagaactactgccctagaggtaatcacaatatgaatttttgcttttatttatagtatatcaacatatgtaaccctaaaacaatgtattgcttagttctactgtatttgaactccatagaaatgaaattgtactccatgtattttcccgtgacttgtttcttacattcaacattgtttgtgagatacatccacggtgtattattacaagctgtaattcacacaatcattttttcatatatttttgctgctgtattgtaatccgttaaattaaaactccataattgtttaatccaatctattattgatggacattcgtattgcatctaacattttgcttttatgaatatttctactaggaacctttcctacacaggtcttctggtaattacacaacaatttctctgagctatatacctaggagtagaattactcagtcacaagatatgctcatgttcagctttattgctttctaaagtggttgtatatatttatacccccatcagcagtagaggataattgccatcactccacatgatttccaacactagggtcttcacttatttttcacaacatgtggtaccacaaaaatatacattgcttaccgtgtaaatcccaattctacaaacagcaaatgagatctggatgcattcagacattctctataagattaaaataagaataagagaataagaaatgtttgtaccaaagaactgtcttcattccccttgctcttgtttccctctttaaagaaaatctgctgtattccaacatctgttttatgaggaagtggctgaatttcttccgtctgttttctaggctagctcaaagacagggataataaagtctggggcatgtggctttatcttgggactgtaaggcagatactttgtcctctaatacaagagcatcatttaaggagtgtaacttattgtaatggtttaattttacttctttcaaatcttgctctaatatcccattttaataataaatatttggctgctataagtagctttttaagcattctttttcagttcaattcttattagatcataaaagtctataatccttataatggatagaaaaaaatctctataaaagggaaatgctcatagttaaatgctgaaagttatgaatgggctaaattttgacagaagactgagatccttggtctcagaatatcaatggcagtactcaacttagaattcacaacttctaactcccaaatcaaattcagattcctaaaacacatgcccactcacaaaaccatgcataccaaacatgactactggtttcttttcctttctttagctggagaaatatttttagcacattaaattagcatgtagtcaaaataaccctaactttatacagtcgaacactgttattatggtttattgttgacaagttaaagcttctccctaaagtttataatgtcataaatctcagcaatcacggttttatccattgtggcaaggaggcaaagacataggatccctggctttctgtggtagccaaaaggcttccagagatgcagtccttgaggaagaccaagaagtcgcatcagacccattctgccaaaggctcttgcccctttagacaatatccacaagaaactgaattctgtatgattgaaggaatttggtaaataaaagattggaaagccaaaggctatatgcgtggacattaaaaataaaaattacagcaatggaaaatcaaactcttaggacactctgttgagtgaagtacttaaactcaatctaaactttcaaatatcaacggtgctattgttcaaaacaaatggctgataatttcatactggggatcatgatcacatctattattaagttattactatcatgactgtaacattattgggtttattttgaatgaaatacactactgaaaacaaaccaggggccatgccctggcatcctcagagcccaagactaagaacgctcattgccttgtccaagatcattcttcccatctacctttggaaattaccccaagttgtacctttgtaacataatagtgaatgactgaacaactctctgagtaagctggaaaagttatcttccccaactgaaagataactcttattttatgccacctggaataaaagatttaccagcctttcttggggttaagtgttgtcctgtgactaagttctccaaaatgagatgtaactgaaaggtgcttaaagggaactgactctgagaagagcccttttttgctcttctgcctttcctacttcttttccaggctgtaacggagacttaatgtagctccagtgacaatcttgggttgtgacggcacaatgagaacagtggacacatgaagtagaccatacagataagagaacccaaagatgcaaatgacagcagagttgccattccctcctcttccagactttgtacatgaaatagaaatcaacctgtaactttttgttttctgagacagggtctcacttggttgcccaggctggagtacagtggtgcaatctggaattactgtatcctcaatatcctgggctcaagtgatcctcccacctgagcctcccaagtagctgggattacaggagcatgccaccatgcccagcaaatattttaatttctttgtagagacagggttttgccatgtttcccaggctggtctcgaactcctgagctcaagtaatccacctccctcggcctcccaaaatgctgggattataggcatgagccatcacacccagccctctaacttgtttaaaaattgttgtgtgtctctcacagcctaacctaatcctaaccagtacagagcaacgtttgtttttaaaaagtaggtattcccagtgccatatgaaagggctctagcacctatcatgagagaattaactctttttatgagctttatcttttaaggagggagaaatatttactctttagttactaaaaacctactttccactccttttcatattctcaaaatgtacaagtattgttgttgggattgctaaaattattaccctgaaaaccctcaatttattttgtgtaactttttttctgactaaccatattacctcattctctctaatctctaatccttacaaatactgccttatccttgaacatccgacctcaggccaggtggcatgtctattgccccagcttgtaaattcattctaacaataatattctcaacaatggcctcttccctctaattactaggagtcggatacatatatttaaaaacataaccaaacttcctttgatcacagtatatgaactggtaataaattttaaataattatattatttccctatatagatgctatatttgcaagaaactattttaactgtaaacccatgagacataaggcataacttggaatgaaggataagtagttaactatttccaataaaagaatgagtttctatctcagataaactctgacccggtagcctctacagtaatattcataaatctacatctagacttccctgaggaagaactaaagaatattatttcaaagatgaatctcatcttctttgctgcctcatctaataaaacagcaaaaaagatgtcaaaaacaagacagattggttacaatctgtttaagagaggtctatagaaaaagaatgcctaagacagaaaaagaatactaaatttgaaattaatgtgattacttacagtttattgttgttttccctaagaaatttcaaaggtaagcatgaaaataaaggagaaaacaaaacttcaacaagatggcagaaaataaacgttatttactatacagtccaaaaaatggtatcaaggtataatttgagttccatcagagggctaataaacacaatattcttttagagagctattttttatacttaacataattgacagttctaattttgatgtcctgtgcaatccctcatcctgatacaaagcaagatgacagttatattatcttctcctctataattctgcttgatgaaaattaaaaagttaaaacagccaagccagttcttcagagtcctgcaagcagtatgttaaaactggtaaaacaagaaagggcatacgggagcagtaaaaccccttcgaatgaggccctagcttgggtcctctatttccaaataaggttaacaaagatccagcatttcctctcaatagcagacaaatgggctgaaggcaaagatgcaataaatggaggatacagagagtgacgacccgttccaaggtacatgggaacgctaaagtgccgcgtgggtcgaatcctttctgagtaaaggtcgcgtctgtcaattatgctttagtcactcctccagagtggaaataaacacttgggaatgccacctacttcagaactggcatctccttctgttagtattgtcactgaaaacattaacagtgcattatttcacaactcccttagtacacttgaaagtaattttccccaaatgggaaaaaagtaagttttttttttaactaattacaaaataaaattaggatttgtttacaaaatgtagagcattttgctcctcagcatatattttatagcttcttcaaattaggagaaaggatgatgataatctacccaaagagaaacatttgcaatctaaagcaaagctaataaaattggcctctcaacattttctaaaaatgttttcagtggtaacagtgccaacagcacgccaagagcatctatacttccaagcaatctaccaatgtccatggatggaatatgtaagagttcaatcagtattcaaaaaggaatcaaccctctccctattaaaaaataacaatcatcatgattagcacatgatctctgtgaaattcaatcacaaagatttgaaaagccatctagcagaaataacctgagatttgaaaagtcatctagcaaaaataaccaaatgaaagcataaatcatcatatcagaagttacagatttcatccagcaaaatgttagcccatcttctataaaacatcactaaaaatcacacgtaatatccaggcagattttggctgaaatggtgaaggtaagaatagttctcgttctgaaaattctgattaaaaagtatggagggagagaaatccccttctaacttagagtaaaataatgagtaccacttatcttggaggatttattccttcacttttgaccaggcactgggaattttaaaactcagttcaaagaaagaaaacgaaaaaaacatttgcagggctttttttttttttttttaatgagacagggtcttactgtgtcactcaggttggagtgcagtggcgcagtcttggctcactgctgcctggacctcctgtccaggattgcctcaagcaatcctcccacctcagcctcccaaatagctaggactacaggcgcacgccaccatacccagctaattttgtttatttttttgtagagatgagttctcactatgttggccaggttggtctcaaactcctgggctccagtgatcctcccacctcggcctgccaaagtgctgggattgcaggaatgagccactgtacctggcccagagcatccttaatgtggcaagcacttctaggtaagtgttaagtatagaaacataaagaagaccaaaccctagcatcagtgatcttccagttcaggagaaagcggtaattaaacatacctgtgccagacaagtgcaatgtaaatgtgttcagcacaatcaggggtatgcacaatgggctttagggaaacagagtagaggcatcaaagtcattcttataggcatgtcaggaaagacttggaagcatctcctgaattttgagtctcaaaagattgagaggtatccaagttcaaaggagcacagaagaaaacggcattccagataaaagtgaaagcaagaaacatcccataatgcgcaagcatctgagggctgctaatgcatgccctagacaccttcctagtctttgcaaataattgcttctcagtccgatatcaattattgataactattaactgacaatctacatactaattaaaatgcattcatatgaatatacaaaacatcctcattttaagacttatctctaactccctgccaaaggaatttccatttgtcagggacttagcatggtcacatcatagagtctgttttgcctccccacccttttagatgcaaaggcccacaagcaagatgccacagctgattgaactagcaggcagtttagccttagtagctgaccaacaaccatggtgtggcctagcaggaagggccaggctaacctaatcatattctttttctcccaaatttgagttgaaaaatactgaaaagatgaagcagttcatagtgcaaaataaaactgagggaatacaaaaagcaaagctattaaataacttcataaccatgaagaatcacagcaatctaaatttacaaagctactagtatgaataacaagaaactatacaaaaaagaaaagctacacaaagcagaggagaataacaaccctgctaataaccccaggagaagtagacccagagagaaatcagtatgtgaagaatggctgagtgcagttgcagacaagtctgtttcttagttaaaaaactatattcctcagtttcttgcagctaggaatggcagcatgatcaaattctagtaaatgagatataattagtaagtcttacaagtcttccaggagggaagcacactcttcttctgccctttcaccatccagctatctggaatgcagaagtgatggcaggagctctggcactaattttggaccataagcttaaagtctacatatagtgggcagaagcttcttggggccctaatgacttctggacttacttgcctgagcaaaaaatgaaactgtcaaagccactatattccaaccaattccagtcctaattgatacagtggttgagagaatgtgacagaaccacaatttgaactcaagtcttttggacgtgggggccaaactcaatcattatgagcaagtgcaaatgaagtcaaacaaactgagtaaagcaggtttacagtttacatgtattttataattcaacaaatcataaaagtctgactaccaaaggccaataaaaaagaaaaacacgcagatgcagtgtcactcacctactacaaataacactttggacaagcctctttgactctgtagcctacctggacatataaggtttttccctcaatacaagtacctacaataaggcatatgggcaataaaaactgaatataggcaccagcttctcatgcatggcagaaacctatcaaattcagatttgtaaggagtagatgagacttgcaagagcacacgggattctggaaagcctacagcatattttgcaaggaagtaagaggcctgtctcattaacttcaagcaaaagaattttccatacgtcattaacaactagaagaactcagcccaggcattgtaactccctaaaccactgatgccccagggtggcaagtgtagcatagatcggcaattcctttgaaaggctcaaggattttagatgcccaagctgaagcaccaatgaactttgtattaattctcttcattaattaaacaatttcatatttgcattgaccacacattttgtgcccagccatgtcccatgctggggacggaacagtgagagcaaagtccctgctcttatggagcctacactccagtggtagtggcacacaaaacaacaaataaaatcaacttagatggtgacaagtcctatgaagaaaaaaaaaaaaaagagagaatgtgcaggagagggtggatttccggtactgctatttttaagagcagacgtggtcattctaacaatattatagacaataaaagagatgccaaaaaagctttcaacagctttgcttcccaaaccccttgcataggcaaacacagtatttctaccgtaaaaagtcacagcattagacactcaattcaataatccacaaatatttattgagaagcagttctgggagacattaagagcaaatctaacagctttcagtgttaagactttctggaatcaaatcccagccatacaacttactatttgtaggagcttgggcaagttgcttaacctctgtgcatcttaatttgtcatttgtaaaatgaggatcatagtagtacctatttcattgggtactaagaggattcaatgagttataaaaggaaatacagtaagcttcagatttgtattttgttttatatattttgtaattgacatataatgtatattttaattgaatatctgctatgttccaggcacacaacttcctctaagcatttgcataatggggccccacacaccaggaagccccaggggctgcagtctgccatcagcttctacagatgccttgcattcaggccttgtctgtactcttggtgtctccgcctgctgtcacctgcattaccaggactaactcctgtgacttcttactgcaaatactgtaacccagaatggtaactctgagattccccaaaggagtaaacattccaaatccaagtttctctcttaccactctgtctcaacagagccagcaactgatgcaaaacaataaacaacatccattttttagccaggcctcacaatattgtccagattggcaatgcgacatgtttaaactgaagaagttttagtctacattatataagattatatcaactatcactcaacctttttttttttttttttgaggtagagtctcactctgtcatgaggctggagggcagtggcacgatctcggctcgctgcaacctctgcccacctcctgggttcaagcgattctcctgcctcagcctcctgagtagcttgggattacaggtgagtgccaccacgtccagctaattttcctatttttagtagagacggggtttcaccatgttggccaggatggtctcgatctcctgatctcatgatccgccctccttggcctctcaaagtgctgggattacaggcatgagccaccgtgtccagcatcactcaatattttaatattcaataatatttaatatttttaatgctattataatgataggcatctactttgccatgcattgtccattaggcacttggaagcaaaattaattagaatcataaggaaaattatatttattcaattatccagagtatgaattcatcttccattccctacgtcccattcgtttttaatataattaaatgaacacaacttttcagcactgtccttctactaaaaccttagaaatcattgtttaggggttctttccttgaatttatctttttaagccacttctttgggcatgatacctacactgtcaaatctatatttaaagtcctcaaaatattcaaatggccaaccccttttactgaatcagtacttctatattaacttacaaaaattattgtactgccaggaaaaggctgactacaggagaacgtggtctaacaaccacttaaaggttcaaaaaaatttctatttgcctattaattagacaatctcaacttttcttcttgtttttctaactgtggagggaaaagaaaggtaagctttgaggttagacaaacctgggtttgaaccattcaataagttactttagaaaactcatccaccctgaacttcaataagtggtcctcagatgagaaaagagaacagataatccttggtttccatgggggattggctccaggaccctctgcagatactaaaatctgtggatgctcaagttcctatatgaaatgctgtaatatttgcatgtaacctacacatatccacctgtatactttacatcatctctagattacttatacctaatacaatgacaatgttgtgtaattattagactgtattttttattttgtattattttttatattttttgttcaaatatttacaatttgcagttcattgaatctgcagatctagaacccgcagatacagaaggctaactataataatactaaagctactaactctactgaattaaataagcaagcatcaggtgcttagcaaagggaagatattttctcacacctagtgaatccaaagccaagccgcccacatctactactggaatgtggatgagtctcctgaacaggccccactagttcccatctgatccctgtataatccatcttccattcaacagccagagcaagttttcaacatgtaaatctggtgctatcacctcctgcttaaaactatttaatagtttaagagtaatcttaacagaaacccaactcccagccacaactgccagaccctacggaatcttaactgggctcccctggggcttgggttcacagccaatttctttgagccactcttcagcatctgataccccaacctctgagattcctatgagcagctataccactgtctcatacttgctgaagacaaatagccccaatctatatgctcagggaactacttggggttttctgtaagtcccagggatccctgtgcccaactcaggtggtagtatctacctacttttgtccccagggactcaccctatttcccttttctttttcaagggataccactttttcctaagtcttgtagattttctccttaccccatccctaaagcctggctgccaagtggcaggagccctcccctccctcccttgctgttgatgttcttgcttctccaaagatgtgcacactggcccttctttatgaatgggttttagtgctaaggactaaagggaacagatatgtggaggttgatataaaaatctaacaactaaaggcagtatagtcattgcctatgtttctgacatgtcgtgtggataagcaagccactgaaactcctgccctccacctgttatcagcaagcggatctctccaaagtcctcccttcactctcaaaccagaaggcagaatcacaacccatgaaccaggtgagctatagaccctcgtaagcccactcctttcagatgaacagtttgcatttctgagggcagagttcctattcaagcgtttcattaagatagtgaataatgtctagtaactatacctatagaaattgagtagaaccacgcacaattcaatttaaaaggatggccttatcttacaagtcacaagagaaggaaaaaaaggcatttactaaggttctactatgcgctaggtatttttatactgtcgtctcactcagcgctcacaattagagcaacgtgggtatttccaggcctgtttctcatattaaaaaaacaaaaggatactagcccgaggctagcaagtggcagaaggtagactactgcccaggtctaattctaagccagtccttttccaactctgcaacctcacacggtgttgcaaagagacagttggatattcaagaaatacttttaagtagaaattgaattttaattagagactgaaatgagaaacaacatgttcaaatgtactgtatataaaattttaacacacaccacccacacataactcatgctgccagagtaacttggggtggggggaaagatcaagtttcatgataaaacctatgttctgccttctcactgaagatcagctcaacattgcacagtgagctactttccaatctgtaacatttgcaactatgattctgttggaatcctgtttttcctcaatgctacaccaaaaagagaacaaaatgcagaaccaaataaactatttgataagccttcagttctcaaccatgtctaaaggcagtttttgtgttcatcagaacagcttcattgtcctcactgattaatatataataataataaacgtgtaagtaaatatcataaatataggcttgtaaaaagtcaaatatagtaaaatatcacttgtttaatagttctgcataaaattagttggaaaaaactccactgcctaaatgaaaagaaacatgttagttcctcccctataccacaatgttttcttaaataactcatagtaaagtgaagagagattggctgatacattaggatcaacctagaagcaaggaaaaagttgaaaggaactttgcatctattccaacctctcactcagtgcatgaacccctttctgtgatgtccctaacaggcagggacccagcttctgttctgtcatttcctactcaaggaagatgaacaaatcttaagagaattcttctttacctgaaccaatacctggccttcctatgatcatgacctgctcagattcatagaagactttatgcccttcaaacaactaaagccactcatcatatcatcctttttttttttattgttttgagacgaagtctcactctgtcgccaggctggaatgcagtggcacgatctcagctcactgcaacctccgcctcctgggttcaagcaattctgcctcagcctcccaagcagctgggactacaggcacgtgccacccacacccagctaatttttgtattttagtttcaccatgttggccaggctggtcttgaactcctgacctcatgtgatccgcctgcctcggcctcccaaactgtcttgctcttctttaaaggttctccccaagtccaaaagccaaaactccaatgccaacgaaaagtatcatgcaatactgcctctcttctttgaggaggtaggtaaatcctattctactaacccagcggctggcaaattccaatctgtgggaaaatccagtccactgcctggttttgccaataaagttctgttgaaacacaaccacagccatctgcctatctattatctacagctgctttcaaactactaaggtggagttcagtagttgaaagaaagacatatgtatattacgttcagtgttacaggctaccgtctcagtagttacaagggtcatccctgtattatttaggatgcccaaatgcctgccaaacattaagctcacaataagtatttgctgagtaaggaaggtcagaaaaggaaagagggagattagaaagaagggaaggtagggcttttcttctcccaaaactaacctgaaatccagccttatagaatactttaaaacctgacagatccttgtcttgctgcaagatcttttaacacagggctacacagcagaattaaaattgaggacctaaagcgactatgttttatttcaggcacataaacactgattaaaatatcatttaataaaacaaaagtccttgttaattttgaatgcacaggaaaatactactcatagtgttagaagcatatgtatttgttactgttgctactgcttattgtcttaatatcactcactgcagttatataaagcaattgggataaataatctttccctcagatgaactcttaagcactctggatttggggaaatagaaaagaactgctttaagacagatgaggaaaagactgaatcatcaatgagcttactataactcttgattcttcatctccttcatggtttaataatcactcacttttacgatggtttattcaagacaacctttgtagaaagtattaaaatatgcatcacatcttgcacagcttttcaactttttaagcaacttgtttcattatacttgtgttctcttacaaagaatctgatgtgaagaattttagaattagcaatgcaagatctttctcaacatggaatcgaaatttttactgagtccattttatgaaactatttcacgtgaatattaagtacacataattatttatgataaaacaggaagaactcagaagacatgaaatggaaaatagtcacctatgggtattaacaaagatccccagtatagttaggtattctccccaaataatgacataatgaaactaaaacatcactagcacaggaatctcaggatgcacaaaaattgcagcctacatccacagaaataataaataggggctgcactccaggctcaaaaagtgatgctacccacagcccaaggccaggtcagtagggaccctgaaagagtcaggaaatgcaaaggaaacctaggagcaatcgcgtgatcacatctaaatgacccaacctttaaaacacacatagaaatcccaaaaaattataggaaaaagtatgttacactgaaaaaaacattactggtgaacaatataaaatatacatttctatacaaaatgaaacaaagagagaaatccaataatccaaagaggttttctactttagcccagtgacttgaaaagagaaccagcctcattcaggaaacattcgaaatgaccaagaacggcaacattacccaataaatcgtcccaatgctccttcctctaccataccctgcctctcaggaaacattcatacaggaagaagggataaaagagctggccaataaatcacatgctctgcttctcaaaagcagaaacttgactttcaaattgtttgactccaatgaaataggaactgaaggctccaaacaatcacagaattccagagtagcacctcagaaaactcatctactgagtcggctcgtgtggccgaacttaggtaacagctgtaagcataactggcctgaggagagatgtgggccaccctcttccctgccaggacctttcaccctgtgaatcagaaatagctgccacttaaaacaccagcaagcagttgaagtgtctttaacccagttaccctacactatgcgtattaggcagaggcagggagatttttggaaggctggtagggggaaaatgaatcgaaatggagcaaaatctttttggtgacaacagtaccataagtccttgttttatatacacttttgtagtacttacagaattaggctctcttttaaatgctttatacacacattaactcaattctgcgaggtaggtatttaatactatcattacacccactttgcatacaaggaaacaggcacggaggctgcagagcaggtaagtcacagagctagaatgcaaatgcaggcagtctggctctgcccctgaccattattatgtgcagcatctcagtccaatcaaatatttactcagcacctgtcaggtgtacttgtgccaggttctgggcatattaagaggcctgcaacccagccctgcactgtgccacaatgtgctctgtcctataacacagacaggaacaaaggcccgaggctgggttatggctagcacattaggcacctctgtgccagttcacaatggggatctgggcaagccaagcaggggctggatttcagccccacttgcccccttggccaggcacttctgtgcagtgtctaacaggcctcactgtctgaggcagccctgcagtggccctggaaggaccctcaattctgttttggtagtgaaaggttgggagaagagaagccctctttcctaacgagttctgcagagttaatgcaccaccaccactgtggcagagggttgtatggaaaggctggagagggcaggtactagtgtgagatgggcttattggaaaggaggcacagagcagtgtacagtaaggatgaccttaatatgaaagatgctatttcatctagcatttccctggtttaggtagttgggagaagattaggcccaggtttattgtgctacagagggtcctcattcagattactaaactcacagctcaattactggattcgtaagactctcggcctatttttttctactaagaggggttgcactaccaggggagttctagttcctgatgaatgggcagactggacccccctcaagggactcagttgctgtctggatctatcactaggctggatttctttggaggggtccctgggattgagtcctgccagcttcaggttcctggggcagagaattggtagtttgaagtgctgagtccagaagctaatgaagatggcccaggccaaggcctttccaacaggactgaaatctggttgcaggcagttgttggagcctggagtttgttttgttgtgggcagcctgcttagggctgttttgttagggcagtttgtgaggttagccctcttatgttatgtctggaacaattgtatagtaatctggatgcattgtcagtaaagctaaaatgggctctgtgatcatgacttctatctaattaaaattataaggagcatagtattgtggaaataatttttagttttccctccccttggagagtctacctctgacctctgcagtcttcaattcacacccctattgtctgaccacattgaactttctttccctccagttttctgacttgttactccatacaacatttatggttcagcctcatcaagaccaccaggcccttccatcttctactttctttttttttgagacggagtctcgctctgtcgcccaggctggagtgcagtggcacaatctcagctcactgcaagctccacctcccaggttcacgccatcctcctgcctcagcctccccagcagctgggactacaggtgcacgctgccacgcccggctaatttttgtatttttagtagagacggggtttcaccgtgttagccaggatggtctcgatctcctgacctcgtgatccgcccgcctcggcctcccaaagtgctgggattacaggcgtgagaaagtagaagaaagtagaaatcttctactttctatgtgcccttccttcctttcctataactcagatctcagtctataatttcaaatattttcttaccagtgtactaagttcccgcaccccattgtctacctatggattcaccttagattaggaaaaaccctaacccttaccaatctaacggcccaccttcttaaaactacatctagatggctacaaaggctacacaaggaaagaaaaaagaaatcacacaaccatctaaatgtgtgccaagacggtctgcaacttcagcacgacacaactaccaaccctctgtgtctctggtcatcctcggccctccgtcctcactgcagcttcttctatcctcctcagttaaaaccgctacctgaccacatttcagtcacacttggcaaaatgacctcacgttctactgcaccagcactgcgccatctctagtcccatttaaggaaagccaccccccaaccttcctgcccctccagttccagccctttctcttctctttcctggtgaatgtctcataaaacattcattggagcagcatcatttcctcattccccactcctccactaatcggcaccgcaacaaggcccatgacagccctctggccaaggtcaccactgacacgaattcagtggtcattttccagtcattatcttccatgatctctggtcaacatttaacaaaattggccactttttcctggaaagtctctatcctcacctgcttgacatcacactctccaggtttccttccaacctctcagttctctttctcccagactcctctttctggttgctgttggttttttggtttttttttcctttgcattttttgttttgagatgaggtcttgttctgtcacccaggctggagtgcagtggcacaatcacggctcattgcagactcaacatcccaggctcaggtgatcctcctgcctcagcctcccaggtaattggggccaccggtgcatgccaccatgcttggctatcttatttttttgtagagacaggggtctcactatgttgcccagtctagtctcaaacacctggccccaagtgatcctcccgccttggcctccaaaagtgctgagattacaggcacaagccaccatgactggctgccaagttcctctttggttcctttacttttggtgatcccataaaagctgcatgtatactacacgccagcagtggctgaggccgtaggcatcctcaagtattttcctttcccacacaactgaaccctcatgcatggctatggcttcagctaccatctaagtggttgcaaatgtgagctcaaacattagccagacctaggttcaaattctggctccaccatgtcttaggcacaacatttaatttctctaagcttcagttttctaatctctaaaacgataatagtaaatgtatagcatataaaaaatactgagcactgtgcctcctgcaaaatattaataatatagtatagtatacagtatgtaacaataaatgttagctattagcttttttttttttttttttttttttgagatggagtctcgctctgtcgccaggctggaatgcagtggcgcaatctcggctcactgcaatctccacctcctgggttcaagtgattctcctgcctcagcttcccaagtagctgggactataggtgtgcaccactacgcctggctaattttttgtattttagtagagatggggtttcatcatgttggccagatggtctggatctcctgatctcgggatacatacacctcggcctctcaaagtgctgggattataggcgtgagccaccgcacctggccctaggtattagttttaactacatctccaaacctcacctctgagtttccatttacctatgtgaaatctcaagttgaattactgcacaagcagttcaaactcagtcactctaaagtcaaacttctccctttcccaccaaacctgctatttcttcagggttacagatcatagtgcatgaccccattacccacctcaatacctacagtggttttaaaacatgcccaaaaattcttcaaccttcctcccaccaagagatatctcccttctgcccttgaacctagcaatgccttttttactgccttgatgaaaagaacacagtaaaagtgacactgaatcactgttgaggattgggtagaaaagaccaggcagtttctgccagtttctcttggtacgtttgctctgtaagccttcggcctcaatatgagaagtccagctatcttgaggccatcacatagaaagaccacatgaagagagatgccccagggggccacccttgtccagcacccagctgttgcaatgtacccagctcagatgccaggcatgtgtatgaagccttgaggtgaccccaccctccatctgattacaacttcatgagggatcctgaacaataactgcctagttgaacccagtcaaaccccgattcacgagtaaaatacattgttattgtgttaaactattgttttaaggtggttcattactcagataaccaaaacaatgctcaaaccaaaaacctaagaattatccctgagatctattctgttgtcatcttccacatccaattacaaaattctggcaattcttaaatgttgttaaatccatctacatttatgcatccctcctgccccttcctggttgtgaacaccatcatctcatttctggatcaggacatcttcctaactagtcttgctccagtcttccctccctttccaatccttctctgcactgcagacagatctgaccatgtcattgcaggcaaactttcagagtttccatgaccctagctgggctctgcagcttcatttctagcactgctccaaaccctgctccaaaaacacagaacccctgaagtcccttgaagtcatggggttactcacccccaaatttccgcacagctattccttttgcctggccctggccctgcctgtcactgggccaactttactcagctttaatgttgcagatgttaaaagactcctctgggaagttctctttggccctgaaatctaggttaggttgcctttcatgtgctactctagccgtctttatttccctccagatagactatgctactccaaaatgtaattgtttatttttcatcgtacaggagcataagtaccttgagggcagactaatgtcttattcactcaacatttttttttagggaaaaaagcaaatttagaaagatagagcattatgttacaattttggtaaaattcttaaagcacacacaatgatactatatatggtttacacccacatgcatatatgataaaaagccaaaaacatgcatgagactgttactcactaacctcgggatagtggtcaccactgagaagggtggaggaggaagcgtgcagggaacaggagtctttagtttcatttaaagatcaccagaattttgaagtcaaaatggcaaaatgttcaatcaggaaggcaggtacacagaagtctgttatattattttctgtacttttctgaatgcttaaaataattcataattagaaataaaactctgaaagaattatatttctgtttagctcctgactccatgtctatactgattaggaacgggtatagacctccaatgcctcaatcagtggtcctggagtgcctccagattgtcattcccttccccaagagaaagagagagagaggccagagcagcagctctcctgttgaaaaaagaacccaagggaatccctcttggagagacatggacataattagtgggataagtcctcaactctgaaagcagcagtccagaggttaaaacagttcccagcaaatctaggtacagaggaacttgataaatgagattggcttgcaaatgcaacttttcagatggtgagctactatcaaaatcatgtaggagtgcttggctctatgagccaaagggcagaacacctacctttatgcacactgaaggagagagtgggtaatcaatgaaagcaaaatcagtgagcagactcccgcctcaaacacaaacccacacaactttcccagtgggagctgcactgtcactgagttcccagagggcctctcacaggcaaccaggtgacagaaacaatcaagtgacccctcaatttccagaattgttatctatggttcacacagtctctctcactcatcctctcaacaattattaattataatagttaagcagcaccgaagaatgctcatggccatgggcttagaatcagacaagctcatacactgatcctgaccctgaccctccactggttatgcaattctgggcaacactcaacctttcagagtctcaagtttcctcttttctaagttgctatgtctttgtggttaacagcactgttgggaggattaaattaggtgatccaaggaaaacactcagcactgtaaatggtacacagtcctgtatttaccagacactagactagattccagtgataaaatggtgattaagacggtcagggaaccagcaatgatgcaggttacagactcagatgccagccatgtatttagcgctagaaatctgaactggccttataaattgtgcggcccagtgcaaaatgaaaacgcaaagcacctgttctaaaattaagatttttttttttttttttttttttttttttccaggatggggaccaaagagcagtaaaccaggcatggggctcttctgaacccagcggttgcatggctgggaagccagccctgctaaaagtagatgtgacttggtactttacagacactcggaaaatgagggtcaaccagaactgggcttcttagactcatccaaacacctgggacattgggacatttggggagatgacaggggagagccacaacataacacagggggctgcaggatccaaaacaaaagcccctcaataatttaatttgtgggaagtatcagaggaaattcccacttcttgtcacctacaatagttatgagaccttccctaacaagctttccttctctttagtctaccttagaaataaatccttttataaagttaataccatcaggagattttgcccagctgaagtccataagcaacaggctgcttatggcctagtatctattgggaacagctgacttcccaggcagtgcgtggcaaaagaacatagcacagtctcagtacctcttcaaaagaaatggggctgggcacagtggctcacgcctgtgatcctagcactttgggaagctgaggtaggtggatcatttgaggtcaggagattgagaccagcctgggcaacatggtgaaaccccgtctctaccaaaaaatacaaaaactaaccatacgcctgtagtcccagctactcaggaggcttaggtgggataattgcttgaacccgggaggcagaggttgcagtgagctgagatcaagccactgcactccagcttggatgacagagtgagaccctgtcaagcaagcaaccaagaaaagcaagaaacaaacaaacaaactgggacttggggcaggtaggaatgtgcccctgaaagtgacactaggggactgagtaaggagatcgcaccactgcactccagcctggatgacagagtgagaccctgtcaaaaaaaaaaaaaaaagaagaagaagaggagaggaaaaaaagaagaaagaggaggagaggaaaaaaagaagaaaaaggagaggggaggggaggggaaaggaggggaagggagggaagaaaaacgaaacaaaacaaaactggggcttggggcaggtaggaatgtgcccccaaaagtgacactagggggctgagtaaggaggttgcctgaaaatctatatgtggtcacctggtggaacactagatgctgaagatcacctcagtggctatgaccagggtatggagactgtaaggcaggagttcccagcacacaacatagttctcttcctagccagccttctctgtaacaatcacctgccagagtccttggggacaagggcgcatcagcctgcctgctcatggccactgctttctttaacatagtagtggtcaaggaccacttttctgtacctgtttacttaagaagcaatatactaaaaattttgagtgcatcccaactgccttaacaccaagctgcctgagcctctgcctagcacaagggaactacttgtaggtggaaggcaatgaagagggagggccctggggccacaagcgcagttcaactacttgctagctgtgtgaacttgaggaaattacacaacctccctgagcctcagtttaatgctattacacatgcaaagcacttagaacactggcacagagtaagtgttcaataaatgttaactgattttgccctcctgattataactcatatacttatctcctctcacccccgacctgagcactgcccacatgccaacaagcatgtggctttggcatctttcagaatgcaagcccctggagggcatgaatcaaggtccctatgtgtcctctcctagggctcatactgttagactggagccacagaagtttgggaaccagacttaacacctttgtagaaaagttcctacctaatggtacggatttgctcaaaacatttttgctatatgaactccatatatggtagatctgtttattgtgctcagataatttttatcttataaattattaagaaaggaatatttaatatgactgcctaatccactcgacatttagactaaaaagtgacctacattatcactttaaagttagtcacaataaatacaacttacaatgttcatagatattcagggttaaaaacaacgaaacaatgtacttttttttttatcaataaagaagttcagttcacagataactgaacataatatgaaatcacaaatgtaccttcactcctcttttcaagtaggatcctttacaatttcatagtgcctgtgggctctaccctttgtagcacatcatgggtttctattgttggttagttagctggtttttatcctgcaaatggtgacagatttgtgatgatcaacccaattctctcaccacatcttccccactgagacatacatttttatgatggcagatacagcctataaccaagaaactaaataggtcaagtccaccagtctatacaaagaaatcttattaaactaacctatcaaatctaatcttattaaatcccaaacactggcagggcacggtggctcactcctgtaatcccagcactttgggaggtcgaggcaggtggatcacctgaggtcaggagtttgagaccagcctggccaacatggtgaaaccccgtctctactaaacatacaaaaattagctgggcatggtggtgggcacctgtaatcccagctacttaggaggctgagacaggagaatcaccccattgcactccagcctgcatgacaagagcaaaactctgtcacaaaaaaaaaataaataaataaaaaatccccaacacggtacagtagtttcccctcatccatgggggatatattccaagtcccagtggatacctaaaaccacagatagtactgagctatcatagaactaactaacatagcacagagcacactatattttttcctatacacacacacctatgataaagtttaatgtgtaaattaggcatagtaagtgattaataataactaataataaaagtgaacaatgataacaatatacagtaataaaagttatatgaatgtggtctctctctctcttaaaatatcttattgtactttactcacttattttgagacctcggtggaccatggttaactgaaaccttgaaaagtaaaaccgtggatgggagggtggaggctactataaacaaatgcaatgaatattaattgacaattagcatccaagactaatcaaccatttttacttgtcacattttcaagtctaagtttatattttagttcacaataaaacacacaaaatgagagaaatgtactagaaagcaaagaagcacatcagaagctaccccctcccctatgtgccttacttaacctgtcctgccacaggttcctctagagccacacgactgccagtcctgcagtcaaggaggatattacagctgagggttcatcccgcatgactttcagggccatgcagaaagtaagggctccataaatatttgttgaatagataaattattcaaatgggttttattttcgtagcttttaaaagattcttaaaagagtcttgtgacttcctgcttgttgattacaactcccagtatttccataaattgagactagtttaaaaggtatttcaataccactaagcagtaacagtcattctacaggaggtataaaagtaacatcagcaacataatcacaatacgttaactttttttttttttttttgtcttgagacggagtctcactctgtcgcccaggctggagtgcagttgtgcgatctcactgcaacctctgcctcctgggttcaagcgattctcctgcctcagcctcccaagtagctgagattacaggcatgcgccacgacacccagctaatttttctattttaagtggagatggggtttctccatgtcagccaggctggtctcaaactcctgacctcaagtgatccgcctgtcttgccctcccaaagtcctgggattacgggcgtgagccacctcgcccagccacacaatacgttaacattttatatttgaaaagcaacgtactgtttacaaatggctttccctccactatctcatttaatcatcataggtattacacagagtacaaccaattctaccactgttgttttgatggcgcagagggaaaaaaggttaattccagatcaatcatcacatgagtcaagacagaaaattttgaactgaaaggaatctagaagttgatcttgtccaacctcccaggaaaactcgagaaatgtgtttttctctttcattttaacctgactattttctcctaccttatccaaaaagctctgcacattgtgttactagttctacctatgagaagaaagagtaagatgctggtactgcctgttgggacagcagctaaatgtttacccagagacttggcagatgtaaacatggcctttaaaccccatcatggaaaggggaaaagttgtgtgcccttctaggaagattcactcatcaactggaaaacagagatttttatgtttaaattgccaccctggctaaaaggattatatcttgatcatcttcaagttaagagtaaaggatacattctgcattcccctgaacaaaacacctaatccaaacagattttatcttgtctcagtttaaaaactggtgaaaaaaagcagaattttcctttccatttcatattcatctgattcaacaaataaaatatcgggccctaactattaatacatgccagaaaccaagtcaggcaccgcaccaggtgatacatctaattgattaggattagcaaatttctattctttctctcgactgaaatcaataaaaccctgtcttaaatattaaagtactatccctgtccctcaccttgactgtcacttctgagaacatttgttttaagaaatcaacagcgacccgaagatcagtagagcttcttcatctgttttaatatctcaatcttattaaaaggattaatcctgttaagacaaaatagcacctccacctttctctcccttcttcctttccactctcctccaaataaaaaggttaagtgacgacatccagcccaaagaacaatgaacaatagatacatacacacacacagctctctcttccagtttccaacaggaacaacacaagaaagtcaaatactgattaaaaagaaatgacacacaccatcattcttgtcagtgcatggaaagggaacttactctaatccattcagcaaaatctggagtcaaacttggaatgaaaggagcattttttttccctgcaaggtaagtaaaagaactcaggaattttttaaaaataaaataagataccagatgcaaataaattgatttctattcctcagaaatagggcttttaataaacgccacacagagtatgcataagcaagcaagtcaatccgaaagacaggaagagaaaaataatgtgtggcacatcattttctctgaaagtcgacaagcaaaaggtgaacacaaaaaggctacctcgggagggctagttttttgttttgagatggtttttctgtttgtttccatccagtttaatgctaaagaattttctgaaatcttttcacaggggacacttggcacactcacaaaaactaaactgtttcctttaagatttcttttctcacctccaaagagtagccactggcttttatggggttggtcactgcacttgtgaattttagatggataaagtggcaaaataatgattttttttaaatataaaagtaaaactaagatgtatggcaagtaaagctttttaaaaagccaagtcaaatttgaggcctgctgattttgacacaaagctgttagtaaattggcaaagaaattaatctgcttttagggtaaacttgagcccaggtaaaacaaaaaggccaagtcaaatttgtgacctgttgattttgacacaaagctgttagtaaattggcaaataaattaatctgcttttaaggtaaccttgggcccacaaacattcatccactcacctttagactatgcctatctagaggttagcctgagtaattaaccagagttatcaattttgttttcactaagcattttgataggtttggcacctcaaagacagctttgtgatgcaatttataaatttaaaacacatccggtaaataaagaaaataataaaatgtcagaaccacctgattttcttttttaagaactatttaagtattcaaaattagcttttagtagtacaggcaatgtcaccctttcctacttggtaattatcccaacaaactttcgctttaatttaggcagactgcaagacaaaaaccatgtattgtattttataagataaattacaaattaaatcagttatttaacttagaaaataatcttctggcagctctcttaacttacagggcaccttgtattgtgaagaatgttcataatcagataatccccgtaaccagctacagtactgggtgaataatatccctttatcacaaagataaaggaagttactgccatcaacaaatgaacaacaaaacagaacttgaattcagaattttagatccagctccattcacaaggctatgcattaactgcagtcaccatcctttcccacaagaccatcaagctctgaagcattaggagaaacattttctttatgtacactaaaataagcccaaatacacagataacagcacaaagccggtccggcgtttcttggccatcaaagcatgcacagactttctcagtacagccttaagtgtaattcctagaaggcactggcaaatctctgccaggccaatctgcagtcgaaaaccgagtgcatgtgtccaacaagatgacaggagggtcaatgtttctaaccgtctacttcaactctgcatggcaatagcggttctgcccaacatggtaaacacaataatcgtataggatcgaacacaagtctctgtaaatgaggatccccttaaacgcaaacaagcaactctggggaaatataatttctggaacaaaacatggtgctcgcataattccacaaagacacatagaagtccatttttaaaatgatgttcggtcccagcactgtgctgacacttttcccacctaaacttctcagcacaagcctggcctaaacagccgggttccaatccgtgcacagtggaaccgcggcacgcacccaagaccggaatggtggggctatacctgtccctactcagtcctgttcgtgccagcctgcgaggtagtttagacccgtctgctttatggtaatgtgcttttaaaaccccgccacgaccgaggtcatagctttagagatttaataacaatcaaatgaccagggctgctgggcacttagtgagccattctggttatggctctttaatagcacctggagttctgctccagggagagaggaaaactcctgctcccccggaaagaaagtcctctgcggagagcgcagagggaagccaggaagccgatcgcgggcaggggacgcgccgccgcggccgccccatctctcaagcagccccagcgcgaccctcgccctgcagccgtgctggcccaggccgcacctttacctgtcagctccaccacccacccgccctggaggctgcccctccgagtccagggaaaggcttaccagccggctgcgggagaaagaaccccagaggcatcctatcccaaagaaagaaagcaaaaaggctgctcctcaaggcagggggccatcgggcacgccgagatccgagaggcgacatgccacccctgccctgcacctaccagataatccatgtacagaaacgcctcagttattcggagatcagacatccggcagcctaaagcatccggaacggctccgaacccggaaaaaaaaagcagcgtctctggctgcgagcgagcagctcctgaaaaagccagcaacagcgaaaatagccgaaagcagccgactagccggagattacacaaggggcgcggcgattggccaggcgggcgggcagaaggaaagaagcgtgctcattggctgcggcgcctataaaaggcaggccccagctggtggcaggagagaaacgcgggagtggtgggggatgtgggttcctgtgtgctgagcggaggagccggggtgggggcggtgcaagcggaagaaagagccaagagagcggaaaatcggctggtgctgtcgccgcccgagttttgtgtttccacagctttccagttgggtacaacggagccgaactccgtgttcccgggctggagagccttggtgtccccgccaacccccagtaggaagcgagcgctgtaacatgggaggcgtggtcgccactgatcttgtctccccccagagccttcctaaaggctctgccgccacgagactgcaccaccgggaaagaagtgtgtgaaagtgtactccgtaaacaggcaatcctgtacgcgacttaggggcagaaagaccctccgcacttttatcatttgaaagtaaggtggacgattccagcctggtgtccctgagggtacacacaggccccccgcgcagccagaggtgactcaggaaccccccttccaacccctgcgtagaacgccgaacagtcttcggagaattcgctttcctccacgtgaaaaggaaaagaaaaacatttgaggagtcgcagtagtcacttgtactccccaaacacacgggaagaagttgatcagtttgcatgcttggagtcaaattacgctcagcacaaatccaacgcccctgaattaaatgagcagtagaagctctctgcaaaaaacacaacagtatttgtgacccggtattatttcaggaggtaaaaacatctataagcagatgcatttgggacgtatgcatttcctggtaatgtcaatatcgcattaagctagtgggtttgggcagggaaagcctgaatcggacaagaagctggctttttttttttttaggctataaataaccagaccatgccagacacatgttcttaggctatgttcttaggctcaggtgattggagtgcccccccccccatccccaccctcagggcttagggagaatggaagataaggtggatgctgtcacctgtattaatagttagggcttgcatacatacagtaaagtttcaagagtgaaacttcatcgactgaactctttatgaagtgactgcctgactctacacgcgatgttttaggagttgaatttttactttccccctgacacctttcttttttgtatcctcaagaaacaaatttccgtaccgtaagtttacctgggactaccaaaacagttctgttagatgaccgtggaattcaccccaaatgtgcacataaccaataagggcgaggcagccccctagagggagctgtaggttgatgagccaagtgattttaggtatgcagtctaatttccaaacctgtttcctcagctgcaaaacgagaattcctacagccagaaagttgtgagggtttgggcggggggcggggttggggaagttgtttttgtttttttgagacagggattctctctgtcgcccaggctggagtgcagtggcgcgatctcggctcgctgcaacctccgcctcgccggctcaagcatcctcccacctcagcctgcagagtcgctgggaccacaggtgtgcacgactacgctcgtctaattttttgtattttaagggtaaagacaaggtctcactatgttgcccaggcctgtttctaactcctggactcaagcaatccgcccacctcggcctcccaaagtgctattagatccaattttgattttccttggcattctgttaattcaaacacatgtaggtttagaagagattttcacctagattttggaggagatggacgtccataaacgtacactctttagcacaatttgtttgaaactaatttggaaaacaaaatctctcaatgagcagaaatagtcatggaacattttttgtttgttttgcttttcttcgtgaataagcatatttaaaataagataaagggcttgagttagcaaagagacaccttatggaccattgtcttagtgataaatgatgtgtgggctactgcccagtcaggctttcgagaggcctatcagtctctatgcagaggaggatagccactcagaagcaggtggcttctgcctttcctttaaaagttaagcttagggaaagatagtcctgaacatgtcattagggtcagtatggttcttgctgcctctaagaattagtatatggggccaaagcagggagatgaaagaatatgttcaaggaaaagttccaaagactgcaccataatattcactttattccacacaatttgcacattcattgtgactggcatcaatgaaaaccttgtagtcagtgtaatgtattaaaaaatcacatattgcattttaggaaagagtccttataaaacaacaacaacaacctgtagattttgaactccatatggagcacattttttcaattagatgttttctgagatgtcagtgagtccgcccctacagaggaaagaggctaacttgactgaattggtatgaacagataatacactacccactacatgaagctgcagtcatagctgatagggttggtagcacctattgaggtaatcacctcaatacatgctttttaaaagagtgtagagaagttagaatgcatttaatcaacctaccatactgtatgccaagtaacagactgcaatccagaacaagacatgatctcattaacctagttctgcccttgctgtcagtgaaaagaatgaccctcttccagatgcggaagaaacatgtaaactcatgaggcaattgcattagtgcataggttttgaggaaagaggctgatacggtttggctgtgaccccacccagatctcatcttgaattcccacgtgttgtgggagggacccggtgggaggaagttgagtcaagggggcgagtctttcccatgctgtcctcatgatagtggtaagtctcatgagatctgatggttttattaggaggaatttccctgcacaagctctcattctctcttgcctgccgccatgtaagacatgtctttgctcctgcttcaccttctgccatgatcatgaggcatccccagccatgtggaactgtaagtccattaaacctctttcttttctaaattgcccaggttcaggtatgtctttatcaacagcgtgaaaacagactaatacagaggccatcactgttgcttgtcaaaagcaaagagaaattattttgacagtccatactctaaaattccataaaggctgctggctagccaaatttggaggaaaattttttgttaaactgtcacttgcaaggaatgaaaacagaaatgcatttttgcaacttggtctcccaactttccagaaaaatcaacatattagtggttatttccagctattcttttgttgtttccaaggagaatactgccttcactagttttgtatcatgcatacactatctcactgaaacttttcataaatctttaatggatacataaaactattgtaaaaatgtactactgtgttaacaaatcctttattagttactactattataaatattacagtgaatgtttgcttataaaactatccacatcttattatcctaagaataatttctagtaatagaattactggtacaaagagtatgagcacttcttttctttttttttttttttttttgagatggagtctcgctctgttgccaggctggagtgcagtggcacaatcttggctcactgcaacttccgcctcccgggttcaagtgattctcctccctcagcctcctgagtagctgggactacaggcacacgtgaccacacccagctaattttgtatctttttttagtagagacggggtttcaccatgttggccaggatggtcttgatctcctgacctcgtgatccgcctgcctcagcctcccaaagtgctgggattacaggcgtgagctatcacgcccagctgagcacttttaatactcagttttgacctagcttatgtagtcttcttccttctaccccccagctccaaagtagggaatgattatcttgtctcatctttgccttaatattattccttaatagctgaaagatggtatctttcattataatgactcttaaatcatggacacttctttttcagaaaaagtggtcagctctgcagaggtcatcaggcactttttctcacttaccacatccaataactcctgtgactttaaaattctcttctgagtcctttttccctttctctccagtggataccttgacacccacctctgatttaccccagtcctcttctctgcttcctaaacctaaatgaagtatcactgtgtcccagaagatgaacttcatcagaacagggtgtccccacatgaagccgctaacagagcttgattcataaatggaatcaagccaatgattattgaatgaggtcagaggttggaattagagtagggttttctgctcttagcatggtgacctacttgcaactcaaactagaggaacccctcactgaaatagctaagtctgaagtttttaatctaaaatatctccatgtcagtttaaacctgttttctctcctgcaggtagatcttaaggccttgtatgtctatttttcaaagatcagtcctggcagtcaagatgaagatttgtaactacttaactagatgagcttggacaggtcacctgttccttccaggctcctgtttactcagccaggggatagagttcaactaatccctaccatgattaagggtcactcaccttttccaaaaagggctttgctgggtcttggggttttaaagcaagataagacatccactgaaaatggtaaatatacgagggaaagataactagatctcacaagcaaccaccattcaagcaccaaatatcaagaagctgtgtaaatccctctcaataccaaccccagcaagttcatttaatctcttagatacatttctacattgctgattgtattaatttcctattctgcaagccagttatgagccttatggaactaaaataaaggtgttggaagagctaaaagagttaatagatagatggaggccattagtgaatcacactcattgcaattgggcagcaagtcctttcttgaattgtgaatctccttttctgccacacacgtgtgtctgaatctccctcaacagcctggcttgacaccttgcatgtagccctggcaccactaaagattgattggttgcttagagcatagacctcactatttacagccagcctcattgtgtcaatatgtcactgcctgagcatacttgttagtacttcctgacacagtcagctccaagtgaaggagaaaaatcaacaaatccattaggcctcatgatcaccatgctgaaatctcacagcaaaaatcacagataaaatacccttcccaagatcacacattaagtaacagagctaaggactttccttccataaccctggaatatctatttcttccctatactactatggaagtgacaagatcttgggatcagtgtgacaagaaaataaagcaggcctagagtctaccacggagaaacttccgcttattagaaataacaggacaaagaaaggcgaatagacaaagcccttcccgatacaaatgtgcacacagtcaacctggtgccagaggagttactaaagtgtttaagggatgagaactcagtgagggtttgccaaagtttctggagttctaatagaactctccaagaaagaaaaaatttatcttggaggatttgtgaggggaactttccagatgggaaaacagcatataaagaatcaatagcaacaaattggggatgaggcattacatacttaaaagaagatgagtgtttgagcccaaggtataggaggtatagacagtttagtttggggaagtctaactggtgcaaatcagggttcagctaggagcttctctgcagattattgcttcccaactccccatgtggtgttggtggaagttgatttgcagctccatccagtgtaattgctccctcattctggtccctaagactggcataaagatgtgccaactacagagggaagcaaatcccaaaaaagtgtttgggcacttgctttcttgcctgcttcttatgagatcatcacctattgggataatatagaaactattcaaattgctttcttgtaggtattccactgaaagttggaaacatcttgaatgcccgtgatttataattttgatctcttctttcaaggcttacatataaggaagccttaatccaagctggcaattgattcaaggcagcttgcaaggaaacgagaaactcagaaacaagaaactataaaataaagccaatgaaaaaagtggctatcatataccatctagataataatgcttcctatctcatccagacttgagattctgactctatgctgtttaaattgagaaagacaggcatgtaggtactctgggcaggctaatatggattcatgcattctacatacctatttaacacctactatatattagggatgctagagaaatattatccctgctcacataaagcttagtctctagtgattggagacaggaaagatatcaactagtgataagtgctatacagaattaaagagatgtgctggcgagtaacagggaagcatactctagacaggtagtcgtggatggcatctctgggttgtgctaagtgatacagtccaataaaactttctgtaatgatggaaatggcctatacttgtactgcccagtatggtagccattagctacacatggctattgagaactagaaatgcaggtagtggatactgtattgaacaatgaaggtatgcagtaaaaatatgaatggaggtcttccacttaaacatgacatattaaatatacttgcttatctcccccaccctcacccccacaggccagtaaaggaataaaaaagatccaccaagacagagaattaaaggagagactccagcatataagaggtcaaccatttaggaaaacagaaagtggatacagaagtggcaactgacgtagcggaacagagaaagctgaaggctaagttcaagaggcgggggaagccagcaagaaacaagctgattcctgttgcagaactctcatcagctcagcaataagcaccacctggttctctgaggtgggaaattaaataaacagctatttaaaagccatcatgtggaagcaccgtgccagacaagtttaccaagttctaccaaacattccctaaacaaaatgtcccaacttgaaactattccagggtagagaaggagggagtgcttgccaggtcatctcaaacaactataataatcttgatacctgatcaaggacatcaataattatatatcagtctcactcacaaacacagatggaaaaatattgcaaaacatccaagaaaagtagaaaaaaaaaaaaaaccacattgtgactaagccaggcttatcctaggaatgccagatgttcttaacattggaaaatcagttaactctccacattatcagattaaggaagaaaaatcaggatcacctcaacatatacaaaaaagaaaccattagaaattaaatatctattggtatttgttttttagagctgccgtaacaaaataccatccactgggtggtttaaacaacagaaatttattttctcacagttctggaggctagaagtccgagatcaaggtttcatcaggtttggtttctcctgaagcctctctccttggcttgcagatgggcgcctcctcgctctgtcttttctctgtagttgtgtacccctggtgtctctctgtatgtccaaattgcctcttcttaggaccctaggattattggattagggcctactctaacagcctcattttaactacctctttaaaggatctgtctccaaatttggtcacattctaaggtactggatgttaaggcttcaacatataaatttgggggagacattattcagtccataacaccattcatggttggcaatctaagagtaaaagggaatttattccgattgatgaagggtatctacaaaaaacttaaagcaaacatattcatttgtgaaactttaagtgtgctttaaggtcagaaacaagacaacggtgtcacctatcacagcttctattctacattatactagagaacccggacagcataaccagagaaaaaatataaagaatggagagaaagaaacaattcatcggcagattgtggttgtgtatgtaaaacacaaatctgcctatcaattattaaagttaaaattaaatctgttactccttaaaaatcaatataaaatgaattgtatttctagttacttagcaacaaagttaggaaatgtgtttttgaatatgtttttttaaatgacctttaaagtagaaactttaaaagcacctaagaataattgttataactttaagattttgagagaagttaaaaacctagaaaaatacagagatatgatgttcatggatggaaagactgtagagatgtgaattctccccaacttaacttatagatttaaaacaaacaataacgtttgaaatcacagagcacactgtatagaaacatttcttaactgttcttaatttgaggggagtgccctcctttttgtgagtgaagtgccagtcttctgcatatttctgttggcatttaccatactgttttgtgtatagtggttaagagcacagatgccagtctgcctgggcttgaatcttggctttccctctttctagttctgtgaccttaggcatgctacttaacatctcagtaacttatttaccccattttataggtaggaaacaaatagctacatcatcaaccttctggattattgagattaatagttaatgtcgtacattagaacagtgctgggcacatagtaagcattatgtaagtgttggctgctgctgctgctgctgttttcattctctctcccactagtcggagttccttgaaggaaggaaactgtctcattggattgtgcacctttggagcctacttcagtgtctgttaaataacacaaaatacattgtcagtgggggctggggatgagccactgtcctgaagtgtcatatttaaagaagcctgattcagtggcataaagtatttgaaaagggagtccattttctacttattttgaatactaaatgtccaaagcatgatccataacacttgtaaaagtacccatataattatttatccttcacttcttcgctgtttagaagccttttttcaccaaatgcctgagattctcccaacttattatcatggtactcaaggtacaagggttgaatggacctgattcctcagttcacggtaccctgtattatcatcattggtccacaacagcgttcctctctctatttaattatttcttttaatccctcttaactaattcctgttccttcctctaacaggaaatcatcccaatatgcctgatgtgcttttcctactttgctacctgtcaacgttgtccatgatgtccctggttgaacaaaaatccttggatttgatgtaatctcttccaccaactttaaacctaagggctggtgctgctgaagttaaaaaagtcctttcctaccacaaaatcaagaagccacagcttcagtaaactttatagcattccctttcatgtttgggtcttttacccattgttagtctatcttttgtatgtggggttaaattgagattatgtccatctgtttaaccaggtttccaaaaacatctgctaaacaattcattcttttctccagtgaggtggagccaacccttaacctacataaaatgccttctatacatgactctgcctctgagctctcctctgttttattgatctgtttattctgtgacaatacggaacacatcagtctgtttttttcttttctctctaacctgaccacaattccttttatgtatattggcttcattgtcaatactgcaagaaataatttttggaagcaaaaggcaaagcattgagtttctaagttcagggttctctttggcaggagactggaggagtctgtgcgcacccacaccagtaactgtgttccttcctgaatgcattaatcgtggcatactactgttctccttttctgctcattccttcaaatgtgcctttccattcagtactagtctgcaaagcctataatgaaacaaaggaggaaatccttgtgatttaattttgctttcaaaataaattattttaaagtttaatactccagaagcagtttaattaattaattaattaatttcatttttttattttttgacacagggtctcacttcacccaggctggaatgcagtggtgtgatcacagctcactatagtctcgatctcctgggcctcccacatcagccttgtaagtagctgggaccacataatgtttaaattttttgttaatacaggatctcactatgttgcctaggctagtctcaaactcctggcctcaagcgatcttcctgcctctgcttcccaaagtgctgggattataggcatgagccaccgtgcctggcccagagacagtttacttttaaatcaattgcttaaacctgacgttactcttcttagaaagaaaagagggcatttaagaaaaaaaaaattgcataagaattaactattatcttaataattaattaactaatgggttcatgaaagacactaacacattcatgagagccaagcttttccaatgctttccctgtctccttgccatgaccttgaagtctttgcctgcatcttgtgtttaatgccatgccatgtagactgattcattgtaatgctttgtccttgagaagcttttcttcaaataggaatctctaacataattgtggttttttatgtacctgagtagtgttgaattctctgggcaaatgagagctagagaagacagtactgtatgcttgctgccaaagtacatcagtgaatggacgtgttctggacgtgcttattccaccaaggcctctctttattccctttgtgtgtgtgtatgttctggtacacgttatggctgactgatggtgtgcctgtggtactattagacctgctggaagacatcaaggaagaacagcatgctagatattataccatatcttcctacttctcaggctgcctccaaggtaatagttcagagaacagaagcaatttggaattggtagaaatcattttggcattacaaagggcatcataatgttacagactaagaggtttggctagttttcttaataggaaatgaaagaagcaatggaccaaggcatgtgacttcatgagatttcaaatggtctaaagagtaatggctaacttaccacaccataatcacatgcggtggcacagctatttcatataattctgatccagttagctcaagggttaagatcaagctttgtcagaagacagagctaaatttcaatcccaggtgctttattagctgtgtgaccttaagaaggatacttaacctctgaaactcagttatctcatctttaaaatggaaattaaaaacaatataggtaatttcttcaaggttgttgtaaggattaaaaacaaatatggcctggtgaggtggctcatgcctgtaatcccaacactctgggaggccgaggtgggtggatcacttgaggtcaggagttcaagaccagcctggccaacatggtgaaactccatctgtactaaaaatgcaaaattagctgggcatggtggctcacttgtaatcccagttacttggaaagctgaggcaggagaatcgcttgaacctgggaggcagaggttgcagtgaaccaagattgcaccactgcactccagcctgggtgacagagcgagactccatcttaaaaaaaataaataaataaaatactttttaaaaaataataaaacaaaaacaaatatactgaacactgaagtgctggctatcctatgtactgaaagccttgttggaggaattgtgtttttatagacagtgcctttgacttagtctggagaagtagaagaatcctgcttccaccattgacttttaaggatctcaggaaaattattccactttggagttacagtatcatctttaaaatgttgatgaaataaagcaaagtaagcaaaagggaaaattaaagggcagcagagagatgatggctttgttgattcttctctgcagcataactcagaatcagaagaaatggtaagatgggcaatccaggaatagtaagctggctttgtgtgccactaagctctatattttgtattacctatatggaagccataagatgcatccgtaggagaccctctgctgcaactaaagtgagtgatcaatcattaaatttctcaaacgtttcaacaggctgcttggttcatttgcccacttccattgatataaaccatgcctgccctccaggatggttgtatggtagcattgtaatgtacaagctttagttgtatgttacgtagtggacacaacactatgtctccatgtgacagatggcagtgcacataaatggagaatctctgcacttctctttggtagcagaaatatctatagagatcgtacaactaggtagagctctcagttcctataagtaaaataacagataaattattatataaaatagctgtgttggaagaaatactttgaatctcaaactcctaatcacttatattcataaatgttctccattcaacatattactttgataatgtctagactactaaactaaaagttccagaccacatacaaagtacaaagtatccagatgaaagtgatgctttgactgaattaccaaggaaaaatatcagcttttgtcttatgccagtaatcctcactggtcctcaacttttaggatatatttagaaggagaaaaataaaaataaaaaatgttgcctggtccatactagtacagaatgttatttactaatattaagtgggaattcagtttacaccctttaaaaagtattatatctcagatgccaaactcttcagtaagaaggccggaagctcagataactcagccatgtcatagcaagattaacaattttgttttgtcagagaataaacaatcagtttttaccacaaagggacacttcaatgagttatttatggtaagaaaaggaaattatagcaatattaagaccatgtgcagctcctattcaaaattaagaaactcactattgcattgtttatctcagcctcaacattcttatgagaagtaattaacagtcgttagaggtgtggttattatgcctggttagggaagcagtggggctctatttgctcaaacctctcaggaaaaggctacaattactgtgtggatacaggaatatcacagttatgagtggtattgttcatagggcatttcacaagacaaagcaataataaaatacttagttcttaggatatcaaaggttattttgtgaaaatgatttgacataccacaatcctaaaacttgacaaactactctcaaaatgttttaagaattatgtgaacccagaaacaaatgtgaaaactgttttcacacaggaaagcctccactgaggattatgaatcttatgaaagacaaatgccctattttgagtacatggtgatatagttggtcaccttcaggtatgcttatttatgttttgcaggattgcagtaatggttaaatagtagaccaaattagcatgtctgggtctcctcaagtcttatgtttccttcagtggtcccatatgagttactaaaatttccagttttatgtagaatgcagcataggttgaccataaacacaactttgtatcattgtccaaagttgtaaaacagagattgtcactgcagggtcatgcaacagaaagggaggaaatgctgttttgtaccatatcaaaaatgataagctacattttccgaaggactaaaatatccctcttattgagaacagaaagaagggcaagaatgacttgtttaaaacctgcaagttgataaggagcgatgtcccagcctttacaacatcatggatgtaaaccttgagaaaggaacaggaagcttgtttacaaatgaacaaattcctgcttttgtaagagaaaattcaagctgtggcacattttttaaattaatagatgtttttaataaattggtacctaggagggattcatcatgttcactgtgcttgacaagtacaaaattaagcgagttaaatcagctccaaagaaaaaaaggctgtgtaggcaacccatcaaatgactgaaagctggggtagtcccttcagtgggcgaactgcttatgctacctgaatagactttgctcagaaaagacttctattgaaagaaccacaggtgtgaagttaatatgcgtttgtaacagttttcaatcaaatgcctcatcaaatagggtagtttaacacttgacgcataaatttgcatcagaatcatagcatcaactaactgggagaaaatggcagttaactgtgaagctgtcctgtgtaataggtgctctgcaatgcaataggctcacaaaaatcctgcccccgttcctagtgggatgcaggattacatggcaattaacaatgtgaattctggagatgaattccacgcaagttccaactcacatcccaccttttatttgggaaagttatttaaattttcgatgcctgaatttccttacctggaaagtgctgataatagaaaccaactccacacaaattgtttggattaaactatttaatacatgcaaagctataaaccacttagaatggcacctggcatatagtaagccctcaaaatattttttttcttacccatgattgtcaaggattacctggatcctagcagaagggaaattaagggctagattgtgcaagaaaagtactactggggcctataattcaaaccctggaaaagaggtaggacatagaaggacatgagataaagaacgtggtttatttaggggaggggatggtaaattctaagggactgaaaaaggcagaattaagcatgatcttttattaaacagcctgactggagtggcaaaatcaggttgtgagatgtgtccggttgatggagggcttgaatgttatggttgaggagatcaggctctgacaggaagccactatagtctctccaggtaatgttctaaaaatagtactaattcctagaaaacaagatagaatgtaggggaagagcctagaagcagatatttcagttaaaaggcattgaggcttatctaagaatgcacagggtgaggttctggaccagggtgataagcatgactggaggaggaaagcaactgccaaagaaaaaataggaagccttgaaataattagatacggggatcaaaagagagaggaggcaaagatgtctctaggatcttgaggttgcctctactggctaacattttacttaaatgagataaggcagtagttgttagacagtagaaaatgaagggactttaggagctggcctcaccctttgtatttgaaggtttccaaaccatcatttgtgaaagcgagagtgagaaagaaggggtcaagactcctgagtattacaagggcatttcctgggtagcagagctccacctagtacagctgtttgtgattagaaccacctgaaggattaacagctcaaaaggactgacactaaagcagaacaagagctgcaaataagccttctggggtcagaatataaaacgttgaagtcgtttaacagctctttcattagtgtggattttgttgcctattttaccttaatgattggattgagtatcatgttatataatatttcacaagcagtaattcaatgttcaagtactttgaagtatttagaagtactgcctattctcctcaatactggaaagatcctcatagattaggaaaagcccgaactaagcaacctaaattctcttcccactaacctgcttaactgttctaggttccaatttatttaaagaagtgagagttggatgttttaccaatgtgggattttcagcaccttgtcttccttggctgaggggagcctctgaagggatacttgttattggtcctgcaaatgaactgctccagctaggtacaggctaaaaaaatgatttactctcctatgttctccctctgattcccatggcacagtaggaattgctctaggtcccttgttcctgatgagccctaaatgccttttgtcccacatgttgctgacattctcagtttgttctcttccacactccgtttctccattctctgacccaccctactaaccgcattccccaggctcccttgccaatgggaaacatcagctggagacgagaaggtgggagttgaagaggggctggagtattcacgcctggcacacctgtcctgctatggcatagtgtggcaatagccgcatccctctacatccacagcccttgctggcggcccctttcatggctctagctctcagtagactgtggtaacattggttctgtccttcgtgtcttcatgcatggaggtgataagggctccctctggggctagttcttggtgcttcaccatcccttgttgattcccagacccctgttcacaccaatgtaaatagtccctttattaaattctcttccaaaaccccagctaatggtcttctctttcctaccaaaacccattctttgaggagtgtacagtgatgaaggcaagctggtataatcagatgtcccacatgaacatataacatcatggagctttattttacatgggtacattttttttcctaagggtttaggtatgtaactttatgcctgaaacttttattaagaaggaatatttttaaatggtatgagacatcataaaacaacttagtttttgaagggaagctataagtcaaattcatttttattttaagaatttgcaaattatagacttgaataagcgtatcaaacattcctaaacaggctaaacactgttacaactatatagaaaaagggatttattatagggctaagaccttacacagttttaccaatggaagggactatgcaaggctgctgtctctgcattaggtgttgagccagaagttgttctaagtcagccagaccaagtgggaagaaaagtaaagatgaacttaaaactcctgagaatgagctggaactgtgaggatgaactggaatccacatcagtctcagactgtctctacctttgatgctgcaggtcacttgcagaagaagttggcaccttttgccatagaatagcccatgcttttggcctaggattaggtgaagctgaaggaattctggtaccagaagtgtgggcccaagtgctgccttatgtagacaacgtgagcagcttgtcaccacagtgtgtacaggatgcctggcatcctacattgactttctttttctttttcttttttgagacagagtctcactctgttgcccaggctggagtgcaatggcacaatcttggctcactgcaacctccacctcccgggttcaagcgattctcctgcctcagcctcccgagtaaatgggattacaggcacccgccatcatgcccggctaatttttgtatttttgtagagatggggtttcaccatgttggccaggctggtctggaacacctgacctcggatgatccactcacctcggcctcccaaagtgctggattacaggcatgagccaccgcgtctggcctcctacattgactttcacagtataaaacaatagggctgcaaccccccttctaatttataaaccttctacatatttctcctatggtcactgctaactcagaagcataaagatatgggaattctggaaaacatttttctaggacagcaaatttgttcattcttcttttagctgagtcgtactccccattgatatcctgtaacttatactgagatataaaagtaatgactattatatcagaagtaggggaatgggagaagggaagaaacatttactacatatatagatacactcataccaaaattaggtagaaaaatactcataactattattgtccttgtttctgcagccattatgtggtttggttttttgactatatctattttatattctcttttccctcgacaatgtttaatcttgtcctagatctttgcttattggggtgacccaatcccttcacattcctgaaggatctgagccacttgctgccctacctaaattgggttttggaatttcctatgaatattaatctcaggatatatctattactttccttgcggtgctatacaaattaccacaaactgggtggcttaacacaacagaaacttattctctcaccgtttaggaggatatatgtttgaaataaaaatgtcaatagggttggttctttcttgggggctcagagggaaaaaaaatctgttctccctctctcctggtgtctagcggatgccgataatcctcggcattccttggcttgtggtagcataaatccactctgcctctgctgtcacatggacatcttccatcttccttctgtgtctcttcgtctcctcttttcttttttcttattttcttattttgagacagagtctcactctgtcacccaggctggagtgcagtggaacaatctcagctcactgcaacctccatctcctgagttcaagcgattctcatgcctcagcctctcaagtagctgggaccataggtgtacgccaccatatctggctgatttttgtatttataatatagatggggtttcatcatgttggccaggctggtctcaaactcctggcctcaagtgatccacctgcctcagcctcccaatgtgctgggattacaagcttgagccaccgcgcctggcctcttctcttcttataaagatatcagtcatattggattaggtcccaccctaattgcatatgacctcatcttgattatatcagcaaagaccctatttccatataaggttatattcacaggtaccaggggttaggacttcaacatatctctttggaaaaaaatagttcaatccataacaatatggaatacaaaaatatgctacaggaaatctgcatttctgacatactcttccttctctccattctgtagttgtgaatgacctaattccactggatagacaggatcaatcatcctagtcagtagaataaccccctcttttgcctgatgattaacttgcatgaggaatacaaagtcaccaagctgtagtcgcaacttctaatttaatggaacattttctgtgttcttggtagaaacatccctcccttgggaattaagaaccctagattagcacagtataaagttatgaagtcaggaagcaaatttttgccagtgaatcaccaaagataagatgagccattcctatttccaacccttgattccccaagttctggctaagggagaaatagcacaatctggcttagactatatactgcatcctggaggatattcctccagccctacaaggtgctgccatgcagctattgtcataaccgagtcttcagtggccattcaatcattctttcaggccacttgcttcagggtgatgggaaacatgataagaccaatgaattccaagaccatgagcacattagcatatgttatgtgctataaaacaaatttcttggtcagaagcaatgctgtgctgaataccatgaaggtgagtaaggcatttcgtaagtctacagatggcagttttgataaaagcactgtaggcagggaaggcaaatccctatccagggtgagtatctattccactgggaacaaagagctgccacttctataatggaagtggtccagcataatcaatctgccaccaggtggctagctggttttctccatcttcacacctggcctgggaatggtgccatatcaggggttcactgttggactttgctgttgggagattgagcattcaacagcagctatagctggatcagccttggtagaagaaaatccatattgtgagcccatacagaaacttcattcctatcatggttcagcactcactaggcaaggcaaagaatggctgttggaaaaggctgactgacacccacagaacaggtcagcttgtccacctgattattacaatactctttttctgagcttgcttttcagggagcattgacatgagacagaaatatcttcacactctgtgtgaacgccatttagtcacatactagattcccagacctctttggtcagaaattttctgatcatgtttcttttcagtccctgactatgcacctaaaccattagctattgctcatgatgaatgtggacctctagccatccctttttctggatgaaatgggcaaacagacgtactgctcaaagttctgcccactgggaggaagattttctttaaatactatccttcagagccaccctgggatagggctgtagtgctgcagtcatctacttttgggtgttggtggcaaatcatgccgaattttctaattttttttcgtctttggtcaactagccacagacaatcctcatgaagctttagatgcaggttaagaggaacgaggctatgctgcagccatagacatctgggctacttgttcatgcaacttccttgtgtcttcagcaccaccggtgactaaggagtcttgtcttgagctagggaatggggacatctggggaatgtcaggagtttttaaggctgagtttctaaggttaccaattctagctacttgcctcctagaaggggcaaggaatgtgttagccactgccctaccctactcctaaagccctgctattatgtagaactgccccccccccaccccccgcccaccaccaacaccaacacaccaacaacataactctgccactttgcgctcctccccatccatgcttcagtcattgggagtagacgtctactggagcaactagcggaagaacttctcagccaccctttgtcagagtaaaggtattgtcggtgaggcgttccagtggtctcattgtgtaactgtatagattctgacatgctctgctccctttctccctcctaagggaagttggggccatatcatggtgaaatctcttagtgttagtttgtccttcagatgtagtaacaccgtcatttgccctttccagcatatgtcatttggaatcatgatttcttctatctgctgcaaattctgtctcagttttacatgcatcaggcctgtaggagacccttgggtctggccagtggctggagctgttggctgaatggacagtgaatgaccactgaatggaaagtcagtgctgtttttctttggcatcttagaagcttatactgagtttggtaggactcactgccaaagtattgcctggtctggagaaggtagagacaagggagagttgggatttctactatttcctactagcatcatttgtctgccataagatgccaaaatgcagggccccagatttgcaaggtatggaattagagcacaaggctattgaggcaggtctgcatgtgagatggccccaccattgggtcactatcaggacctgctctaaagagtctatggattgtaggagagtcactatcatacagttcatggaccctgaaaccttcctgcccaatctccattctccttagatctgctaagttagtctccatctgtattgcacagttttctgtgaaaaacctttaaaagggactggtacttccagccgacaacataaacatgatggttatatttgggtgtgatccttaatttaaaaaaattttaagcttgttagcatcctccaaattgtctgcaattaaaacatactacttttgtaagttctccaggaagatagagtttaagtaacaatcagcttcttggcatcaaacactggtggcccatttttcatgaggagactaggaaatggtactccatattcattgcttccacccactctaagttctgatttctcccctaagcccttgattggtgtatagcaaacctagtttgttttatcataggatggttgtttccatattaaattctagtttctgttatcctgtatgttttagaaccaaggtgactttaaaagcagagcaagctaagcctaagtaatacaatcctaggaaaaatagggatggcttacttcctaattccattcactttgattaaacatcttgaccatatctctacctccagcattattagcagaaaaaaaaaagacttgagacgtaatgagagggactaactaaaaatcttatagactgaagttgtcacaacagttttttttaaagagaactagcttaaaggtatatttcttctatttttaaagcttatggaaaaattcttgttgcatatgtgttatggcaaaacaaaatgcaggcatggaaaaacaactgactttaaaaatagcaaaatacttgacagcccagcttgaagtcattaaaagtagtacagccggggtcagtttataggtttctgtttttaatatgcataaatagtctagcacttggatggaacagacatgcagctgcctcatcagactgattaacttttcaatggcctcccagatacccaaaagttgctggcactgtcagggcagtgctaggagtcatgataagcctgaaaagtgagatgtcttctaccttcctatatgaaggaaaacccagaacttccgataatgtcttttttctacttagagctgaaagtcttttgagttctgctaatgaaaaagaaacgcccactcccacctcaagaacatcattagtatgataacacttccactgcccagactgacggggccagagggccacactgctaacccctgaaattaaaaaaaaaaaaacaaggtaggccccctatcttaaatcacatagaatggtagcagtgtttcatgtcctttctaggtgatggagtcacggtctcataatacagcaccaaccattaattccataaacatacagcatgtcatgaagtccagggtctgatgttgtggacaagtgcaagatttctagagaaaatatacattgtcttgcttatgaaataagattatgcatttaaaatttcaaaaatattcgatctcaaagaataaaagagttaagagaaagcctatgattaaaagccaagtgactgatagggaatttcaggagaaaaaaaaacagaataaatcagagtagtcagggatggcataatagaattgggacttaacacaaaacacttatttaacactttctatgaaatatgccttctgagaactcactggtgaaatcaaacccagatcctggcctcttgatacttgtatgctttttgggtgtacagttgctcaatggacatataaagtacagagtgatgagtgtcacagtaacagacacaggacttacctaacccaccacagccgtacccacaagcaccactgggagccagaggacagacctgctttacctgtaacctccaccaatggtgcccacacacattgtccagtggcctcaggactgacctatcctacttgcacccatgcaccctttgcaccactggcacgcatgcactccgtctggaggcctggggattgatccaccctggccacagcagccagcacccatgcacaactttagggggggcctgatgacaggcatgccctgctcgctgccactacttccagtgcctgcacacattgtcttggggcttggggattgatccatactgcctgctcccactgttgcccacactcaccatccaggggcctaaggacatttcttctgcacccaccaccaccattgccagtgtccaaacatgttatcgagaggcctggggatcaacctgtccccacttaccagcaccaatgtgcagtgtccaggggcctgggtataggcctgccctgcccactgctaccaacacagacatgaacaatctaggggcataagaaagaaccaccacctgccactgatgcccacacatgtctcccagcatccctggactcggctactcagcctgccactgctgctgccagcacctaccttcctaaaccacttgggggcctggagattggcccatgtagtccactgttaccactgctggtgcccatgtgcacagttcatgggcccaaaggttggcctgccactgctattgacaccactgataccacatatgccacccagggggctgaagacctacctgtctggatagcccatctgacatccccattctcagcaaagcctcaccacagcctccactaacaaccaccggataagccattgaggaactctcagataccacactgatgctgattacagctgaagaaatcatgtggagaatacactactgcatctattcagaatcaaatccaaagcaccctacccaagtaacactgtagatacatctacaggaaaaagtcattccctacaaaagccaatccataaaatcaaaagaagtgactgttataccaaagttgcagatattaatgtaaagacacaagagacattaaaaagcaaggaaacatggcaccttcaaaggaacacaattattctccagtaacagataacagcaaaaagaaaatctatgacatacctggaaaagaattcaaatcataatattaaagaaattaaatgagataaaagaaaacacagataaacgacacaacaaaatcagaaaagtaattcatgatttgaatgagaaattcaacaaaaagatagatattaaagagaataaaaaagaatttctgaaactgaagaattcaatgaataacataaaaaatacagttgagaactccaacaatagactagctcaggcagaagaaatttctgaacttgaaggcaggtcttttgaaatagcatagtcagccaaagaaaaaaaaaaaaaggaaaagaaagaaaaagaatgaagaaagcttttggcataccataaagcatttaaatatttgaattttggtggttctagaaggagaagagatgggcaaaggcatagaaaatctatttgatgaaacaattcctgaaaacatcccaagtcttgcaagagatatagacattcagatactggaagctcaaaaatctccaaatgggttaaatcccaaaaggtcttccccaaggcaaattatagtcaaatagtcaaaagtcaaagacaaaaagagaactttaaaaaattaataaaaaaacatcaagtcaaagatatgggtatctgcatcagagtgactgtggattgctcagtagaagccttataggctagaggagaatgagataatataatcagagtgctaaaagaaaaattactgtcaagcaaaaatactattcccaacaaagccatctttcaaaactaaggtgaaatattatttcccaggcaagcaaagactgagggaattcattgccactagaccagacttacaagaaatgcttaagggagtcctacatctggaggtgaacgaatgacatctaccatcatagaaacacaccaaagtataaaaatcactggtagtgcagatacacaaatgagaaagagaaaagagtcaaatactctcataacaaaaaactaccaaatcataaaggaaaacaataaaataagaagaagagaatggaggatatacaaaacaatcagaaaacaattaacaaaatgacaggagtaagtcctcacctatccatagcaaccttgaatgtaaacagtttaagtttcctagttaaaagagacagactggctgatttttttttttaaaccaactatatgctgcctacaggaaattcacttcatctgtaaagatacacatagactgaaagtgaaggaatggaaaaaagtataccacacaaacaaaatgcatgcaggagtagctatatttatatcagacaaactagactttaagttaaaaaacaaaaagtgacaaaatgatcattatataatgacaaagagatcaattcagcaagaggatatacaattgtaaatctatatgctaataaatattattatagctaaagaaagacagaccccaatagaataaaagctggggacttcaacacccccctttcagcagtggacagatcatctagacaggaaatctacaaagacacatcagacttactctgcactacagacctaacagacatttacataacatttcatccaacagctgcggaatacacattcttctcatcagcacgtggaacattctccagtatagaccatatgttaggacaaaaaacaagtcctaacaaatttttaaaaatcaaaatcatatcaaatatctttttagactataatggattagaactagaaaataataacaagaagaactttggaaactgtacaaatacatggaaattgagtaacatgcttctgaacatctattgggttaataagaaaattaagaagaaacttaaaaaaatttttaaagaaatgaaaatggaaatacagcatacaaaaacctacagaatacagcaaaaacagccttggagagaagtttatagcaataaatgcctatatcaataaagtagaaagatttaaaataaacaacctaatgctataccccgagaactagaaaagcaacaacaagccaaattctaaattactagaaggaaataagaaagatcagagcagaactaaatgaaacagagactaaaaaatcattacagagaatctataaaatgaaaagttgttttttaaaaaaatgaacaaaatcaataaaccactagctaaactaaccaagaagaaagaagataaaaaaagtaatcagaaatgataaagaagacattataattgataccacagaaatacaaatgatcattagagactgttatgaacaactattctctacaaagtgtaaaaccaggacatagataaatttctggacatatgcaacctaccaagattgaaccagaagaagtagaaaacataaataaatcaataatgagtaacaagattaaattagcaataaaaaatctcccaacaaagaaaagcccagaatgagatgaattcactgaagaattctatcaaacttataaaaaagaactaacatgaattctcctcaaactacttcaaaaaattgaagaggaaaaattattttaactcattgtatgaggctagcattatcctaataccaaaactatacaaagacacaacaataaaaagaaaattgcaggccaatattcctgatgaacatagatgcaaaaatccttaacaaattttagcaaactgaatccagcaacgtatcaaaaagatattatacaatgattaagagggatttattacagggatgcaaggatggttcaacatacgcaaatctataaatgtgatacattacatcaacagaatgaaggacaaaaaccgtatgatcacatcaacacatgcagaaaaatcacttgataaaattcaacatcctttcattataaaaactgtcaacaaattaggcatagatggaatataaatcagtataataagggccgtatatgacaaacctacagctaagcatcatactcaatgggaaaaagctgaaaatctttcctctaagaactagtataagacaaggatgactatttttaccactcatattcaacatgatactggaagtcctagccacagcaatcaggtaagataaagaaataaaaggcatccacattgcaaaagaggaaggaatgaaaactataaaacattgataaaagaaatggaggaggacacaaacaaatggaaagacatcccatactcatagattggagtattaatactgttaaaatgatcatattacctaaaggaatttacaaattcaacgcaatccctaccaaaatactaacaacctttttcacagaaatagaaaaaataatcctaaaattagtatggagccaaaaaggatcataaatagccaaagcaatactgagcaaaaagaacaaagctggaggcatcacagtacctgaattcaaaatatgctacctagctaaagtaaccaaaacatcacagtattgatatgaaaatagatacacacatcaataaagcagagtagagaaccaagaaataagtccatgtatttgcactccactgatttcaacaaagacaccaagaacataaaatggataaaggacagcttctttaataaatggcactgggaaaactggataattatatacagaagaatgaaactagagctcgatctttcactatacacaaaaaatcaaatgaacgtgggttaaagacttaaatctaagacctgaaactatgaaactttaagaagaaaatatttgagaaattctccagaacagtgttctggttaaagattttttgtgttaagaccccaaaaacacaagcaaccaaagcaaaaatagacacatggggctatattaaactaaaggtcttcttcacagcaaagtaaacaacagagtgaaataaagctaaagcagactaaaatttggtttccattttgaaggctgggcaaagtaaaaaaagtatttcgtaggctgggacagactatcaggctcagtgggcagtgcatgtaacatagaacaaagaagcctggggaccatggttctaaaatgcctgcaaattaaaacatggcgatggccataacatcagtgctgtgagagaagtgtttaccagtatctcactgccacacagagtagtcattgtcaaaagaatattgtctaatatgaaggcaaaagatatacccgcgttgcattttttaacaattttaaatattattattattattattattattattattgagacatagtcttgctctgttacccaggctggagtgcagtggcatgatctcagctcaaggcagccaccacccactgggctccagtgattctcctgtcatagtctcccaagtagctgggattataggcgcacaccaccacgtctgactaatttttgtaattttagtagagaaggggttttgccatgttggccaggctggtctcgaactcctggcctcaagtgatccacctgcctcagcctcccaaagtgctgggattacaggcgtgagccaccgcacctggcccctgcattgcattttttaatactcctgggagatacggtcaacccagcttcttagaaaaacatacaataaaaacacatattttgatagtaaaaggactgagaaagttaaaaaaaaaaaaagaatgaatcattgatttttgagtcattgactttttgttactataatcatttttaagtgtataagtcagtggcattaagtatattcagtgttgtacaaccattaccactatccatttccagaagaatcattgatttttaaagagtaaaattaggacacaggagctcaagtctgatatctctttttggatggattgatgcagcagagaacttttgatagactatgcatggggagagagcctaatgctggggctttgtttttcctaagactcaattgctccagctggtgcagaataactcctcacctgctgcacatgctgatttttgtattgaatgggaaggctaggacaccagatactcaccacatccagccattctccagtgctgctggtggacacagtatcacttgatttaataggctgttgtcaatggaggacagcctgcaacaggtcaatgccaaaggaactactgtgcattgcagaggttctagcattttcagagctacaactgtcttggttttggtttaatcctccaaaactacccttttgctgcatgaccccacccccaaatttgtaaaattttgtagctagaagggaccctagaaattatctattcaaactctatgtccagttacagaatcaagaagcctgttcaaggcgatgcagcagaggaagctgggtctgccacagtccaggtcttccaaggtcctatccttcccacagctgctgcacacattctaaaattaaagtgagtaaagtcttaaaacatttttcttttgctttattttgagtaaccagatgcttctgggagtaacaaaagcaggggtagaagtctctaatctggtggggtttctttttttttctttcccctttaatttaccacatgttgaccctgacattttaataaggacacaggacacagtgacttaacaatacaaaacagtctaacccagatgttgatggcagactcatttctgaaagcacaagcctgagagcttttttcaaaagtggggaaaatgttgggatcctagaatagcagtcatagcccccagctaaaatgtccttgtcaaacttgcaaccaaggccattgctgacacacagaaattatttatatttaatcatttttgcccattctcattgtcatcccttcttttctcttccttttatggctcaccttgctacatttccattatttcccaccctctaggttgcctgcatcgtcttgcttgtccttgggttttcatatctccccattagaataatctggcttggtctgtgtttctgaaaaaagcatctcatcccatatggctatttccttacatttctttctactatcaaaatatctttatacctttctccctccaaagtgtcctttattgacttactaagacaataattttataatataatcaaaatgtttgttagcagagctatattataactttaggagtccatagacacccttgggggccccttcctcggcacaaaaatattaaaaattacattttacaattgcattgggatgaaaataaatataagccaaatctgactcattaatatactttcattattatttttccctccaattttaagataaattaaaatgaaaattatttgcatgggcttgtatgcccctggcactgtgccccatgggcaggctttaggccatccaggtgccgactcttaggaaactttcattctacaaatacagacataaagatagatcatgtaatagcctttgctttttaccttcgtggtagctgtagccctctgtgtctacctaattgttagaggtcatttccataatgaatggtagctgaaaatgccagatgcaattgaccctctgtatccatggattctgtatctgtgggttccacatttaaggattctaccaactctaataaaaaatattcagaaaaaagtcatctgggccaggtgcagtggctcacgcctgcagtcccagcactttgggaggccaaggcaggtggatcatgaggtcaggagttcaagaccagcctggccaacatggtgaaaccccgtctctactaaagacacaaaaaattagccaggcgtggtggtgtgtgcctgtaatcccagctactcaggaggctgaggcaggagaattgcttgaatctgggaggtggaggttgcagtaatccgagatcgccccattgcactccagcctgagcaacagggtgagactgtctcgaaaaaaaaaaaaaagtcatctgtattgaagatgcacagacttttttcttgtcatcacttcctaaacaataaaggataacaactattcacatagcatttacattgtattaggtattataagtaatccagagatgacttaaagtgtacaggaagatttgcataggttatatgcaaatactgtatcatttactatctgggacttgagcatctgtgggtttgaggatccacagaaagtcctggaaccaatcccccacagatacagagggacaactgtacaagctttctcagcccctcttgtatctaaggtttggatacacaatcaaattctggctgttgaaatttcagtgaaagtatgatgatggcttcttggaaagttttcttcttgcttaaatgtacaagttcccacgctttctattcactttgggacacgcataagcttctgcagctgtcttgacatcatgagagaccacacagataacaatttgaagatggtagagcaaaaagacctaattctaggttcttctttttctttttaaattattattattattattattattattattattatttgacacagggtcctattctgtcacccaggctggagtgcagtagtgtgatcacagctcactgcagccttgacctcccaggcttaagtgatcctcctacctcagcctccagagtagctgggactacaggtgcacaccaccatgcctggataattgtttttctatttttgtagagacagggtatcactttgttctccaggctgatctcaaactcccaaagtgctgggattataggcatgagccactgctcctgacctaattccaagttcttgatgacattgttgaactacttaaccggctgtgaaactacctacttctgaacactttcattaagtgaaataataaattcaaatttatgcaactttgagctgggtattctattacttgaaatttgttacagataacaagaaaacaaaggtatacaccagaaaatttcagataaaatctcacaaaaataacaagtcaataactcttctaaattttagcaataaacatttaaaaataatatttccaataatacaaatcataacgaaatccaagaataaatttaaggtatatgaagcatatgcaaactgcaactttactgagaaccataaaaatacttgaataaatggagagataacatgtgcttttaagacattattctaggccaggcttgttggctcatgcctgtaatctcagtgctttaggaggccaggatgggagaattgcttgaggccaggagtttgagaccaacctgggcaacatagtgagaccctgtctctgcaaataaacaaaaaaattagccaggtgtggtggtgctacctgtaatcccagatacttcaaaggctaaggtgagagaattgcttgagcccaggagttaaggctacagtgagccatgattgtaccactgtactccagcctggatgacagagctagaccctgtctctaaaaataaaatgaagaaattattctgtattgtaagatgacaattctcactaaattgttttataagccactgtttaaaaatgaaacagtgaaattccaaataaattgtctacggtactttttgtaaaatatttattgaagtataatatacatacaaaaagtacatatatcttaagtgtgcagctcttaagtttatctgaaataaaaatggagagaaatataccataaaatttcaatagaaaggaattttacaatgttttaactagcactgtactatagaaatcagcaaaaaagaataataaccctaaaatcaagctccagagtgcataaataagtatatgtgataaatgcagcattccaaattggtgagttaatggatttttaaatcaagctccagagtgcatatataagtatacgtgataaatgcagcatttcaaattggtgagttaacgaatttttgaaatggtgttagaatgactgatataagtatcccactgaacatatgaattttaaaaataaatgtaaataaatgaaaccagaaaagaactagaataacatatagtttaaaactcaggatgaataggtatgacatgaaaaatagaaatcacaatggaaaagatcaataaatttatctacatacatttaatacttctttatgacaaatatcataaaggtaaaaggcaaatgataaactaggagaaagtgtttgctatcttgatgatgtttgagctggtgtctttgataggaatagggtatattctattgcttgcatgtgtagattctagagtcagatggtttaaatatgaattcccacttccagctgtcttaggttgggtttcctaggagcattggctgagagaaagattcttatacaagtgatttattgagaaattcctctctagtaaaacctagagaagtgagggaagcaggacaggacaggacaggagaataagctagcaaaggtaaaggttcagctacctacaaaaaaaaaaaaaaaaccaccaccaccaccatcacaacaataacaaaacacttcaagtcctatagaagttaaaggtgaggaaaaagtaaaaccgaactttagacaagttaaatttaagggccaggcgcagtggcttatgcctgtaatgccagcactctgtgaggcaaagcagtaggattgtttgagcccaggagttataagccagcctgggcaatgtggcaaaacctcatctatacaaaaacacaaaaattagtcagtcgtggtagcgcatgcctacagtaccagctactctggaggctgaggtgggaggattgcttgaacccaggagtttgaggctgcagtgagccataatcccaccactgcactccagcctgagcaacagagagagaccctgtctcaaaaaaataaataaacaaataaaaaaatttagccaggtttatttgagcaaaaaagtacttcatgaattgggtagcactcagaatcagaactgcaagagagcttcacccagcaactgtggacaggtagtatttatagacagagaaagatagtgatgatatacagaaacagcttgattgattacagccagctgtgtgtttgccttatttgagcatggtgtgataaggccttatatgtacatggtttgatcagttgccagcctataattggctgaagctcagctctggtgactggctgagacacagctatttgttacaagaatatactcttaagttaggttacagtttgtaagttagattgcagtttgccatttagggactctcaagatataaaggcaactttaagccaaatttaatttattttcacaagctgaagtctagccttagcccatcgtaatgaaagattagaggcaaacatggtaccactttaagggtgtcaaagcaaatgaaatatggcctgagaaggactccatacttctatatttgagtccttgtggatgaactgtaacctagcttaatagtcagacaagatcgaaaaccgaacttagaagtatgcgcctgtaacaataactgagtcttggcttatcccagcagccatacttcaaccactcatagaccgctaattgttctgtgttcaaacaaggcaaacaccaacctgtaatcaatccagctgtttctgtacctcactgctgatttctgtacatcatttccctttttttcctgtaaatcttcttccactacgtggttgtgttggagtctctgtgaatctgctgtgattctgggggctgctggtttcatgaatcgttcattgctcaattaaactcctttaaatttaattcagctgaagtttttcttttatcatggtggcatcagaagtgggatctaaagtagggcttctagcgacccccaggagcactgagtgaacatgcaaggtacctgcaggacccacttatgtccactgatctctcagagagactggggatcatgggtaaggttcctctcatattttggagctccatggatttgttttttgagctctcggagtttctttgagcaaatttctgatccaaactgggtttggaagtcatgacagaaacaggactgggtccaggaacagatctgatcttttgtgttgtggcttggcccccagggctatggtatggtgagctgggtcactagggctgctcagggtaagggaatccagaagcctggcataccagcaaaagggtaaaaatttcttaccattcagatttctggcttccctctctctgtgcaaaccagttgaatgaatggtaaaaactactgtttattctcctctgtaaagttttgattaatgcaaaaaagaattctgaagctagccttaagctgtagcgaatcttgtgtattttgtgctatgaattcatttttctgtgttgaggggtacctcaggataaaacatgggcttaggaccccataagctcactgttcaagatggtccagcaagctggtcagtaacaaactttgcagtaggtccctgaaacaaacaaaaaactggatggggccttcatcttgttttatgtccttgggagcttgaccttgtaaccacatggcagtactttctcttggtctctgttttccagggaataggaattttagggttcatgtcatagttagctctaaaaattatcttgagtagttaaaagcctttgcaagctcaaaattgactactccagacttcttctgggaggggatatggagactgccctgtgctatagcccagtagctaaggttttgccctttcgcagtgcctgtctgggtttgattcctggcttaagaaatgagtcatttctgatttgatatttgcatgaacttgttgattctattctcttctatggactgtcttaaatttttctttctcgaagcacctgggaggttacgtttgctaaagttcaaaagccagaaatattgtccatttagcttggctaaagtcaagtattaagaaattttaaaaggactttattaaagagtgctatggttaaaagccagcgtaattaaaagtggtattcaagctctaatggcctggacttcttgggaaaaacaggagacactagagaccctttcctggccctgttcttccaaggactccaccataaagccaataaccaattaagaaacttaaaaattggcaaatgaaaaatcttacaactactgtactaatcttctgtctgtgtagttatatatgtgtcgtgtgtgtaatgtttatataaagagctctaattaattggcttaaacaaaaataagtgcttaaatcaaatattttgaaagaaaaataaaaactgtaatgccttttagtttacataactgtactaatctttaggaaataagaacagctttaaaaattattggcaaaatttaaacatttggtctaaattatgcaggtcagatattaagtttactaaatgctttcaggtcataatcagcttctttgacttttgaaagttgttcaatttacttaccttggatatgttagattctagatgaggcctgaggacatgtggaattagccatgcaccctagctatgcaaagaaggttgtaaagaagagagattttatataagaaagtatattgtatggtaaattcttgtccgaaagtaaaatgactggttgtttaaaaagagggatatttaggatgagtcagaaagtccaagcatgtcatagattgtctgcataagttgtgaaataatttatgaaacgcatttatccaagaaacgtacaacttaaaggtgattagggctcctaaatgcttcataaaatgccactatgactcttaactgtacagcatgcctgcttaacagctatgtaaagcctgtgacacgtggagttagatgctggaaagagtcagaccttacctgaatttttgtctgggtcctaggttccacactggtacgtaattagaatcacttactaaccaggcttttcagcagaggtaaaaatcactaagggttaacagtataacatgtatatgagactactgaacaaaacagtttacatgcaaggtgtgtaaggaaagtagaatatacttttggtaaaagattattagaagtcatgggaatttgaactttttgcctagattaaacagttaaaggattgttttaaattaaataaagctaaaggtttaaacaagttgtggaaggtttataaaaattaaccttgccggtggctcacgcctgtaatcccagcactttgggaggccgaggcaggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggtgtgaacccgggaggtggagcttgcagtgagccgagatcccaccactgcactccagcctgggcgacagagtgagactccgtctcaaaaaaaaaaaaaaaaaaaaattaaccttgcaaaaaattctatgagtgaaaatactgactaaatttaaaggggtattatttggtttttccataaattgaacatcaaaataaaagcacaacaggtttttcttagagcactaatctgccctttaacaaaaattgtaaaggattataaaaggtttataaagttcttattttatgatcaaactaattaagattgaatacatttgtctgtaaggttttattaagaattgggtttgacatcaataatgcactaatgcaacagtgacatttggcttatttggtataaaaatcatgggaagcattaaaataatgttgaatcttcaggttatattttagtgatgatattaatatattttccaaaattatatatatatatatatatagggatttctaaaaccctaatatgtctgagtatatgatatcaatcataattaaggttataatgttaagttattgtagaccagagagataacgaaatttccttgtcaattgtgtttttaactatcactatttaaactcatttctacaattaattgcttaatgctcttgcagtttctaaaaactccataagcacacaaaaatcccagaatatgatgtcttttaagaggtcatgaaaggatagaaagaaccctgaaaagcactcttgaataaagttttctaacaactttaaaattatatcatgggtaagaattccccatgaattccccaagaattggtctggataagaactcctgaaaccttaataaaaagactgactgatttataaaacttccaacttaagtataagaaaaattaattaaataccaagaaaatactttgcccaattatcatgtgaaatcagccaatactagatatacaatttgaatgaactccacagtgtaagtcaaattacctatgataacccattagttatcagtgctatgctcctaaattggttaaacaactggtattcattcaatgttaagtatggactcatgaagaatcaggatggctgccttgtccttcctgagtccttaaagcttttgttattaaaggttctgcattccatgacttgtcatggaaaagataaaatgatccaaattgaatatattgatgtggtgatttataaatcgcagaaatagttgaaagccaatgtttggttccatattcctgggaagacaataaaaatttcaggtacatttggctacctgataggccatttaaacatttataaaggaattttattcaattgtcattttcagtgcatgttttctggttatataaaagctttcccatgtaagagggctaatgttataacagtagattattatgccacagtatattttcactaggtaaagaaagctctttatggttcactgaggacaaccccttcacagtctagaacccaaagattggacatcagatgcccaaagatttggacacccaaagagaacatcagaaaaagaccatccttgccattcacactacagcaaaactttgggaccttacactttgggttcataatctcacaactgagaagggtccctccacactcttggaactgtacacctattgtaacccttaaggtaaagctaaccaggacagtttctccccagaataagatggcatccttaatgtgaacagttttcccagaatcacagatcaaaacttctctactatcatgaaactcttatctttgaatttttttttcatttcttatgcctctgtgaacaacagaagtgaaagggtggtctattatgtacacttataggctgtacctttatttgtgaaggattttgcggccagccttatacgtgaataacctttaatagataaaagatgaaggccaaatataggtgagaaaggttaatgatacatatgttgcctcataatcagtcaaaactcctattaacctacatcatggattaaagagaatattgccaggaggccttcactcttctagaaggacatcatttgttaggtcctttttccatgatttagaataaaaggcaataatttaaaatgtctccctcataataggctctacagcaatttctactttaaaggctatcattacacaacagactttaaactcttgtgaaagttgtgctaaataatagaattagctaaacagaaaagtatctgtgcagctgctgacacttgtggcctatggagaaatacatcaaatgtagattataaaacttcaattgtaggggattaatgaaaagaccacttagtcaagcgagtagactcttcatctagctcattctttaatctatttaattttaggtggtttggtttatggggaccctgggtaaggagcatactgcaaactcttgatattatcctcctcatagtcataataatagtctccccagtgcgctgtattctctcaaatgttttaaatgtttgcatgcagcaatctctagaaagtcaaatgctctctcttcaactggaatgacaaaagctgaaagaaatgtgtgaccatgaggacaatgtaacctgtgaatgacatgccaagcccggaaacccaaaatggtgataactgagagtggtgctaaggccctaagttttggtcacactgttgtctgagtaagaacctggccaaaacggggaatttaaaaaaaaaaaaattgtggaaagccattatttttgactgagctcatttattaggccccaaccgacaaaattaaatggagtcactcatgctacatgtgacataatccaagactttaaggaaacacgtaaatcctagaacagaccagactttgttattctcctgtatacaggccgttccaacataaggaggcaccctctactcaggccttgttccctccttgcaaaacccattgttctactgttcaccaaagggtttcaagaccatataagtacatttgcaaaatgatagtaacatcaatgactaaagttttggtcaatctcttaaaatagagaaaatgaccaaaaagggggaattgctaatgcaaactaaatatggcctaagaaggactctatacttctatatttgagtccctatggatgaactgtaacctagcttaatagtcagacaagattgaaaacctaacttaggagtacacacctgtaacaataactgagtgttggccaatcccagtggccatacttcaaccactcatagatggctaagtgttcaaactatgttcaaataaggcaaatgtcaacctgtaaccaatcaagctgtttctgtacctcactgctgatttctgtacatcatttcctttttttttttttttttttgtctgcaaatcttcttccaccacatggctgcactggagtctctgtgaatctgctgtgattctgggggctgcccaatttgggaatcattcattgttcaattaaattcctttaaatttaattcagctgaagtttttactttaccaggtgtaggatgtcccttttcacaagtcagtcattgattattggccatcttggcatttgactccctttggggataattttccagagaaggatggaaaattgagttgttagccacaaacaatcttagcccctggaggatgggagtgctagatggattaggtgatttagggatagtactagtagcatcttctacagtaactaagtcatcttgattaatttaattaattctttaaagcttttgttttctcatttatgagaaaaattgtatggatgctatagaggtgtaagggaaatcacaaaaaatggtttctgtcagaaacatagcctaacaaaagcactcaaatgtttgcatttagagagtattatgagcataaatattcactattagcaaagtgggaaaatgacgaagactggtactatacaagggaaaacatacaattgtccaaaatatagaactgtttattctttcactgcaaacttaaaatgcattaccatttatttcctgttaaagatacaaaatccaagataatgctcagtgttggcaaggtgtccatgtggaaatagagggcaatctcctacattcctatgaaagatataaattaatcagttgttttctggagggcatattggaaatctatctgaagcttttaaaacatgcaaacccttctaacctggacattctcacctccaagaatttacctgtggaaaatttgaccagatacttaaagctacaaagaagcttatagtattatatgagtgttgaaaaattggcattgaacaaaagagctaacaaaatagaaaggaataatgatgacaaggaagttactataaacaataattgctattgggaataatgctgtaatgaacatacacatgcatgtctttataatagaatgatttatattcctctgggtatatacccaataatgagattgctgggtcaaatggtatttctgtgtttaggtctttgaggaatcaccacactgtcttccacaatagctgaactaacttacactcccaccaacagtacataagtattccttttctccacaaccctgtcagtatctgctattttatgactttttaataatagtcattctgactgatgtgagatcatttctcattgtggttttgatttgcgtttctctagtgatcagtgatattgtgctttttttatgattgttggccacatgtatgtcttcttttgagaattgtctgttcatgtcctttgcccactttttaatggggttgtcattttttcttgtaaagttaaattccttatagatgctggatattagatctttgtcagatgtatagtttgcaaaaattttctcccattctgtaggttttctgtttactctgttgataatttcttttgctttgcagaagctctttagtttaattagtcccatttgtcaatttttccttttattgcaattgcttttggtgtctttgtcatgaaatcattgcctgttcctatgtcttgaatggtattgcctaggttatcttctggagtttttgtagctttgggttttacatttaagtcttcatatggtttggctgtgtccccacccaaatctcatctttagttgtagctcccataatttccaaatgtctggaaaagactcagtggatggtaactgaatcacgggaattcagcattgaatcccatgctgttctcatgatactgaatgagtctcatgagatctgatggttttataaaggggagttcccctgcaaatgttctctttgtctgctgccatgtaagctgtgactttgctcctccttcgccttctgccatgattgtgttgccttcccagccatgtggaactatgagtccattaaacctctgtttcttagtaaattacccagtctcatgctgtctttgttagcagcatgagaacagactagtacagtaaattggttctgggtagaggggtgctgcagtaaagatacccaaaaatgtggaagcaactttggaactgggtaacaggcaaaggttggaactgtttggagggctcaaagacaggaagatgtgagaaagcttggaacttcctagaaacttgttgaatggctttgaccaaaatgctgatagtgatatggacaataaaatccaggctgaggtggtctcagatggagatgaggaacttgttgagaactggagtacatgccactcttgctatgcaaagagactggcagcattttgcccctgccctagagttctgtagaactttgaacttgagagagatgatttagggtatctggcagaagaaatttctaagcagcaaagcactcaaaaggaagcagagcagaaaaatttggaaaattgccacctgacaatgcagtagaaaagaaaaccctagtttttggtgagaaattcaagccagctgcagaaatttgcataagtaaccagaagccaaatgttaatcaccaagacaataaaaatgtctccaaggcatgtcagagacctttatggcagcccctcccatcacaggcctggaggcctagaaggaaaaaatggttttgcaggctgggcccagggtcctcttgctctatgcagccttgggacatggtgccctgcatcccaggtgcttcaactccagccatggctaaaaggggccaacacacaggtcaggccattgcttcagaaactacaagccccaagccttggtggcttacatgaggtgttgggcctgtggatgcacagaagtcaagaattgaggtttgggaacctccacctggatttcagaggatgtatggaaacacctggatgtccagacagaagtttgctgcagcagtggagccctcatgaaaaactttgctagggcagtgcagaagggaaatgtggggtcacagtccccacacagagtctccactggggcactgcctagtgaaggactgagaagagggccactgtcctccatatcccacaatggtagatccactgacagcttgcaccatgcttctggaatagctgcagacactcaatgccagcccatgaaagcagccaggaggtaggctatacccttgcaaagccacaggggtggagttgcttaaggctgtgggagcctacctcttgctctcacacatcagtgtggcctggatgtgaggcgtagagtcaaaggaaaccattttggaactttacagtttaataactgctctattcgatttcagagttgcatgggacctgtagccccctttgttttggccaatttctcccatttggcacaggcatatttacccaattcctgtatccccattgtatctgggaagtaactaacttgcttttgattttataggctcctagacagaagggacttgccttatctcagatgaaactttggactgtggacttttgagttaatgctgaaatgagttaagactttggaagactgttggaaaggcataattggttttgaaatgtgaagacatgagatttgggaggggtcaggggtggtatgatatggtttgcctgtgtccccactcgaatcttatcttgaattgtagctcccataattcccacatgtctgggaggtactcagtgggaggtaactgaatcatggagggggtctttcccatgccattctcatgatagtgaataagtctcacaagatctgatggtttttataaaggggagttcccctacaaattccctttgcctgccaccatgtaagtcatgactttgcttctccttctccttctgccatgattgtgaggcctctccagccatgtggaactgtgagtccattaaacttctatttctttttaaattacccagtgtcaggtatgtctttattagcagtgtgagaacagactaatataagtctttaatccatcttgagttgatttggtatatggtgtaagccaagggttcagtttcagctttctgcatattggctagccagttatcccagcaccatttattgaatagaaaatcctttccgtattgcttgtttttgtcaggttggtcaaagatcagatagttgtgggtgtgtagtcttatttccaggttctctatattctgttccattggtctatgtgtctgttcttgtacaagtaccatgctgttttggttactgtacccctgtagtgtagtttgaagtcaagtagtgtgatgcctccagctttgttctttttgcttagtgttgccttggcttttggtctcttttttggttttgtatgaattttaaaatagttttctctagttctgtgaagaatgtcaatggtagtttaaagggagtagcattgatctataaattgctttgggaagtatggccattttaatgatatcaattctccctattcatgagcatggaatgtttttccatttgtttgtgtcatctctgattcctttgaacagtggtttgttgttctctttttagagatctttcccctcccttgctaactgtatccccaggtattttattcttttgtggcaattgtgaatgtagcaaaagttcattcattatttggctctcagcttgattgttgttggtgtataggaatgctagtgatttttacatattgattttgtattctgagactttctattataaagacacatgcacacatatgtttattgcagcactattcacaatagctgagacatggaatcaactcaaatgctcaccaattatagactggataaagaaaatgtgttacatatacaccatggaatactattcagccataaaagagaatgagatcatgtcctttgcaggaacatgggtggagctggaggccattacccttagcaaactaacacaggcacagaaaaccaaatacctcaagtctcacttataagttggagctaaatgatgagaacacatggacacatagaggggaacaacacacactggggcctactggagggtggagggtgggaggatggagaggtcaggaaaaccaactaatgggtgctaggcttaatacctgggtgatgaaataatctgtacaatgaacccctctgacacacgtttacctatgtaacaaacctgcacatgtacccctgaacttaagttaaaaaaattgcataaaaatgtatttatttatatggaaataagttcaaactttagtcaaacattaacaaattaagattgtattcaaacaataatatttgatttctaaaaatttagaattggatgcactagcagtgattatctttgtgtgacgagttatttgtactttctttgtgcttatttgtaactttctgatctttttacaagaaacaaataatacagcaataactctttcaagtctcaggcttcttggtaggagctcaagcctgtatatacaatcctctttgaagctgatctttaactataattcctagttattttatttgttgctaattttgccaaacacaaatttgtaagtaaatgtttaacatgtatttaaagtaaaaatgaagaccaatcaggttcaagaagcagatttccagctgggcatggtggtttgtgctggtaatcccagcaatctgggagaccaaagcaggtggatcacttgaggtcaggagtttgagaccagtctgaccaacatggtgaaacccccttcgctactaaaaatacaaaaattagccaggcatggtggcaggtgcctgtaatcccagctacttgggagactgaggtgggagaatctcttgaacccaggaggcggaggttgcagtgagccaagatcgtgccactgcactccagcgtgggtgacagagtgagactccatctcaaaaaaaaaagaaaaaaagaaacagatttccttaaacacataaacacaaatcactgtgagcaataactgcacatttttacagaagtaagataaagaggatattttgtatgataagagtggttggtgagggaactatcttagaaattgctttgaaaattgatttatagtcattcaaggaattatttcttgaatgtactcatcttattctgtctttaggctcattttatatttggcaaacatactgtatcagtcagaatcctaacaggaaacagatggcacagtcaacagtataattgaagagcgtttgataaagggaccgtttacaaagatgagggcagagctccggaaaagccaaatgccttggctggcaacatcagagagtgaccaccctgcctgggttgaaagagcaagagggaagacctattatcagaactctgaaagggccacctgagagaagcagggatttcatagaacaaaagttattatcctggtcacgtagggcagctgtactacatgttttggctcagcctttcaggcagcttcaatctcaggacagctccatatcaacacaagctttcacaatcatcatggcaggagaagagcctggataagcacatgccagctcttaaatgctgctaattagaagtggtgcatcacttctgctcacattccattggccaaagcaaattatttggctttgcccacccaacttcaagggagtagggaagacagtcttcctatctactcaaaaacaaaggagagggccgagcactgtggctcatgcctgtaatcccagcactttgggaggccgagttggacagatcacctgaggtcaggagttcgagaccaggctggtcaacatggtgaaaccccgtctctactacaaatacaaaaattagctgggcatgagtgcctgtaatcccagctactcaggctgaggcagcagaattgcttgaacctgggaggtggaagttgcaatgagctgagattgcaccattgcactccagcctgggtgacagagcaagactcagtctcaaaaaaaaagcaaaggagaactggaaacactggtgaaaacctgaaaaacacagacagagagtaacccgtgttcttttacattatgctgcattcttttgtatgagaaagaaactttcattggacaataatacatgctctacagctatgctgtccaatacactagccatcagccacatgtggctactgagcactagaaatgtgtcaagtctcaatcgagatgtgtggtaagtgtaaaacaaacctcagatttcaaagacttagcatgaaaaagaacataaaatagttcattactgattttaaaatattgagtacatgttaaaatgataatgtttgatatcttgggttaagcacaaatctattattaaaagtaattttacccagttttgctttttaaaatgttgtttctagaacatttttaattacacatgtggcttgcatttgtagtttgcattgcattgctgttgaacagccctgctctaaagagtcctatggtttctaacagggttcttactagaaagaggtgaagaattaccaaactctgctggaattctctagaataaatttttactttaattgatcttggaaaaaatggattttttttcttttattttagtgtctgatttaaatttctttatacaaattcagtatcatttttttctctcttccataaaggcgcagcacagatggttcagagaaaccattattctacataaagtcttttttataaaatgtggttacatgaaattcagtttgattaaaacaaagggagccattcctcaaacacgttgtttttcagtttcttagtttttcacagatattcaacttgaagtcttcaacttttttttttttttttaactgggagggagagtacagagaaggccactcaccttgccttttcatatatatgtagagctgaaattgtaagatgttctgaagttttcttggaattttggtctagcaaaaactattgagtggtctgtgccacagatgtccttcctcctctccacccaccctagacccctcttcttcccctgtacccatctgtctgccctggatgctgacttgggtggtctgcaccagaagtctctcatctttgacttttggttctgttcagctaatggagagttctggccagacaatcaaggagggaggggagcagggtcagagtgtctactcacctggttccctcctgcaaggtcgcctggtgctgaacatccagaggtgtcaggaaaagagcatcactgcaaataacccaggaagaaaggatttaatatagaaagaagagcttaggcaaaaggtggagggcactgggatgagaaagtctggatgacagattcagagggtcagagagataatcatagtcactctagccagtgcattggcatcagggcttcccagtatgatagagatcatagacagtctacgaagcaatgcatgtttggttattgagtgggacccagaaaagggaggttgtcaaggagtctgtggaagctgccgctaagtagggtgggcttgaggctgatttggtgagcagtgacagcccttagagaaacatgctatattcagagcaggaagagagagggccagtgtggggaggcctgccagaaacatcacatctctctgtcactgtctgaccaagatgacctcccaaaagtaatggtttttccctcaagttcaccttccaaatttcacttgaattcctctccttggcaaaccctaacttggaactatactgggaagggcattcaggaaactgacttcccagcctcagacaggagcagaggtatcaagctgacaacagtctggcataggccagctgtgtctcgtgactgagggccgtgttactttaaggaagccttcttttcaccactgcaagttccagagtttgcctcggctcatgctttcaggcctgagatatcccttttcatatgttgggagtggtaacagcttccttgggtgaatgccctatcccttgtgattcccgaacactctgccctccctcccccatgaataatcttgatctgagggtgctgtctgcattccactgtgactcagactgacaggtcccctggcatcttgtgggaggctgtattaaaacaagaggtcttagtgtctccgccaataactaaaggacacaggagagcaacattttaaaaagagatttgctgaagtctaggaaaataaggcagtttttcctgcctttctgcctgagttttttaaaggctttacaataccttttaggaaaaataaactcattataataatactaagttaaaaaaggaagttatcaggatgcattttatatgttatagtttattctttagcaaagaaatatcaagattccaaccacacattaagcttaacactcatagcttcttggtcttccaaagtgtaccttgtacttcttttggatgggaggttgaaaaacttcctttgtttcttcacccccaattatttctctaatgagaggcttagactagatgatctcaagtatcccttgtatactcataagggatacgaaacattccctgtttcagtcaagtttgtggcgtatattgattggtgaggaaaatgtttagagatctttttgaagcactaggtgagtatattgtgaaacaaaatttaccttcccatttcactaagagaatgagagacattttcactaatacctttgaaagcattatgcaaaagagtgcatggttctaatagaaccccagcctagttcaggagttggcaaacaatggcctgtgagtcaaatccagcctgctgcttgtttttgtaaattaacttttactgaaacagagccatgcttatctgtttacatattgtctatggctgctttctcactaccactacagagctgagtagttgcaacaaagtttatctggcccacaaagcttaaaatatttactacctggcccttaacagaaaaagtttgccaacccctagtttaagtaataaaatttgtaagcagctctcttcaagtaaaattccctctctagatttttcagaaaagatataacctgagatcctaacaatgggtaacttagagtacaaataaatgtctattttggatgcatgaaaattatagtacctcatataatacgtcagaggcagcctgatagccctgggatctaatctcaattttgttatttaccagcttaatgaccttgtgcaagttacctaatctattctcagttgtaaaatcgcatgaaagagtatgtgaagcaccctaaatttctatccaaaataatccaaaagtgaaggattattgaatattaatttttacactgaagaaagatgaaagatctgaatctatggggttagaaggttggaaatgcatcatatgggtatagaacttagaatgcaatgtactctaaattattaaacaacattttcttcccattgctcccgtaaagccactccttcaacagaaaaacttgactctcttaggcaacatattggaaactgtgcataggagtgagaaacacaacagcagaatttagaatgaatgtagcctggcaactgtgtgtaccgggaccctggccagcaatgccttaggataggagagctctcaagctatgaagaacactgcagtgggctctgcaactggactgtgcaatggaagcttccagctgtggaggcacaaggagattgatctctaaatgaggaacagacaacctgccgaggaacacctgtgttcctcaaatgtcaaacctagatctagaagggtttagagacacaacccagaggaaagcctggggaacatacaaaggtttaaaaagaccatccttttgtatttactttcagaacgaaaggaggaataaatctaattcttctcttctggctctgcaaagttcgaagtccaccaacacacttcagcttgagctgaaattcaacagataagaaaagattcttaatgattaatcagccccaacacagttctggagaaagaaagagactttattttcattttatagatggggaaactgaggctgtgagcggtcagaacccctttggggtcatacaatttttttgtgcagattgagaaagaatctctgggtctctgactcctgctctactcttcttctctagaacccagaacttgtgtagaatacactggacctcctctgatttatgacatgaccttggcatgttggggaatctctgtactttcgttcccttctctgtaaaatggtcagaattcctgtctatctttccacataaatatattgaagttcaaatgtgttcacagacaggaaatcgtgattcagtggatttggcagatgcttattttcctacataaaattcatcctcttctttctaattgcttgcagcaatctgcccagcttcagggaataaatcatgattaaaccactacagttatggtagtcccatgcccttttgccagaggttggactagatattttcatgtgacccagactcctcaataaaatctggaggagagcctgaaatgggttttagaaaactctaaggatagtcctgttatacctcttgaaagtcacaggtggtaatgtgcagaaaagtttaagtgtctgcaaaggatactctcatgtgcggtatgaggtaagatggaagacagcaggggtggagcaaagcacaagtcagttacaaactcacacactgattcaacaaatatttatggtgtgcccaccatgtgttaggcactggaaacacatcagagaacaaaacagaccaaattcctgggccccatggaaattacattctagcaaggtgaaacaaacaagagaagtaagtacaacatgcagcatattggtaataagtgcaaaagaaaccaatgaagcagaaatagggaagtgaatgaattagggtgttgagattttaggtagggtaatgaaggatgtcctcctggagaaggcagcttttgcataaagcctgaaggaagtgaggaagtgagccatggtggaatctggagtcagaacagccctctcagaggagacagtgaggaggctggtgtggctggaatggagtgagccatgggggaggagtagaaattgtgatcagtggtattgagagccacatcagttgtgtgaaccctcaaaagcactgtggttcttaccctgagtcacacaggaatccagggaaaggttttgagcagagagatgtggacaaatctttatcttagcaggatcattctagcagctttgtacaagtaggctgaagaggcacaaggacagaaatgaaccacatagtaggatatttaatataggtgagagtcattggcagcttcagccagagtggtagcttggaaaggtaagaagttgttcagaatctagatataattgaagacagagttggcaggttctattaaatataagagtggggtttgaggaagttgaggatgactccaaggtttttgatttgagcacctagattgatggagtctggaagattgtaggaacatcaggatttggaggcaaggccagaatcttgcttttcatcttgtttgagatgcctattagtcatctaagtggacatgtcaagcaggccattggataacaagtctaacaaattgggcatttaattgcatggaagaaacaccagaaatgagtcacagggaagcatctgactctctgtgtgaaaagcaggataatttcttcaaacctcaatttcctcatcattgaaatgggagtaacaaccagtgttgtgaaggtttaataagatgataaaaggacctagcacagtttttttgagcaataaacagtaaatattattaataattacttactatttttacattttcctgcctgagtagaatctacagaaaattaagtcacttgacctaccatttagtttccttgtcctaagaataaaggaatctctgagtatttttaatgggcttggtgacttacaatttcttatagctgtcatataggtctagggtaaagatgcaatttttttcctgttttatagatgaggaaacagacttagaagtaaaataactttcccaaagttacacaactagtgtcatcttcgaagatcagtttttcaattatttttaatttaacacattgcatctttaagaaccttctcaaatatatctactttttactgacaccgattttaaaaaatgaacactttccctccatgttaataaataatttttaggaagaggttctcaaaatttagttttcagagaacaaaagtctagatagagtagggaattcttacccacaataagaattaatgcaaatatggatgtttcataatgaatgatgataaccttctgggtttacacttaatggatatgtccacttgacaaatggcatagcgattatccaacacttccccatgtaggttgatccacagtaacaaatggccatactgcccaaagtaatttatagattcaatgccatccgcatcaagataccattgactttcttcacagaattagaaaaaactactttaaatttcatatggaaccaaaaaagagcccatatagtcaagacaatcctaagcaaaaagaccaaagctggaggcatcgtgctacctgacttcaaactatactaccaggctgcagtaaccgaaacagcatagtactggtacaaaaacagatatatagaccaatggaacagaacagaggcctcagaaataacgccacacatctacaaccatctgatctttgacaaacctgacaaaaacaagcaatggggaaaggattccctatttaataaatggtgttgggaaaattggctagccatatgcagaaaactgaaactggaccccttgcttataccttatacaaaaattaactcaagatggattaaagacttaaatgtaagatctaaaaccataaaaaccctagaagaaaacctaggcaataccattcaggacataggcatgggcaaagacttcatgactaaaacaccaagagcaatggcaacaaaagccaaaattgacaaatgggatctaattaaactaaagagcttctgcacagcaaaagaaactatcatcagagtgaataggcaacctacagaatgggagaaaatgtttgcaatctatccatctaacaaagggctaatatccagaatctacaaagaacttaaacaaaattataagaaaaaacaaacaaccctaccaaaaagtgggtgaaggatatgaacagatacttctcaaaagaagacatttatgcagccaaaaagcatttgaaaaaaagttcatcatcactggtcattagagaaatgcaaatcaacaccacaatgagataccatctcacacaagttagaatggtgatcattaaaaagtcaggaaacaacagatgctggaaaggatctggagaaataggaatgcttttacactgttggcaagagtgtaaattagttcaaccattgtggaagacagtgcagtgattcctcaaggatctagaaccagaaataccatttgacccagcaatcccattactgggtatacacccaaaggattataaatctttctactataaagacatatgcacacgtatgtttattgcagcaatgttcacaatagcaaagacttggaactaacccacatgcccatcaatgatagactggataaagaaaatgtggcacataaacaatgtggaatactgtgcagccataaaaaaggatgagttcatgtcctttgcagggtcatggatgaagctggaaacctttattctcagcaaactaacacaggaacagaaaaccaaacaccacatgttctcactgataagtgggagttgaacaatgagaacacatggactcagggaggggaacatcacacaccggggcctgtcggggggtgggcgctaggggagcgataacattaggagaaatacctaatgtagatgatgagttgatgggtgcagcaaaccaccatggcatgcgtatacctatgtaacaaacctgcacattctgcacatgtatcccagaacttaaagtataacagaaataaaaaaaataaattaaataaaaataaataaataaataagagctagccaaattgtaaaagctaagtacccatcagtaaatgtttaagttatgtttagccctatcatgctctatatcatcatggagtgcttaagaaaaacataataagccaggcacggtggcttatgcctgtaatcctaacacttagggaggccatggcgggcagatcacctgaggtcaggtgtttgagaccagcctgaccaatatggcaaaaccccgtctctactaaaaatacaaaaattagccggctgtggtggcacatgcctgtaatcccagctactcaggaggctgaggcaggagaatcacttgaacccaggaggcagaggttgcagtgagctgagatcacgccactgcacaccagcctgggtgacagagtaagactctgtctcagaaaaaaaaaaaaaagaaaagaaagaaaagaaaagcataataatacagcaattatggtaaatagaataaaggcaagctaggactaatacaaaatgctctggcctacatgaaatatgcatgcattagaaaaaataccttgtattgtatttccttttattgtatttcctttcatgttcacagtggctgatctttccctattcttataacagtcaacagtttgtgtatttacatgtgccagaccctgcatttagtgttttatagatatccttatttaaacattaaccataggatgagattatatctttttttaaaccattaccatgaatacttttatttttttagcacagactattataagtggatgaccagttttcatcctttttatttaaacagctttattgtggcatattttacatatcacagaattcatctatttcaatacaattcagtgatttctagtaaccttaccaagaaatgcagtcatcaccatagtccagttttataattttttatttccctactaagctccttcgtgtctatttacatttaatcctcatttctactcccagccccagacaatcactaatttaatttctgtctctatattgccttttctggacattttatataaatggaattatacattatgtggtcccttggtcttttgtacctggcttctttcacttagtgtaatggttttgagttttgtctatttcatagcacatgtcagcagtttattcctttttattgctgagaaaatctcccagtatagtgaatataccagcttttgtctatccatttgccagatgatggacatttaagttgtttatggtttggggatattataaatatataccatttcttagatgaagaaactgtggcctccaagaaggtcagtaactctccccagattgcacagctactcaatgtcagagccagggtttggatccaagcttacccaactccaaaacccaatcacgctgtttattgctagaattaggggatgaattttgtcctttatatttttgtttctatacatcttatgatatatattttataatttaaaattttgttagaagtgtttaaatatctttaaattgtgaccaataaagctatgatgtgttacctcttccagggatagtcagattttgtggataaagtgttagctttattcattccttcagtaaagctgtcacatttcagccctcaacaaaagataaaccaaagacagggaccatggtagcaggctaccccagagatgccttgcagatttacctctgctgaagcctctggactttgtgctagcactgccatagaattgctcagggtcctcctggaaccataagacatcccgggcttctgtttgaagctgaaggttaaagatgaggccagaacaacctgagtgataggagtaaagtgttcctcaatgaaaacatttcctgatcaatctgtcttttatgaagtcagacaaaagttgagtaaatcctggtatttttactggtttgtttttcaatgcttggaaatgttttactgagtgtaggcatttttctgtgggtcttaacagcagttacacttcataatcatcttaaaacacacctaacataaaatttaccatcttggccatttttaactgtacaattcagtggtatgaaacatattcataatgtttaataatcatcaccatccagctccataactgattttcatcttgtaaagctgaaactctacacatatcgaaaagtaactccttatgtctcccactccccagcccctggcaaccagtctatatgtttctatgattttgacaactctaaatacctcataaaaatgagatcaggcagtatttctttttgtgactggcttatttcacttagcatcatatgctcatagttcatccatgttgtagcatatgtcagaatttccttcctttctcagcctgaatagtattttattgtatgtatatgccacaatttgcttatccattcatctgttgaatggacacttgggctgctccgtgttttagcaaatgtgagtagtgctgctctgaacatgggtgataaatttccctaaaattttgtgttcaattatttggacatataccaagacgtgaaattgctggattgtatggttatctgtttttaattttttcaggaacttccatactgttttccaagtagctataccattttacattcccacttgcagtgctcaagggttccaattttccactttctccacatcctcaccaacacttattttctgttttttgatagtaacctttctagcaagtgtaaagtggtatcttattataattctgatttgtatttctctaatgattagtgatgctgagcatcttttcatgtgcttattggccatttgattattctctttggagaaatgtctattcaagtcctttgcccacttttgaattagttttttgttgttgttgctgttgagttttaagagttctctatatattctggacattaatctcttatcagatatatgatttgcaaatattttcttctatttgtggtttgcctttttactctgttgatactgtcttttgatttacaaaattttaaaattttcataaaatccaatttgtctatttttctcttgtcgcctgtgcctttggtatcatattcaagaaatcattgccaaaccagtgtttcaaaacttttgccctatgttttcttctaagaattttatagtttagttcttacatttaggtccttggtccattttgagttaatttttgcatatgatatttggtaagggtccaactccattcttttgcatgtggatattcagttttctcaacatcatttgttgaaatgattgttctttcctcattgagtggtcttagcagccttgtcaaaaatcatttgatgatacatataagggtttatttctgtgttctgtattctattccattggtctatttgtctgtctttatgccaataacatagtagtaacttttgaaatcaggaagtgtgagtcctccgggtttgtaatttttcaagaatgtttggctatttggggtcccttgagattctatatgaattttagaatgggttcttctatttctgtaaaaaaaagtcattggtatactgatagagattgcattgaatctatagattgctctgggttatattgacatcttaacagttttatccaaacatgggatgtgtttcaatttatttaggtctttaatttctttcagtaatattttatagttttcattgtacaagtctttcacctccttggttatttcctaagtattttattatttttgatattaccataaatggaattgcttttgtaatttgctttgcagattgttcattgtcagtatgtagacatccaactgatttttgtatgttgactttgtatcctactactgtgaataattcctctattagctctaaaagctttttgtgaaatctttaggattttctgcatatcatattatctttgaacagaaatgattttattcttcctttttagtttggatgatttttattttttttcttgactaatgtttcaggctagaacttccagtactatgttaagtagaaacggtgaaggtaggcatccttgccttattcctgatcttagaggaaaggtttttgtcttctaccattgagtatgatgcttattttaaattttttcatatatggcttttattatgttggggtaatatgtaataggaatgtcctcctattcctagttcattggaatgtttttattatgaaaatggttgatttttgtcaaatgctttttctgcatttgttgagataattgtggtattttttctttattattttaacatggtatattacattgattattacatgctgaaacatccttgcattccagaattaatcccacttgatacacaatctttttaatatgctgctaaatttggtttgctagtattttgttgagaatttttgcatcaatattcttaaggaatattagtctgtagttttctttttttgttgtgtctttggctttggtatcagagtaatgctggcctcactgaattagttagaaagtgttccctacttttcaattttttgggaaaatttgagaaatactggtattagttcttctttaattgtttgataaaattccccagtgaagccaccaggtccagggcttttctttgcttaggaattttttttaatactgactcaatctccttactagttataggtctattcaggttttctatttctttatgatttagacctggtagtttttgagtttctgagaatttcctcatttcatttagattatccagtttgttggtgtacaattgttcatagtactctctaataatcttttttatttcttaaaaagaataatactgaatcagtagtaagttccccttttatttttaattttagtaatttgagacttttctgttcttttttttgtctatcaagctaaaagtatttcaattttttttctcttttcaaagaatcaacttttggtttcactgattttctttattgttttctagtttctatttatctctgctctagtattattttttcttccttctactagctttgggtttagttgtaaagttaggtttttgatttgagatctttcttgtttttaatgtaagtatttatagctataagtttccttcttagcattgctttcccttcatcccttaagtttttggaatggtgtcttttttaaaatttatatctaagtattttcaaatgttcctgtgatttcctctttgttccattggttgtttaataatgcattttttggttcccacaaatttttaattttccagttttacttctttatcaatttctaatgtcatctcctagtgtcagagaaaatactttttctttttttcagactgagtctcactctgttgcccaggctgaagtgcagtggcacaatcttggctcactgcaacctctgcctagtgggttcaagcgattctcctgcctcagcctcccaagtagctgggactacaggcacgtgccaccatgcccggctatttttttgtatttttagtacagatggagtttcaccatgttagccaggatggttttgatctcctgaccctgtggtctgcctgcctcggcctcccaaagtgctgggattacaagtgtgagccaccatgcccggccagaaaatactttttatgatagttatccttttaaatctattgagacttaatttgtggcctaacatatagtctattttggaaaatgccccatgtgcacttgagaaaaatgtgcatgctgttgttgttaggtagagtgttctgcatatgtctgctagatctaattcatttattgtgatgtttgtcttctatttccctacttttcttttctctggtgacctattcattattgagagtgggctattgaagtgtccaactattattgtagaactatcttatttctcccttgaattctgtttatgcttcatatatatatatatatatatatttttttttgtttgttttttttgagatggagtcttgctctgtcgcccaggccggactgcggactgcagtggcgcaatctcggctcactgcaagctccgcttcccgggttcacgccattctcctgcctcagcctgccgagtagctgggactacaggtgcccgccaccgcgcccggctaattttttgtatttttagtagagacggggtttcaccttgttagccagggtggtctcgatctcctgacctcatgatccacccgcctcggcctcccaaagtgctgggattacaggcgtgagccaccgcgcccggccgcttcatatattttaatagtctgtcattaggtgcatacatgtttataatgattatgtcttcttgatgtattaaaccttttattaatatataatgtcctttaactcttgtaagtttaaaaaattaaagtctatattgtctgatgttaatataaccacctctgctctctttcagctactattttcatggaatatctttttccattctttcactttcaatctatttgtgtctttggatctaaaatgagtctcttgtagacagcaaatagttagatcatgtgtttttaatcccttctgctaatctctgtcttttcactggaaagtttaagccatttgtatttaaagtagttgctgatgaggaaggacttacttctgtcataatgttatttattatctcccttatagctttttgatctttattttctgcattactctcttattttatgtttagcttatttttatattgaaatgtttacattcctttctcatttccttttgcgtatattctatagctattttctttgtggttaccatggggattacatttaacatcctaaagttatagcactctaatgtgattttataaaagtttaacttcaataacatacacaaagtctgctcctttacagctttgcttttatctccttagtgatgtcacaaaattacatccttatacattgcataccccaaaacataaactaataattcttctaaatgcaccaatctcttaaattatgtggaaaacagtgtgaagttacaaatcaacattacaataattctaatttttagactaataattgttttttaatatgtattaatctcttaaatcatgtagaaaacaaaaagtagaattacaaagcattgttacaatatattagcttttatcattgctcatgttatttacctttactgatatctttattccattatacagctttgagttactatctgctgtgctgtaatttcaccctatagaattccttgagcatttctcacagggcaggtctactagtaacagactccttcagcttttgtgtatttgagaacaccctaatttctccctcacttttgaaggatagttttgccagatatgggattcttggttcacagatgttgttttttccttttagcacattgagtatattagcccctgccttcttacctccaaagtttctgatttggaatttgctgataatctaattgagggtccactgtatttgaagagttctttgtctcttgctgctctcaagattctctttgtcttttgaaagtttgattataatgtgtcttggtgtggttccttttgagttcatcttacttgtagtttgttaatcttcttgaatgtttatattcatggttttcaacaaatttggaaagttttcagccattattttttcacatattctctctgcctctttctctctctcttctgtttcttggactcccacaatatgtatgttggtccacttggtggtatcccacaggtcctttggactctgcttttttttttcaatcttttttctttctgttcctcagacttgatattttctatcatcttatcttcaagttcactgattctttcttttgcttgcttaaatctaactgtgaatccctctaataaatgtttaattttagttatatattttggctccagaatttctttttggtttccttttaggtttttaatatccttttgatactttcattttgttcatatgttgctttcttctgctttcttgactttcttttttttggttggttggttggttggttggagacagggactgctcactttgtcgctcaggctggagtgcagtggcatgacctcagatcactgcaacttctgcctcccaggctcaagtgatcctcctgtctcagacccccaagtagctggagctataggtgtggccactgcactcagcactttttttttttttttttgtagaaacagggttttgccatgttgcccaggcttatctcaaactcctaagctcaagtgatccacctgccttggcctcccaaagtgctgagattacaggtgtgagccactgcacccagccatgccttctagactttctccacatcctattagtcctttgagcatccttaagacagttgttttaaagtcttcatttagtaaatctgccatcaggtcttttttaggggggatgtttctgttgatttattttttttcctttgaaatggtcacactttcctgtttctttgtatgaccttgtaatatttttaactggacattcgaaactaataatgtaatacctctgacaatcagattctcctctttccctgtggtttgctattgtttcatttgttatttatggggtttggtttttttaatttttgtaggttctctctgccaaggatcagcctgaggtgtaaacttaaggtctttctaaggtcttttctgatcctgcacctttccctgggcatgtgtggtctctttctaattttccttgtatatgcagttgcttttgaatgttctagtctttaatgtctagcccctgaaagtggggaaaaaaacatgaaaggaaggggaagaaaggacaattgccttttaaattccctggaagtcacttcagccagagatggaggggttggcaacaatggtggcggggggcgggaagtagaacagcagtggccagtcttctttttgtctgcacctctgtgatcaggagcagcaatcagtgattagaatggaaatctctgatgtttggatgacagagccctttatgttcatcctagctcctgcaagctttttgcaagctactccaaggacatgtgtgcaatattacaggcatggctacctgccatggggctgaaggtgagagacgggtagctgctactgtgctaagagttaaaattgatcagaattaaatgctcttcactgtctaagccttcctctggagttttaatccttcaatagactccagagcttcaaaatagctacatccgatatattctgccagtgaaattgttgtctaggtggggtgacagattcctggtgcttcctactttgtcacttcctcagaatcctccctttttatatgtgtcgtgtcactaaagatatgcattttagttaaatttgaaaatatagatcaatgtggtatggtagccagactccaagatggccccacctccagatattcatactcttagacagtctcttactacattatacctgagttgtcttgtatgtacaatgaatatgcgaaagtaatgtgttaatgctgacaactagtttataaaagatacagcaggctgggaatggtggctcatggttataattccagcactttaggaggccaaggtgagtgatccacttgaggccaggagtttgagaccagcataggcaacatagctagaccctgtctctacaaaaaaaaaaagtagaaattagcttggcatggtggcatgtacctgtactcctagctgctcaggaagctgaggtgggaggattatttgagcccaggagttcaaggctgcaatgagccatgattgtaccactgcactccagcctgggtgacagggcaagaccctgactccaaaaacaaacaaacaaacaaacaaacaaaaagaagaagaagagaggcattgcagcttttgtcttggtctctccttctctcaatctgtctctcttggatcactggctctggaggaaatcatgtcatcagcagccttatggagaggtttctgtggtgaggaactaaagcctcttgccagcagccataagactgaactttgaagaggatcctctagccccagctgccaccttaactacaaccttactagagatcctgaatcagagccaaccaacttaattgcttctcagaaactctatgagataataaatgtttgtagctttaagctactacatttgggggcaatatgttatatatcaatagacagctaatacttagggggaaattaacccataatttcacagtccaaaaattactgttaacattttgtgtgtaaaacattttgtatgtgctttacaaatagttaaaaaatatgaatatagaagctgtggtgaaaaacagtatgacagttcctcagaaattaaacagaattactatatgcaccaataattccagttctaggtatataccctaaagaattaaaagcagaaactcaaatatgtatttgtatacccatgtttgagcagcattattcacaatagccaaaaggtagaaacaacccaagtgtccatctatggatgaatggataaacaaaatgtggaatacacagataatggaatagtatttaaccttaaagaggaatggaattctgatacatgctacaggttgagcatcacaaatctgaaaatttaaaatttgaaatgctccaaaattcaaaacttttcgagtgctaatgtaacatgcaaaggaaatgttcattggagcattttagggtttgggatgctcaactgggtaattatataatgcaaatattccaaaatctataacacttctggtcccaggcattttcgataaggcatattcaacctgtggaacatggatgaaccttcaagacatgatgctaaatgaaataatctagacacaaaacaacaaatactgtatgattcttcttacaggctatacctagaatagtcaaattcatagagacagaaagtagaagattggttatgggaatgagggaaaaaattaaaggggacttattttttaacttttaagttcaggggcacaaatgaaggtttgttatataggtaaacttgtgtcatgggggcttgttgtacagattatttcatcacccaggtattaagcataatacttattagttgtttttcctgatctccctcctcccaccctccaccctctgaaaggccccagtgtgtgttgctctcctttatgtgttcatatgttctcatcatttagctcccacttacaagtgagaacatgtggtatttgtttttctgtccctgtgttagtttgctgagaataatgacttccagcttcatccatgttcctgcaaaggacatgaacttattcctttttatggctgcatagtattccatggtgtatacgtaccacattttctttatccagtctgtcactgatggacatttatgttgattccatgtctttgctattgtgaatagtgctgtaataaacatacatgtgcacatgtctttacaatagaattatttatattcctttgggtatatacccagtaataggattgctgggccaaatggcatttctgtctttaggtctttgaggaatcaccacattgtcttccacagtggctgaactaatttacactgccaccaacagtgtataagcattcctttgttggggagttattttttaatgggtacagaatttcagtttaggatggtgaaaaagttttggaaatggatagtggtgatttttgcacaataatgtgaatgcacttaatgtcactgagttgtacacttaaaatggtaaattttatgtatattttaccacaataagaatacattaatatagaatgatattaatttgtaactcttctctttactcaatgtcataaatgtctttccatgtcaagtagaatgtacatcattcttaatatctggatagtaatgatagaggcaggaagcagagaaattctaggcagacaggggcaggttcccagtgaaacaccacctttcagctgaaaagcctgaagcctgcagtccaaagtgagaacttctatccctgtttgcccactttctcccaattggttctttctggataatgtctttttaccaattgaatgttgctttttccaaaactacacatggcctgccttgccccgccccctccacatcgtgtgcctataaagaccccaggctcagttgatatagaagggagaggggcaacttggcttcagagggaaggctggactttggagtagagatggcttggcttcagagaggcagtttgacttcagggaagagccagccgaagatgaccagactctggggaaagattacctgcccatcctgccccctctctagcttccctctcgctgagagccacttccaccactaaataaaattctctgcctccaccatctttcaagtgtctgtgcaacctcattcttctttgatgccagacgagagcacaggacccactgaatacaggtacccagaaaaggctttcatactggctctttgcccttgctggcagagggcagctgccccatgcaatgaggcaaggggcccaatgagctgataacacactgctgtccatggatggtggatctaagagagcactgtaacatgccctctggagcttcggggtcacaggcgcccccacctgggtgctgctgcggggtccccatggagcttgctcctgccagtggccaaaccagccagctggatcccgcactcatttgctcacacctggtttggctgcagggcccacatggagcttgctcctgctagcggccaaatggccggctggatcctccactcacttgctcacatgcttcctcctgcaaggggttgagcaccatgggctgagtaaatggggcacccccgtcgcaaatccaacaaagcggtcgagaaaaatcctgcatcagtaatgcatttgatggacatcctctgatttgggtccaaggaagtcatagaactcggagttacagacccactgacttctccaactacatctctgttggacatctcttctctctttgtctctctgtgtctctgtttctttgtctcactctttccctttgtctctttcatgatttttaattgtagaatttaagagcctttctctttgcaaaaatcaagctttaaaaaaatgtgagtggagtggggtacaggaaaaatttaccttatttgatttgtttttcccccttctctagcagattgagaagctttcatgctttctctccagttagcttgggattttattaccaataaagtgtcactctgtgctcttcagagccttacaccatttgtaggctcactatgggcacatttgtattgctgatgtgcaatctgtgggttagaagtaaaaaatgctaacagagccttgagaagcctccttgcagtgataagggttatcctggaggacagaggcatctcagcaggctggctccctgggaacacagatggagctcgagaggagtaggttcaggactgtttctgtgaatggagaagaggtttcaaagagatttttctgaaatttcattctctggtttgtttgtgtgctgtacaagtaagatggatcacatgttagaggctgagtctccaagggaggatgtgttctggcagagtcaccagggggcagggtaatatttctttccatcacactttattttgcaggtttagaaacttgattttatcagaggtgcataacatggtttgtttatttaccaaacttgatagagcctgatttgtataaagggtccaccttagaatttccaccgaacagcacctatcaggtaggccatgttaacacatttcgttattgataggtagtgggttgggattttttcctcttaggattttgggttttggagtcaaacatgcaaaggtacgatagcttctaatcttagagaagctacttgaacttcaatttcctccccagtaaactagaaaaaaaatacattgtaagattatgaaaaatacatgtaatacagtacataaagtatctagcacagttagtaacactcatagtaagctcttcatccttttcctcctcctagatgagattaaggggtttgtaatcaagtcacaaatacccagggcagccactcacacaggcaagtacttaataagccagccagggtgctcaagtccagctaggcctggcatgctgttccctggacagggttggtattcagtccagcaaacgtatgaggcatgtatggtgtcaaatactgtggaggacacgacaatgtccaagtcatagttcctgccctctgaaaacacatgtgcatccacagaagcctacaggatttgcattcaagtgattaaaatctcacccaagacttgtgcttctcaaagtgtgaatcctgggcctctggcagcctgacagaaagtgactgtcacattcacagaccttgcagacaacgtaggtagatggaaaaatctcacaaaccctaatttatccatatctaaatataagcatattgcatatagtttaaggaataaggaataaaactcaaataattttcttaacttgtacttttgatcttaaagaaaattttgctccctctccctctctctctccctctccccatggtctccctctccccacggtctccctctccctctctttccacggtctccctctgatgccgagccgaagctggactgtactgctgccatctcggctcgctgcaacctccctgcctgattctcctgcctcagcctgccgagtgcctgcgattgccggtgcgcgccgccacgcctgactggttttcgtatttttttggtggagacggggtttcgctgtgttggctgggctggtctccagctcctaaccgcgaatgatccgccagcctcggcctcccgaggtgcggggattgcagacggagtctcgttcactcagtgctcaatgttgcccaggctggagtgcagtggcgtgatctctgttcgctacaacctccacctcccagccgcctgccttggcctcccaaagtgccgagattgcagcctctgcccggccgccaccccgtctgggatgtgaggagcgtctctgcctagctgcccagtctgggaagtgaggagcgcctcttcccggccgccatcccatctaggaaatgaggagcgtctctgcccggccgcccattgtctgagatgtggggagcgcctctgccccgccgccccgtctgggatgtgaggagcgcctctgcccggctgcgaccccgtctgggaggtgaggagcgtctctgcccggccgccccgtctgagaggtgaggagcccctccgcccggcagccgccccatctgggaggtgaggagcccctctgcccggcagccgccccaactgagaagtgaggagcccctccgcccggcagccgccccgtctgggaggtggggagcatctccgcccggcagccaccctgtccgggagggagatggggggtcagcccccacccggccagccgccccgtccgggaggtggggggcgcctctgcccggcggccccttctgggaagtgaggagcccctctgccaggccaccaccccatctgggaggtgtacccaacagctcattgagaatgggccatgatgacaatggcggttttgtggaatagaaaagggggaaaggtggggaaaagattgagaaatcggatggttgctgtgtctgtgtggaaagaagtagacatgggagacttttcattttgttctgtactaagaaaaattcttctgccttgggatcctgttgatctatgaccttacccccaaccctgtgctctctgaaacatgtgctgtgtccactcagggttgaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggagaaccagagacctttgttcacttgtttgtctgctgaccttccctccactattgtcctgtggccctgccgaatccccctctgggagaaacacccaagaatgatcaatttaaaaaaaaaaagaaaaccaaaaaaaaaaaaaaatcaaaaaaaaaaaagtttcacttgcctattgagctcctatgctctgccatcagaagagcatgcctcagaaagcaatggctccagaatatgctcaattagaaatgggttcttgagactcgctcccagattaaagaagcattcagaaaaggcttgaactcaacctactgtgggaagccaagtccaacggaactcatcagaaccacagctgacacacagatctgaggacaagaagatcgtatttgttgttgtaagccactgagatttaaggggtgattgttacacaacaaacactgactaatgtacataactaataagcttataaatcagggttttggaggctgatctaatacagcaacacagatcatggaaaaaaaaaaggaaaattttaaaagttatcacggagaaggatctgaagtttatgataaaaaatgatgggctaaatctctcctcctacttgatttgggaacattggtcatcaccctgtgatacacctggtgtgctatgattttcaagaataaggaatgttagatttcacagttgcttgctgtatggaatctgaaagtcgctgaggtccttagtctgctagttgcctcccagcctcagcataggttgtgttggtgcctgaatggttttccctattcagacatgttcttgttaactttgatgtggtatctcttttattttgagacagagtgttactctgtcactcaggctggagtgcagtggtgcaatctcaactcattgcatctttcgcctcctgggtttgattctcccacctcagcctcctaagtagctgggattacaggcgtgcaccgttatgcctgggctaattttgtatttttagtagagacaaggtttcaccatgttggccaggatggtcttgaactcctgacctcaaattattcacccacctcagcctcccaaagtgctgggattacaggtgtgagtcactgtgcccagcccagatatggcatctcttgatgccccatctgtatcctagaagtcagggtccccttatcttctgagcctgtacccctatatgaatggagaaggaagcaagctgtatggtctgcagaagtatttgactgactagtttggtattctgaaatttaaactcattgcccttaaacaatgtgctaatgttctccacatgttatgcaacagcaccactttgttttctgctgtgtttcctgagacatttgagttcttcatcttggctttttggtaatcaaagctttcccagtccagctgaatcctttctttctaggcctgtcagtacgtaaagtccttccctattccctgaggaataacccaaggtctctgtgcctttgctaggtctgtttcttttgggtagaatgcctctcctgctcctttgtccaacctaaccattttgtactcctccctgtaatctcaatttgcacatcacctctgtgaagcttttctcactgagtctgtcctttctactccctagaattagtcaaacctccctcccaatagttccttgccggtactccaaccatggtgtgtatgtgttgagaaataaacaagccagaaacaaacttagaagttccttaaaggtgtcaaccttaaataatgagattcaaaaaatatattaagtatagagtttattcgagtgcaaagtttgaggatagccacccagagacattgactccaaatgaatgcaacaagcattccaaagtagagaagttaaatttcagcagcatggcaacattttccatacacgaccagtgcacacacacatcacagtgatttgattggttacgaactgctacattctaaggaagattgctttattactccaagaggaagagtagtgagctgagggagtcttatctctggggaactttgttcttaattatttacagaaaataaaaaaggcagaagttgcagctgcatgccatgtgacttaagctgcatagccacattcctctcaaggctcaggataacttcaatttcaaacagctttaagtttgaattattttaagtttgaattatttaatttcacaaaggctacagccatgttttctctgctctttcctcaatgtgggatccttcatgtcattgaattctttattggacatctattatgtataaagccccaaaagataactgatgaggagttttttttatctcagagtaggatggaggtgtgaggccagggagcagagcctgctctagatgttaccacttttctcagggtgcttaacctgcttcagtgcggccgttgctaccgcccgctggtgcacttctgaggttattctccaccgtgccagaacctcccgccatcctctgctaggggaaagatgaaagagcatactatttactttttttagtctttatactttgcctcccttgataccaaaggatgggcaggagcatgtctgacctcctgatgtggatgttgcaattgggttgaggctgctggatttacttagtaccaaatgctctcttttgcctgacttcctgccaagcctaggtgcatataaccacttgggcggtggccacccccagtgatttgaacttataggacggtagaagtatgtgaatcatgttgcttcaagaaattcagttattctccaagttctaaaataaaatctggtggatgtttgttagaagctaggtacttaactcttcagaaaaaggaaaatctgaaagaaaaatatatttaaaagtggtctaagatggctgcagattggacatagacaatagaaactaggcctatgaattaaagctgaaccctcaccagcaaggctgcagtctgtcaaatatttcactgatatgtacgaattataatacaaccctatctatcagatatagcataaaggcaggataaaatcaatcatccctctccagaccctaagatgcccacatacttgctaaccttttaccctatataacttaaccagactgttgctttatcttatgtacaatgtctctgagcaccaatcagaattgtgagaatgtcacctttactttattacccctttctctcattttctatgtaatggaacacatgaataccgtgcctcatgtaacccactctgagactcattatcggtttgtgctaagtcagtgttttcaggggctatttgtcctcaaacttggctaaggtgaaattaactttacatttttaacattataatgccttttgtttcagctttcagtcaacacgtcaagggaaggaagaaagattaaatattatttatatacctgtgtctcagacaggcagaaatgtaggctttgggataagcgatggtctggagaacctggagggagagacaaagaaattgcaactctttgggcttaaacggaagcttcaattagagaagagagttgaaatggagagaatttctattgtctaattcaaggctgatgggcttcctaagtgttttaggctagaatgagctcacatttggagaatattctgagctcttcaataatacttaagatatattaggcatgatcaaatatgtagtcatttaaagatgtttcactttttttccctttcaaaattctattagagttctcaaatgcaagagctgggatagagagtttcttcatttctgcaaaatgaagaccattgaattatttctctctgtgatgaattaaaaaaaatgctgggtctaaaatcaaatcgtctgcaagtttaagactttgactagctcagattctggctatattagaatatttgagcctgctatcaagtataagaacatgtgcaggcctcctttttacctccttctatgagtattttaccttctatttcaaaatcaagaacaggaaatccaaccctgagggttccattcctggcatatttatgccccaggcagattgagagaataaaatagactttttacaaatgaagagatatcacgctttttagcctgggacaggaaactttagctgttgctaaggcaactgcagagttctggctcttaagctggctgtgcgaggagtatctcagagccccagatgcctctgctgtcactcactgtcagaccaagtgcaaaggacttggtagtgaactcacagaaacaatgagaccatttttgaattctgaaaagcaagtgaggactctcaagacaaagtatacatatggtacctgctatggtttgaatgtttttgttcccttcaaaatacacatgttagaaacttaatccccaacgcaacagtgttaaatggtggggccttgagggaggtgtttaggtcatgaggacagagtcttcatgaatgaattaaagccactataaaaagggcttgagggagtgtgttctctgttctgctcttctgccatgtgagaacacagagttctttctctccagaggatgcagcaacaagctgccatattggaaccagagacttaacctgccagcaccctgctcttgaacttcccaggctccaaaaccatgacaagtaaatttctgttctttataaattacccaatctatggtattctgttacagcagcacaaaaccgatgaacacaataccctttaaaaataaacaatggaatgatactatagtggtcgatacatgtcattattatttgtcaaaatccataagaatctaccttaccaagagtgaaccctagtgtaaactacagactttgagtgataatgatgtgtcaatgtaggttcatcacctataagaaatataccattctggtatgagatattcatagttggggaggctgtgtatgtgttgtttgttggggggcatatatgagaactctctgtaccttctgctcacgcttgctgtgaactgaaaaccactaaaaaaaaaaagtctgtttttaaaaaattgacatccttggggctgggagaaaaggggacaagtccaaagggctcaaagccaggctgcatgggaaagttgtattagtctgtagaacaataaacgaagaaaccgtgggtatgaaagacccaaagaacactctgatgctgataagaatgtcaggctgctgtctggttgagaaaataatttggcttgctcaggctggaaaaccagtaacattgggacagactgtctttcttgtggatgaaatttgtggatgaaatgtggaaacatgctgagatttgtaaaggttatgaacgagagaatatggccttaagaaaggtgatgttttatataatgatctaattaatgcagatatctatccatctcagccccctgccttgagccaggaaaccttactcctccatgtctatccagggcccagacactagggaatattgtgtaaccacttgagcagcgcctgcaggtactgctgttttgttttgctctcctgctgtttcctagtctctggtaaccatttttgttgcaactactactgtggcccttgcaaaacgaggggtgtgtgttgtgccagagagtaggtgatataaaagtcaaagcgagaatgaggcatctccccaataaagcaatcttgggaaacctgtggttagggctgcatatacccacgtccacaccttgctgccacatggggtcccttttactgctcaaatagaccagtctattccagtgtctcttatcttgaccttaataagtcaaggatgacctttttatgaagtatgtgcatgtggaaaacacagcggagcaattaaaatgctattttctgcagttagactgccagggttggcagttcaattctaccacttactagctgtgtgaccttaagcaaattactcagctgtgggtctcttgggttctttatctgtaaaatgagaataataatagcactgacctcattgtgagttgttgtgagaattaaatgatgtaatccatgtaaaatgcttagaacagtgcctagtacactgtaatcactgaaattggcttattgttgcactattggctttctggcttgcttttgtttaaattaaggcataactatcacatggcttgatataatgcacttgggaatggaaatattgagctacatgacaaggaacaatgtattctggtacagttatatcaagtttcaatttcataacacaactgaaaaaacaaagtttaaaaatgttgacatatttctaggtggttgcagtgacaaaaatataaccaacacaacagatttgaatccctctagcactaacacctgctttatgaaatatgttctatggcatgttttctttaagaggtcgagaagctttagatgataaattctgtcctataattttaaaaaagacagcagtggtgatacatcctgttatactgagaatggaaaaatcgacttcaacttggttcttgtactgtgtcttgtttttccataaggaggaggagactgtcctctaccaatttcatttatgcttttcttgagccaagactgtgcttggccatgcttgtgggttggctcttaaagtgacgaactggtcactgggaaattgtagctcctcctcgccttcccccggtgtgctttccttaccaatcaagtaggggaaatggccttctggattatgatctattggtttggaggtaggggtggagtgtgggtgaatttgagtcacatctacacttccctaggaagctgttgcttttattatggtattaggaactttacagatgtacatgctaatattaagctattcttgcttaaaaatattttattatattaatcattgtggaataatggtttaaaatgtttctgaagttactaaatgcctggatagaaatcaaacccaaaagaattttaaaaacacatgtaaaattacttgtctaagagaaatttctgtgatgatgaaaatgtctcttctgtgctgtgtaatatggtaaccagtagccatatgtgggtgttgagcacttgaaagtgagtagcatgactgaggaactcaatttgtaattttatttaattgtaatacatttgaatttaaatagccagatgtggctaatggttaccatatcggatagtgtaagtttaaaacataatgaaaagtcacctaacctaagcctcattttcttagtatgcaaaaggtgtgaattaggccaatggttctctcgatcttggcagtacaatgaagtcactcaaagaatgttaaaagagtactgatacttgggtctcctgctgtattagatcattttcatgctgctgataaagacatacccaagactgggtaatttataaagaaaaagaggtttaatggactcagagttccacatggctggggaggcctcacaatcatggtggaaagcaaaaggcatgtcttacatggtgggagaaaagagaggatgagagccaagtgaaagggaaagccccttataaaatcatcagatctcatgagacttattcactaccactagaacagtatgggggaaaccgcccccatgactcaattatctcccactgggtcactcccactacatgtgggaattgtgggagctacaattcaagatgagatttgggtggggacacagccaaaccatatcacctgcccaatattatttagttagtctaagtctagtcattgagattcttctaaagcctctcaggtaatcctaaagtacagctaaggttgggaaccatcactgaactagattacctttaggttctttttcagttctataatataattctatatatttagcagcaaattgtactaaatttagaattctataaggcaaataggacacttattacttaagccagttgcaatagaaaagtacatatagatgttggctttttacaaaggctgtttgtcctaaaacgtttctgaaacttaatgatataaaaccaataaaccaggttattgtgatctactcctctttggagtttttcctggctgtgtcagaccatggcttaggctatagacaaggaagagtctatgtgtatgtacttgtttgggatctgactgcagcctgtgtcaaggtttggccatctgcccataaacctgcatggggtgacatcactgagtaatccaagctgccagtttatggagatctcagtaggaggtctttgggctaatcatttagagcaccacacagcaactgctgagtttgtatcttccctgggattagaaaaataaagtttttggccaagtcattctctctcaaagctactatacaaatggttccagaaggtattcaggacagtgctcccaggatttttaaggcctgaaacaaatgtacatttcttctagctaataaattcctcaaataatgagtgaaataggtacaagtactcagttttctctaaaaacaaaacaaaacaaaaacaaaaaactatttggttttaagagttatactcataacaagactttgttttgttttgttttgtttgtctgtgggccttgactaattgatatagtgtttctgtatgagagaacaaaggactacatataggtcaaatattggagattaacaaggtgttgggggaatcacttttgtttgcctgtgtgcccaccctaatcttatcttgaattgtaactcccacaattcctatatgtcatgggaggaacccagtgggaggtgattgaatatgggtgggtgggtgtttcctgtgctattcttgtgattgacagtgaatgagtctcacaagatctgacggtttttaaaaacgggagtttccctgcacaaatttgcttgctggcaaccatgtgagatgggactttctcctccttgactttcgccatgattgtgaggccttcccagccatgtggaactgtaagtccattaaacctttttcttcccagtgtcgggtatgtctttatcagcagcatgaaaacacactaacacgctttaataaactgctttatttaccatcactttaaaataaaagagcagacaatggaccagtgtaacagaacagaatctggaaccagactccatatgggtttacacatctgaatgacaaatgtgctattataaatcagtgggggaaaggaatcctgggtaaatctcactgagaaaatgcttatctttacagaaaaagtaaaataaaataaaattagattcctacctcacaccaatacataaatcaattccaggaagattaagaatataaatgtgaaaaagcaaaacctttaggcaaattgtggatgtaaattattctccaactctcaggtcatacagataagacaaaaatatcagtgaaaaagactgaaatttgactacatgcaacttaaaacttctatacagtaagatagcaaaaacaaaacaaaaacacacacacacacacacagactgggaaaatatgcttgcaacacatagttgataaaaattgaaggctcttacaaagaaaaataataaggccaaaagaaaaatggcgaactgattcacacagagggtattatatttgccagtaaacataaataagatgtactacctctttagtaaccaggtaaattcaatttttaaataatatataatttcaaacttacaagattggcaaaaagaataaaaactgacaatatcaagacttggtaaggatgtggaacaatgggaactctcaaacactgctatttggagtgaaattggcacagccactttagaaagcaatttaacaatatcaggaaaagttgaaggtatgtaatagctataatccagcaatatttttgtagcatgtatcctggagaaaattttgcacacatgtgcaaggtgacatttatggaactactcattaaattattccttataaaagtaaatattgcaagtgaaattgccatcatttggaaaaatgctaagcaagatgtggtataatcccacaaattagtgaattacaactgtgtgtatcaatatggatatgtctcaacataatgttgagtgaaaactaattataggacaaacaaaatggtatttatataaaccttaaaacaagcaaaattatactatttattgtttacagggcttagatagatatgtagtataaaaacatttatggttgcattcactttgtggggaaggggatgagattgggggaaaacacagagggtttcaaatatctctaaaatgttttgtgtgtgtgtgtttttttttaatcaagtggagtggtaagttcacaggtcttcactatatatagcttaaatgttaaagtgcttcaccaaaaaataaacagcaggccgggcgcagtggctcacgcctgtaatcccaacactttgggaggccgaggcaggtggatcaactgaagtcaggagttcaagaccagcatggccaacatggcaaaaccccatctctaccacagatagaaaaattaaccgggcatgatggcaggtgaccagctactcaggaggctgagacataagaattgcttgaacccaggaggcagaggttgcagtgagccgagatcacgccactgaactccagcatgggggacagagcaagactctgtctccaaaaaaataaaaataaaaataaaaataaaaaaataaacagccataggtagactatctcccaaagaataatcaatgataagattttgttgattaaggaaagaaaaccacaaactcacagcttaagaaagcgtacaatattagacaatacaacacagttattgagctcatatgtgtagcagatgtgaacctctgcccaaaattaaggtatgcaggaaataattcttttttagaaaaatattttaagttttatttaaggttcaggtgtacatgtgcaggttcgttacacaggtaaacttgtgacttgggggtttggtgtacagattattttgttatgcaggtgctaagcatagtacccaacagttttttttcttgaacctctccctcttcccagcctcctccctcaagaaggccacagtgtttgttgttcccctgcttctatccatgtgttctcattatttagctcccacttataagtgagaacatgcagtgttttgttttctgttcctccattagtttgctaaggataaaggcctccagctccacccatgttcctgcaaaggacatgatctcattctttttcatgactgcatagtattccatggtgtatatgtaccacatttcatttatctggtctacctttgatgggcatttaggttgattccttgtctttgctattgtgaatagtgctgcaatgaacatacacatgcatgtatcttaatggtagaatgatttatatacctttgggtatataaccagtagtgggaatgctgggtcgaatggtagttctgtttttagttctttgaggaatcgccacactgctttctacaatggttgaactaatttgcactcccatcagcagtgtataggcattcccttttctctgcaacctcaccagcatctgttattttttgactttttaacaatagcctttctgactagtgtgagatggtatctcactctcgttttgatttgcatttctctagtgattactgatattgagtattttttcatatgtttgttggctgcatgtatgttttcctttggaaagtatctgtttatgtcctttgcccactttttaataggattgttttttgctagatatttaagatccttatagattctggatattagacctttgtcagatgcattgtttacaaatattttctcccattctgtagcttgtctgcttactctgttgatagttccttttgctgtgcagaagcgccttagtttaattgggtcccatttgttaatttttgcttttgttgcaattatttttggcatttttgtagtgaaatctttaccagctcctatgtccaaaatggtatctcttaggttatcttccagggtttttatagttataggttttacagttaagtctttaattcatcttgagttgatctttgtatctcgtgtaaggaaggggttcagtgtcagtcttctgcgtatggctagccagttatcccagcaccctttattaaatagggagtcctttccccattgcttatttttatcagcttgtcaaaggtcagatggctataggtgtgtagctttatttctgggctctgtatcgatttcattggtctatgtgtctgtttttgtaccaacatgctgttttggttactgtagccttgaagtacagtttgaagtcaggcaatataattcctccatctttgttctttttgcttagggttcccttggttatttaagatctcttttcgttccatatgaattttagaatagtttttttctagttctgtgaagaatgtcattgtttgataggaatagcattgaatctttaaattgctttgggtagtatggccattttaacaatattgattcttcctatccatgagcatggaacgtttttccatttgtttgtgtcacgtctgatttctttgagcagtgttttgtaattcttattgcagagatcttttacccgccctggttagctgtattcctgggtattttattatatctgtggcaattatgaatgggactgcattcctgattttgctttcaggaaataatttttaattatagtaaagatcaacctcttttctgtttcaagtccctattcaggcttcagtcagttgtaagaaagaggaaactgtttggtttgaagtgtgacctatcctggtgaacacctctggctctactcccctggctggcctgactggctttctgttgttgattaccacaagccatgccctgaccatttgaagggctctctatgttctttcctagccatgctttgggagcagaaatgcttctgtgagaatgtctgccctggccttgactgcctgggcagaggtaggatagtacacattcactgctatttaaaaaatatgactctgccatatgagggagtttagaaagaaaaaggatatatggggaaaaaaagtagctgcttaagaaaatacagcaaaagttagctgatcaataatatttaaaagagctcacatttttttgaaaaagaaaaagcacacatgcaagatagctaaaacatattacatttcaactccatatcttgttagaaactttgttcctagcaggtaatacatgatatagatgtgaactcaaaaacaaatgttttggaaaataggcagatgcattggatggtcttcagattcagccagaatagttttcccattcagacaggattaagaagtgggtattgctgggagcagacctacttgaggatgaatgaggctctgggccttagaaagttctactatttcttgccaggtcccaacttggctgctttgtaagaagtggacttctgcctcctcagcctaacctgaagaatagaaccaggtttgtcttaaggagtttggtatatattcaggcccctcttggtactttagattctatctactttttggtatctgcatatcttttatgacaggagactaatttcttttttgttattcacaattggagatatctttaaagacaagtacctggtgaggagataaataacatttgctaaaacttattcttactcagccagtgattttccaagtgtggtccctagaccaacaacacaagcatcacctggggacttgttagaaatgcaaattcttgggctccatctcaggcctccataatgagaaaccccagaggcccagcctgctaaaatttgggaacatatgaacaatcaaactaacattttctcaaaccaaaccaaacagttttctctttctcgcaactgactgaagcctgaatagggacttgaaacagaaaaggagttgatctttattaaaattaaactgaacagtcaaataaacagataagaatagtaactcttctacttcccagccctctcatgcttcctagtcccaacttgattggagataaaaggtaatagataaagcagaggagctttggggctagaggacaaaatgtagaaagcacagaagtagtgttagatggtgttcagtgggaaccatgtgtgaaggcacacctatccttggttgctcagtggaacagtgttgaagccaatgttgccatttgcaatatgcaaatgcataatttgttgaacgactgactaagcactgacaacctgtgtgccaaatacaagagaaacatggatggacctcaagagtctactgggagaaacaggtaagtaatcaagcagttacccttgtagctcgtgggtcagtgtatcggatcctgggaaagccagatgaaggacccataacccagacttggggttcagggaagggcttgagacctaaagcatgagcagctgtcaggtgaagggagtggggctcagggtttagctttcactgagtttttgttcttaataaagaagctctgtttccagatgatttattaatctctgtcattgcactccggacattaaaaaatacccaagacatttcttaacttgtcaagatgtgaaatataatgagcataacaaaacaagtcggctcctgatttatttgggcccttgaggcctccagtttggccaaataacctttcacctggctgtgaacactacattttagatttgaagttacataggaaattacacccaccaaagtcaccatatgtgataaaaaatattacaggatctctttgtaaagaagttacaaatcatggttgcttttttgataaatgtttctagtaatgagtggtagtatcttcaatttattcaaggagagttttgttgaatgattttctttgacattcattgaatatccactccctgccagatgatactgagagataaactaatgccacacggtcttgaaagaagtcagtaattttttttttaaatggtgttatcaataagtaataaggcccattccaaggccttacacatactagaaggcttctgatacacactaggccttattgtcatcacttccttctcattctttccacatagcttctttcgtggcaattttcccccaggagggatttccctgcagtggacctcctccccagtggtaccttcagccatcagaacacctcgctttagatctgtgggtcccaaatttcatcaaatccaatgaccatttctatggtaggtactttgctatatacacctttgactacctggaaatgaaataattataactactttctttgtatgtatctattagatttccattggtgtattacattaattttttaaaattttgtgcaaggagattttctttataaatttcagtatgtatagtagaataaaacctcactagattaagatacaatgaagttatggcactttaatatgtttgtagactcaccttgaatgctgcagctacaaatgcagattgaaaattgtgtttttctctaattgtaaccagcttggtaaaattcaaacaaaacaatgtatgatagtccctcaatttatatggcagttgcattcctggaaatttcagtgagtattaaagtcatacacaaattctttccttctttttctttctttctttcctttttttctttcgctctttcttttctttctctctctttcttcctcccttccttctcttctgccttcccttcttccttctttcctttccttttcttcttttcctcctccctccctccttcccttcctccatttctccttccttcccttccttccttccctccttccttccttccttccatccatctttcccttcttcccttctttctttccataaaagaaaacataagccctttgcctgggtaattataaacaggtttctcagcaacatgaatgctcttagagcattacagttcccacacagttattctctgttgtgtggaaccatccctttcagcacaggcagactagcatctctggcccttggctcacaaagactccccataatttccaaaatgccttccagaagacagtgaaaaccatcttccccacacaccttgaaaaccattattctagaacctagatggattttatcttcctttttctcaaaccaggcttgcagctagcagccaaaatagaaacacctgaaactcatttaacacaaatgtctttgactgacaactttatctctttcttccagggataatttacctcttgctagaataagtgcctaatataaggtagaaaattatagaattctaaaatttagcagcaattttgataagaagaattttgcctgcagaaccttccaagtcgcctcttgccatttgttctacctacaaagcacatgtgaggcccagaaggtggtttttcatgcctttaataaccatctgggcagcagcaggaagttactgacttttaggaagatgacatagaccttaagctaaggcacctgggctagctcaaagaaaggcaaactgtaaactgtacttaaatatgtattcattcagggccccaagggaaatagcacactcaagttaggataattcaaggaggtactaataagggggttgtttagaaagctatgggtagggtgaggaaaaccacagcaatagtgcaggactttaagagctattactatccttgagcctcaagggataggggagacaggagttcctgaaacctcttaaaaaaaaaaaaaaagcactcatagctgggcgcggtggctcacgcctgtaatcccaacactttgggagttcgaggcaggcggatgacctgaggtcaggagtttgagaccagcctggccaacatggtgaaactctgcctctactaaaaatacaaaaattagctgggcatggtggtgtgcgcctgtaatcccagctacttgggaggctgaggcaagagaatcgcttgaacccgggaggtggaggttgcagtgagccaagattgcaccactgcacccccacctgggagacaaaagtgaaactctgtcttaaaaaaaaataaaatcactcagggcagagcagctgccttgagaggactcatgtactttatggaaaaatgcagttagtccgaggtgaccctacatgaagggagttggggaactctccttcctccctctgttcactattggagaggagaaagccaatgggaatctagaaggcaaggaagactgttgatgtaggtcacggaggtccacctcctgggcagggaggagggtggagaaagtggagagcaaacctggagggaaagcagctaggtatctgttgtgctggacgttttctaacttcttttatggaacttctggaatggtagcccattgttaattgatagtcttaatcttgccccttaaggtaaacatatttacctacttttaacatgtatggacattacccagttgaatgtattgtgcatagtgtacaattatgtttgacaaatgaaaatggagcaaactgtgcttgagactacaggtcaagaagatgagaagtgtctggtcttggccacagacacaagacgatgaatagaaagtcaccatttgaaaagcattgcaataagaagtaaatgtgctgccgcagtggcgccaaggcctaccaacttcagaagttgatctgctgcaaatgcggccacactgacaagagcaagagaaagtataacttgagtgccagggctgaaagatgaaatgccaccagtactggtcaaatgaagcacttaaaaattgtacactgcggccgggcacagtggctcatgcctgtaatcccagcagtttgggaggctgaggcaggtggatcacctaaggtcaggagtttgagactagcctggccaacatggtaaaacccagtctgtactaaaaatacaaaacaattagctgggtatcgtggcgcgcacctgtaatccctgccactcatggggctgaggcacgagaattgcttgaacctgggaagctgaggttacaatgagccgagattgtgccactgcactccagcctgggcaacagagtgagactctgtctcaaaaaataataatgataattgtacacctcagattcaggatgaattctgtgaaggaacaacacctaaacccaagaaggcagctgttgcagcatccagtttagcttcagaacgtcaacaattagtcatgcaaataaatgttctagttttaaaaaatagaaataatcctggctaacatggtgaaaccccgtctctactaaaaaatacaaaaaattagccaggcgtggtggtgggtgcctgtagtcccagctactcaggaggctgaggcaggagaatggcgtgaacctgggaggcagagcttgcagtgagccaagattgtgccactgccctccagcctgggtgaaagagtgagactccgtctcaaaaaataataataataataactaaataaacaaataaaaataataaaaataaaaaaataaataaaaaacaagatgcaaagtggagttaatagaaaacagttctaggagattactgttaagactcagactatgcactgatgttcagtccttagtaattggtggcaacctggtggagagggaagaccacaggctgtggagttggacctgggtttgaagattggctttgcatgcctagcaggatgtaagcttggcccactgacttcacttctgagccttgttctccatgtctgtcaagtgcaggggaagggttagtgaaatctatcttatatttttatggacactaatgagattgggaatgaaaacgagatgcccataagcatcagtgcatcataggtacttggccagtggttctcaaagtgtggttctcagaccagctgtatcaagattgcctgggaatttataaaggaatggagattctccaggcccagcaatcagcatactaaagcttgagaactgtgttagactttctgggatctaacgaagaaggcaggacagattttgttagatgtattacacaaggggcaggcacctgtgcacaaaaagaccccacaaaaacacagaaaaaaaacacagaagaggtgctttttgttttgctctctgtgtgataagctaatctgataagtgagaagtcctgttctttctataactgggtaggtaagtctaatttggaggtcaagtattgaagctcattgtagccacatgtctaggccacctcctccaatttagcttctatcaataataaagttaatattttgatctatttgtttgattcttgcattgcatctacttttcaatttgttctggtacgggagagaaaaggagttcttttaaaaattatactctgtggctgggcacagtggctcacgcctgtaatcccagcactttgggaggccgaggtgggcggatcatggggtcaggagatcaagaccatcctggctaacacggtgaaaccccgtctccactaaaaatacaaaaaaattaaccaagtgtggtggtgggcacctgtagtcccagctattcgggaggctgaggcaggagaatggcatgaacccgggaggcagagcttgcagtgaaccgagatcgtgccactgcactccagcctgggggacagagcgagactccatctcaaaaaaaaaaaaagaaaaaaaagcaattatatctgtgatagcctccaaaattaccccctaataatcccaattcaggtattcccaccctcccttgtggttccagagttagtttgtgtgaccagtgcaatatgtcattagacattaggtctctctgtctcttatagatcactcattctgggggcagccctctggcatgtaatgagcagtcctatggagaggcccatgtgacagtagccatgcgagtgacactggaagtgaaacctgcagctccagtcaagcctttagaagactgcagccctggctgacagcttgacagcaaactcatgagagactctcagcttgaacaactcagctaaactgttcctgggttcctggtcctcaaaaactgtacgagatgaaaaaaaagtttgtttttttaagctgccaagttttgggataatttgttattctaatatattttttaatacctggaagtaaggtgctaccataataaatacctaaaatgtaggcacagctaggaaactagacagtggaggtagctggaaagaatttaagaagcatagcagtgaaagtctcaggagccttgaacaaaacattagaaaaactttggactttgaccaggctgctggtggaggtttaaaagaaagtgagaaaaatcttgttgaaaacagaacagggaatccttactatggagtggcataaatcttagcaatattgttgtctgcaataatgtgggtggtgggaatgtacctggtaaactgggtgatctaatttgctattcataaagacataaagattctcagcttttacagatggtgaaaaatgctaaattaagaaatggctgaaggacagaggtcaaatcctgggcaccatcatgaaaacataatccaaagatgaagctgagatgtgactataaatcctttgttatgacctcagaaagatcaaaagtggtgcctcagagtaccagtttggtcacacaaaggccctctaaagtttttaaggctgtgactcacagattctttcaaaaacagggctcctgagaagcttaagagcatagtttttcagcagaatcacaaggtgggaaagggattatctcaaaaagatttttgggcgtgacttttgtctaatggaatggacccccaaaaattcataggtgattcacaaattttttaaaagaattatattagtagaaacattgccaactagaactcaaagggatagagacagtatgaaatgaaaaaaggccttggtactcactttgcccctgtttcactgcaggttaagaaaaaatttcagctgcatacatgtactaactttcatgaaaaagaaagaatagctaagcatggtgactcactcctgtaaccccagcactttgggaggacaaggtgggaagaccacttgagcccaggagtttgaatcagcctgggcaacatagcaagactctgtctctttttaaaaaaggatgactctgaaggggaagctaaaagcctcagagaataactcatgcgtagaaataggactaaatcctaaggcgattccaacatttgcctggctggatttcagagctgctatggggacatagtagtgtgtccagtacctttcctttttgaatattaatgcatatagtgtttattcctgttccaccattgtgtgtttggggtgtgtgtgtgtgtgtgtgtgtgtctatgtgtgtgcgtgttagtttcagattgagaggaattatacccaaggagctagagttaagaaattatacctaaggaacctcttgtgtacctggtcctgatttaaatgacaagactctagactttgagttgatgctgtaatgagacaagaattttagaaatgttgagatggagtggacgtgttttgcatgttggagggacttgattcactggagcctagaaggcagactatggtagccagccctcaagattgtctcctcctggtattcatacccttgtataattcccctcccacattgtaccagaatttatctgtgtgacagaatatggcagaagtaatgatatgtcacttctgagattaggttataaaagacattgtggctaccatctctcatcactcactcaaagggaagccaaccaccatgcaatgagaatctcaggtaatgaggacctgagacctgttgtcaatcacgtgaataagcttgggaggagattctccagccccagtcaagcctcagaagacttcagccctaggtgacagcttgatgataatctcgggaggcagaaccacccaactaagccactcctggattcctgaccctgaccctgaccctagaaacagtgtgaggtaataaacgttgttttaagctcttaaatttgggggtaaatttttaggcagccatcaataattaatacacacctctaatgtatttgtacttacaccacataccatgggatctcacaaaagagcaattttaaagcttgcttggatagccgatatctttattttcagaacatattcttcatgcataaagaagcaaagactctttccttcagtataatccttttgatagaagcgaaaacttaagtctggcagttttcctaatatatgtttttcacacttttcctttattttaggcaattctaaatagacaaaatcaacttgagagtgttcttggatttaatttagaaacaaccccagttaagcttttcataaaacttttaaattgggctggcttttattttaggaatatgaatgttcttggaattcttccagatctctaagcaataatcttttacgcaatcccctttattttgttatgaaaaaagagcctaggtagttcttttaaggtttacttttttgtaaaggtatctttaaaacatccagatgcctctagacattcaagatagaacgaggcactcacaacttctatctgcctatgtttcatctatttttctatgctgttgtgtgaattttgacgttttattttgtcaagaatagtggtgaaaaaccaatgaatttttaagtgattgagctctaacatttcctacattctccttccagaaagtaaatacacagtaattatcattcattattaccttctccatctgacaactgcctttcacccctcaaattattgtgcatttcacattcttttttctacctaggactaatttgtccaatcaaccggacatctgtttttcttccccttttttgaaaacaggctgcttctatgttttcagggccttcctttctagaacatgtaagaacttgttctcagactacttgtaagcaagacactctctgaggttacaagtctggaagcactttctgagaacaattaaaagatctgtctgcctgttagggcgttccatgggaatgttacactctttggaagaaagctttgtgtaagcaacagtcacttctacatagacaatacaaatgtcacttcatttattaacattacgtgtctagatgattgactgcccttggaaaaatatatatggaatgaggcaagcttattaaaacctaaataactctgaagatctcttacttggtctgtaaactttctactcttatagctcatgcattttcacaggaaacaaaagcccttaaaggccaaatttccacaacaaaacagtgaatcttttcaggatataatccttcaattctttcctaagtacgtttagataatttttttttctttttttttttgtttttgagatggagtttcactcttgttgcccaggctggagtgcaatggtgcgatcttggctcactgcaacctctgcctcccgggttcaagcaattctcctgcctcagcctcccaagtagctggaattacaggcatgtgccaccacacctgcctaatttttgtatttttagtagagacgggttttcaccatgttggccaggctggttttgaactctggaactcaggtgatctgcccgccttggcctcccaaagtgctgggattacaggggtgagccaccgtgcccagcccttttagataatttttaaatcaggaaatatatgatggtgatgaccacatgtgacaccccagccatgaataagttcttggcctttcttttgactttagcctcattcttccccttattttctttttcctactttcttcacctacttctctgtttctccgtttcccttttctgaatcacgccatgatgccgtaaaggaatctccttgggatctggtgctggatgcagtctagggggtgccctttgtcagaagaggctgagtggaaaggaaagtggccataagcaagctggtcagttcccaggcaaccagggaggaaagacagggtaggaatctgaggagcctcaccagggaagccccaggccgtgggtcccagccttttgccttgagcctcaggagagctcccatgaggagagctagatccaaggctccactttcctttcagtgctgtgtttttaaactctcctcatgtctgattaaatgtatatgggcagctatattggagaggaactaaagggctctaggagtttctcaccaggttccttttgtatctcttttcactagcagaggtgtctgctatgggtaggattccctctggggttccctttgaccaagcttctgcagccagaagcactgaggagggcactggggtgatgggactgaccctgaggccctgatcacaggactcctaagtaggagttcctctgaggagatatgctaggacctggtttatcaaaccagcaatgggatatctggaaaagccgctggggggctgccaggactgcttctcaacatactgtgtgttaacctgcattaacactgcacgaagcaggaacttagagttttctgagcttggctcagtttgtgtgtaacaaccaggctgaggtttcaggggtggctccatttggggtttaacctgcagaccagaggagggaacaatgaaagactagttgtgtttctgtgtttctgtggtctggaagaggaggtgaagagagcgtaggacaaatcactgagtgttcatgtcaaaatatctgcagactgctcagcttggttgctgttgagctccctagttcagcagcagcaggtcgaggaccaacacttatcctcggataataatgactactatttattcagtcctcccatgtgctagatgacatattaggtgctttatgtgtacaaccttagcaatcctttaagagaggtgatattcccatttgtcaaattttagaaagctagttagacagtccagagaagattagtggtttgttcaatgttaggcttccaataagtggccaaaattttaactttggtacacagttatctttgctaagacatcatatgcattcctaaaaaaaaaaaaaaacactcttcagttagcaatatagtatacttaaaataatagggcttatgagaaaaatggggttggtgttagaattaggaagtaaaaaacctgagagtgtaatacaaatagaaatactagcatggctgaatctctgtaaacatttgcctttagcatcacagacagccctttgcagccttatatcctggggctcaggcttcttgtaggtccttggggcattcactgccaatagagaacataggcatcgacattagaattctgatctagggtttcaatacagagggatgtctcttcaaagcatcttcaactgcactcacagcttcaccagatagtttaatataatagaaaacttagtggctggtttaatggcttcaagaatcactacctcattgaaggtcttcactgtatggaatatacaggtttttccctaacgtactcatatatttcttagattttcttcctcccagtaaaaaaatttaccctgatcacctcaaatgatgggttggcaaaaatcgcatattcaccaccacaacttctgcatcatgatcttcagtacccagtttacctgtcacttatgagatactgttgcatgaaaggaaagaaatgctgcttcagatagaaccagactgtttcagagcccatgtgatttcttttgtgttctaaagagtcctcattggccttgagggaagtttagacaggctggagcgttgataactgatagactattttttctccccacgcaaccaccatggcatgatgctactcaacaaaatgtacagtggtttttttcatttcatgtaataccgagactatgttaagattttgtgatagtcaggccgggcgtggtggctcacgcctctaatcccagcactttgggaggctgaggtgggcggatcacgaggtcaggagatcgagaccatcctggcaaacactgtgaaaccccgtctctactaaaaatacaaaaaaattagccgggtgtggtggtggccgcctgtagtcccagctacttgggaggctgaggcaagagaatggcatgaacccggggggcagagcttgcagggagcagagatagcgccactgcactccagtctgggcaacagagcgagactccatctcaaaaaaaaaaaaaaagattttgtgatagtctcaaatgctttttacagctggtttgttcaaattaggatccaaatatggcctaaatattacatttgattattatatctgctatgtattttattctatacccttctgctgttttttaatacagttgatttgttggagaagtccattcttcataccacagagtattccatatttgaatttggctgattgctttctcatgatggttttaaaaagtagttcctttattcctcatatttcctataaacttattgttagatctcgaaacatgttcaatttggtatgaatactttgtaagtggagctttatagttcctatggcattgtatcttgaaatacaatgtcaaggcctatctaatttgagtgatgctaaaattgatcagtgtattaggaagtggcagctggatccctcctttacaatatttatcaaccattgattatcctagatccatagtatctcactaaaattgaaagatagtgattttctaagcctatcatttcttctgcatttgttagctggaattctgtgaagcacatgacctcaagtctttggataaatggaaacgcagcttatgccggaaaggtaaaatcttgattcttttcttttattaattttgagagtaggccaggaacagtggctcccacctgtaatcccagcactttgggaggccaaggcaggtggatcacttgaggtcaggagtttgagaccagcctggccaacatggtgaaaccccatctctactaaaaacacaaaattagctgggtgtggtggcgtgcacctgtaatcccagctactcaggaggctgaggcaggagaatcgcttgaacccaggaggcagaggttgcagtgagctgagatcacactactgcacgctaacctgtgcaacagagggagacttcatctcaaaacaaacacaaaaaaaattgagagtagagttggtgccctagccaactcagatggtgaccaatgcgttgatccctgagtattgttgtgaactactgaatgtttatatatttatgtttcaagcagtgatattgttccttttggcttgaattgtcacaactttgccagcagaagccttttcagtttaggtcctgtgtacttttgacatgacctctttaaagtttgattatttccctgctttctggcagaaaattatgtcttactcattttgtaaatgtcctgatgtggacctaaaatcaactatttctcaaaaggaatttcttttagtggagaatgatatttaaaaatcacaattcaggcactaaaggggattttactcttgaacaagagctgattgcaatcacgtaggtttttcttggtgccatttcaattttctagctgtgcactaatagttataaatgtttttcctgcaaattctttgagagaaaatatcattattgcaaatataaaacttggtattcttgactccatttttccttaggaaaaatttttttctgcttctttgataacataaatattctttagaaataaaactatttagtttagccaaatgagtagagaagtgaacgggtagaagtactagggaactaccctagatatttcaaaatgctcaactacaaggttttggactcagaagctatgcttcaaaatttgtttctgttttcaagtattaacaaatttaaaagcataaacatttgttcattttttggtaggaaccttaatgttttccattttgtagattattttaggtatatggatattaactattttgtttctatccttggttcagaaatctgttcattttatttgtggctgtcatttgcaattctttaaattaacacatgaaaagagatccaattccaactttattagtagacaaatgatatgcaaattaaaacaagaatatttttattacaacaaattagcaaagacctaaaaaattatactccattccaggaagttttaaatgacagtctcacttttttatgcatgccctgctatcaagtttctgggttttgggtttttttctactcgatatgtctcccattttctcccttcctcaattacagtatcagggtccccctcaccatgccctctattctgacctgccagggttgaacagacacaaagatgcccagcataaaattcaggagcccatgaattattctctgtaaagggccagatagtaaatatttcaacctgtgagagctaagcagcaaaatcaagatattatgtaagtgctaagagtacagtagctcacgcctataatcccagcattttgggaggctgaggcaggaggatttcttgagctcaggagtttgagtctagcctgagcaacacagtgaaacaccatctctctcactcttaaaaaaaaaaaatggtagcttgcacctatagtaccagctactcaggaggctgaggcaggagggtcacttcagcccaggaggttaaggctgcagtgagccatgatcatgctcttgtattccagcctggacaacaaagtaagactgtatctcaaaaaataaataaaaaataaatataaaatgtcaccattaaagatgtaaaaatctacttttaggttggggagctataccaaaataggcagcaggctatatacagttaccaacccccggcttagatactcctcagaaaggacttattgctcagctgagaggaggagtattatctaacagcccccagcaatgagtttcatcacggtccactcctcaacccaccctgcccctcctctaaacccattccacctctcccagtcaatgacggagagaggcctggtctcctgccgacagccagcaaggaaaagcaacctgagtcctatagctgtaaggaacgacattctgccaacaaccagaatgaactagaaagtggattcttccccagagtctcaaaataagagtccagctcacaccttgacttgggctttctaaacagagaaccagccaaattaacccagatttctgaagtatagacctatgagatagtaaatgggagttatttttagctgcaaagtttgcagtaatttgttatatagtaatagaaaattaataaactgagaattgtagtttgcagaggatagcccctgtaacatggaacagacaggggaaagacaatgaatggatctgggagcaaataagccaatggccagacagaccttatcacaactttgttttgtacatcctttagcctagatgtttttggcatgtatggctcactctacgttgtctcaatgagtaaagagatttatttgtgatgatgactgggatgttagggatttcggctaattattgttagttttattggagaaagactttgttaattggtgaatggctatgtgagccttttctttctgtctgattctctcccctctgctgtggtgtttgcaattgaggaacagctactaagaggtggcagctgcagagaaaagtccagagccatacagatgaggctgggaactctgactagcactgagtatttgaaagagagcttggcgaaagtctgttactacatgtagcagatacctgtgactgcatatagggagtgaaggagacagccaaaagtgcacttgaggataacaaatggccagcccctacatgatcactcatgaaaatccaacagaacccagaagtctcacttagctttaaaaaatccattatttttttcagacagaagcacttagggaagcaaaatggcttatttcagcatgagaaagcaatgtaacagtacagctaagctttgagggtctcctgatcaaaaatttgtgagactaatagcttacacaggaaagagatgatagcccttttgaatgccttctgagcgctcttacgagatgcgcaatctaattgtggtgtaaataccagctattgatggtgggttttgttcatcgggtttgtgctaccacagtaccagaggtctgtatctattagtgctagtaatgtatggatgaccagggctggtgcagacatctctgcagcaataataaaaggtaagaagatgcagacaaagctgaatttattgtgtttgagaagatatagaattcaatttccctgataaccaagcttaattgcacagaattatgagagctcattaatgaaacccaatatagacagtttatattagtaatggcattacattgattatctaatttcagagtaaggaattaaagggggccaaattagggattattctgcttttacgtaacacctgtagtcaggaaaaataaatagctcccgttattaaactaaagcttttgtatacaaaagaatgctagataataaatgtagaaataatgatggaaatagaaaatatttttgcaagacattatgaaataatcaatccaaacaaggatcaataatgaatgctaaaactgttagttgaacagtcaacagagaaccagatattcaaaaagcaccaaagtatcacccttaaaataacaagtaatttgctattacttgtttatagcaaacggaggaaaaagtaccctttaccatggagaaatatggctattatcactaggtaacttactatctgattgtcccactattaatgatgctgtgtgacttctgaggtaatgctttataaattatatgacagcacctgtcaataatatttaagagataatgtttaagatggaaatggaatctaaaggctggattagattcaagttaaaggaaattcaaagcagagaagaacaaattaaggtacacttgaacacattcagaatatgggacagaataagacagctgttctggtctcaaaaaaaaaagttaatgacaaggaaaaaaggaagaggagctaggttaagggactaaacaggcaaaaccaattcaacatgggattcttgagtggattttggtttttaaaaaagctttaaaaacactttgggttaatggtgaattttgaatatggaatattcaaatatcaggcagggtcctcgcaggaaaccgatggcaaactcaaaagaacttaatcatgaatcagttaaagaagggactattgagggatgtaggcagagctaatggaatcaatagggggtgctgaggcacccagggcgcagcagggaagctgtcaccaactgctgttagacccaaaggagcaggcatgggggcagttatgagtgtctagtcacagctggagctgctgaacagagtacagcttcacaagggatacagtggcagatgcagccagtaccggacaaggaactcagcagggaggagcagagagagtatcccagccactctcccaccctctgatctcttgccagggctcaccattggcctctgatgccttgtaggtgcctccagttggctgaccccagttggagtcctggccacccatggcagtctgtagaaataagccttttggagctgagagcaaaacagaaaaaagtggagaatgcatctggaggtagaaggcaaagggagaataaagcacgacaagtacagagtagattagagaattactgttgattgttagatgtaattgtcttgtgagatcagagaatgctcagtttttttgttttttttttagatgtacattgaactattaaggaataaaatgtcataatgcctcattcattctgaactgattcagcaagagagacagatagataagtaggtagatagactagatatacaaagcacatatagacacaagcttttttcttatttattgctaccaacttcatgcatccagcctccaatcgtgtcatgcctaaagaaacaatccctgcccccgtttcttagacccagtacctggcacatgataaacgataaaaaataagttcttacccatgcatccctttttcagtgggaattatacttcttggctgccccctacacacttctattataaagaaatttatattgttatattttttcaccacaagaaaaattatcaggtttaaagagggggattaactaatgataaaggtgtaaacagtgcaagaagacttaattattcttagcgtgtgtgtggctaacaacagagcactaaaatgagtgaggcagaaacagataaaagtgcaaggagaaatagataaatccagtatcatagctggagaatccaacacaccttaataagaaatggacagatccagcaggcaggaaatcagtgaggacatagctgaactcagtagcagtaccaatcaactagatatgattgatatcggtagactgtttcaccttacacattcttctcaagctcacatggaacattcaccataatacaccacattctaggccataaaatgcaccttaacagtttaaaagactagaaatcacacatctgctttcagaccacattgtaattaaactagaaatcaataacagaaagatagaggcctcagctcctgctgatgaaaaaataataactgaaggatagctagaaaatcccaaatacttggagattaagaaacactcttctaaataatatatggataagaaaaaaatctcaagagaacttaaaaaatgtttcaaactaaatgaaaatgataatacaactcattaaaatttgcataatgcagcaaaaacagtacttggaaggaaatctatagcattgaatacataaactagaaaggaagaaagatctacaataatctaaacttctattttagaaaacttaaaaataagagcaaaccaaatgccaaataaggagaagaaaagacaatgaagaattagagcagaaatcagtgaaatggaaaataggaaattaatagacaaaatcaaaagttagttctttaaaaagaatattaaaattggttactctctaggccaagaaaaaaagagaagacacaaattagagttgtcccatgatatccctggggaattgttccaggacccaacatggataccaaaatttatggatgctcaaatctcttacataaaatggcacagtatttacatatagcctacacacatcttctctcatgctttaaatcatctctagattacttttaatacctcacacaatgtaaatgctatgtaaataattgttacaatgtactgttttaaaatctgtattattttattctatttttatttttgcttttcaaaaaatacttttgatccatggctggttgattttatgaatggggaacccatgaagatggaaggctggctgtactaatatcagaaatggaagaggagagacatcactagagatcccatggatattgaaaggataataaaggagtattatgagcattgttatattttatgtctcctataagctgtaaattcctacatagcaagaattctgtcttactcatcctttaacaactactgtgtaccttataatgtttcataaaatattatgatttggttttattattcacaaaagaatgctataagaggtgaaaaatggagaggctagaaagcataaaaacaagttacatcaggtggtagagcctggtttaagggtcaaagataaaagaagggaaggttaagggcagggctttagagggagagaggataaacacagtttgattaaatggctgattcagccgggtgtggcggctcatgcgtataatcccaacactttgaaaggctgaggcaggaggattgcttgagcctaggagttcaagaccagcctgggcaacatggagaaatcctatctctaccaaaatacaaatacaaaaacaaaaattagccaggtgtggttatatacacctgtagtcccagctgcttgggaggcagaggtgggaggattggttaggtctaggaagttgaggctgcagtgacctatgattgctccactgcactctagccttggtgacacagagagatcctgtctcaaaacaaaaacaaacaacaacaacaaaaaacatatatatatatatatgaggtttatccacagtaaagttcagtctagggttaataaaagattctagggttcactaagacaaagagtagtcgcagtagcagagccttgggtgaagctaaggtccccaggagatctgggatgtctgtgaggaacagtgaggcttagtcattcagacaagccagcagaagtgaagtttagagaatgtggatgggcctcaggctctagacatcaaaacaaacagatagaaaaggcagagtgtagaatccagacagtgaggctcacaacaaggtatgcaattctgcataagcagatttgaggggacaccaactatggactgatgtagataaatatttctggtaattccagttagtgattcactctgaactcacataggatagtatctcttcaaaggcacttgtgttgtaattaaatgcacacataagacataatgcttattgagcccttagcatgtaccacccactcttatgcatactatatgtttaaaccatttaaactcacaccaaccccctgggggtaggtagtattattatccctgttacagataaggaaagtgagaagtaggagttaattggtctcatgatcccctacaggctggccttccagaaaaaggaggtaacttgccccaggataccctggaaaccaatcagaatgaattgccttaaactctggcttgtagcccaaagcaaggcttgcccacaagtcttgccagtatgtggttgaacagaaattagaatccagacagcctgagtccttttcttgccaggcaggggctggggcttccccaaccatgaaagttcaggtggtagatcctgccactgctttgcacaccagctccctggtgctaacctcaactgccagtgctgagctggaaggatagggctggaggcaaactcctaccccatcatgttgctggtgtattccatcctggtattggtcacaccaaggaagggcctggactttcctaatcatgcagcttaaaagcaacacaaggcaaggcggggagtccgctctcctgaagtctgacatccaggaagaccagattgctatgtgctgtctttgacttacttggagactcacacacctacactagtgcccccttatctgagggggatgcattccaagacccccagtggatgcttgaaaccataaataataccaaaccctacatatactatgttttttcatatatatacctatgataaaatttaatttatataatagattaggcagagactaataacaataactaataataaaatagaagaattataacaacatactataataaaagttaacgtgaacattgtttgtctcaaaatatcttattgtatgtaatatttttggactgtggttgttcatagcaagtgaaaactcagatgggggagggtggcatactgtatttattttcctgtatccattagtgtttcccagtgaacactgcaccaggaggttggccatttgtctttatttatacatcaaactaaggcatggagaataagagcttggtaaggtcatatagccaggaggtggttgaactgagattcaaactgagacagtctgagtccaaattctaccacctcttgtgtgtgacatttaatggataggtgggcttttgtaaccagtgtctctgcctttctccatgattcacagcacagaaacttgtgcatacattctcacttgatatctgaatgactgtaacagtgatgtaaattaacaaggaagggagatagccctgatttaattggaaatcactgacagagctcgcccagtaaactctctacaaacagaatacaaatgttttgtatttaattgctaaagtgttttaaaattgaactcaaattaataaatacttattgtatctgtcagttaaacgaaacaaccaataaacaaccaactctgttttctaatcaagagggactgatcctttaaaaaaaatagggtttaaaaaagatgatatgatcaatgtaaaattggattatagacttttagagtcttaaaagatgagaaaagagataaagatgaatagatatggagtaactaggataagactctctcacaaactggaccttaaacagatttaggaagaaatataggattaggatagagaaaaagaagagaaagaattgcctataggcataataaaaagcacaagtgtatcaatcaacacagggtattgtggaccagtgaggaaggatcatgatctagactaggggattcatgttggaaacagtgagacaagttagaaaggataggatgggacatattatatggttccaaacataataaatgagcacttgagctagaaagtagtataatgttcacaggtggtaaagaggtataatgaaaaaactatacttcacaaaaattagtggtgttcagtgggttggagagaagaccaattagaaggttatctgtggaattacaacaacccagtgaattgagctgatggagagagatgctcctcccactaccaacactcaaacataaggcaaaaatatttataggtgatgagtaatgatgaaaaaacaaaagaacaaatgatagatgacatgaagaatgggagtagggaagaccatatttaagactctgaggtcattaaatgatgtaacatgtttactagcccaaaaatatatactaaaagagtagaaagaaaacaaaaaatttccaaatcagtagcaaggatcaagaaaacaatccaaatggaaggaaagaacaatgtcccttggaacataacaatagaacataatatgaacagtacctccttctatgtagtgtagatattaaacatagggtgggaagtacacatatcaatttcaaaatagtggtttaatctgaaattgttaaacagagagggagggaagcaatagaactgagagagcgttcaaaagccttttgttgtatctgtagagtcttttatttcttaaaaatacaatcgtataccacatgataacattttggccaatggactacacatatgacatggtcccataagattatagtactgtctttttactgtaccttttctatgtttagatatatttacatatacaaataccactgttaaattgcctacagtattcagcacagtaacatgctgtgcaggattgtagcctaggagcaatgggctacaccatgtggcctaggtgtgtcgtaggctctactattttggtttgtataagtacactctatgatgttcacacaatgatgaaatcacctaacgatgcatttctcagaataagtttctgttgttaagcaacccatgattgtatctgaagcaaatatctatatctccttattaaaccttagggtaagtacataaattagagaataagtatattattctctaatttgctattgtattatatataatatatgtatatgtatactatgtatatattatacatagtatacatgtataatatacatatatagtatatgtatattatataatatacatataatatatataatatataaaaatatataatatatataatatatataatatataaaaatatataatatatataatatatataatatacaatatatataatatatataatatacaatatatataatatatataatatacaatatatataatatataatatatattatatatataatgttaatatataatatatataattatatatatataatgtatacatatgttatatacatatataatgcaatagaaaattagagaataatatacatttgtgtacttagcctaaggtttaataaggaaatatagatatattatactatattatatatgtagtataatatttgaaaagctattaaagtaattgaagcctgaggtgaaggctctagtttaatgttgcacaagagggagtcctccaacatgactttctgcacctccatccctggcagaaatcccctaaataatatccatggagctggtgtggcaactagatatgaggttacacattcaccaagtctcaaagatgtgtaccttcttactgttactaacagtttaagattcaacagtcaagctctgtaccaaaaaagacaaggtccaggggatttattctgtaatctgtttatagtgccctctagtggcagctctgcagagatctaacgcagaactcactttttttgtgttgaatattaactttgtatctatttttcaatgtattaacataaattggattttgtttttgttactaagcaatatgagtaattcttaactttaaaattgtattattcattcattacctacagagagaagatcatgctgtttttttttgtttgtttgttttgtttttttaattgatcattcttgggtgtttctcgcagagggggatttggcagggtcataggacaatagtggagggaaggtcagcagataaacaagtgaacaaaggtctctggttttcctaggccgaggtccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacatggcacgtgtttcagagagcaccgggttgggggtaaggtcatagatcaacagcatcctaaggcagtagaagttttcttagtatagaacgaaatggagtctcctatgtctacttctttctacacagacacagcaacagtctgatttctctatcttttccccacatttcccccttttctattcgacaaaaccgccattgtcatcatggcccgttctcaatgagctgttgggtacacctcccagacggggtggtggcctggcagaggggctcctcacttcccagaaggggcggccgccgggcagaggggctcctcacttctcagacggggcggctgccgggcggaggggctcctcacttctcagacggggcggccgggcacagacgctcctcacctcccagacggggtcgcggccgggcagaggcgctcctcacatcccagacggggtggtggggcagaggcgctccccacatctcagacgatgggcggccgggcagagacgctcctcacttcctagacgggatggcggccgggaagaggcgctcctcacttcccagactgggcagccgggcagaggggctcctcacatcccagacgatgggcggccaggcagagacgctcctcacttcccagacggggtggcggccaggcagaggctgcaatctcggcactttgggaggccaaggcaggcggctgggaggtggaggttgtagcgagccgagatcacgccactgcactccagcctgggcaacattgagcactgagtgaacgagactccgtctgcaatcccggcaccttgggaggccgaggctggcagatcactcttggttaggagctggagaccagcccggccaacacagcgaaaccccgtctccaccaaaaaaatacgaaaaccagtcaggcgtggcggcgcgcgcctgcaatcggaggcactcagcaggctgaggcaggagaatcaggcagggaggctgcagtgagcagagatggcagcagtacagtccagcttccgctgggcatcagagggagaccgtggagagggagagggagagggagggagggagggggagggagagggggagggggagggggagagcaagaaccgatcatgctgttttctttaggtgggttaaatcttgcacatttgcataggtaaaatgttaccaatgtaacactttagaaattctgtgcttcatgaaaagtccccggagatttgccgatgcctttatttttaatatatttgaacctcaaggaaaacactgaaataatatgaaataattctgatgaggtttcctatacttatcagttgtagttgtctgatgatgtcagtcaaaaaccctatagggtaatcagtcatcattttattatatgaaacttggccacaaaattacttatttaatttgaaactagcagcttcttggccagtggtttttaactggggatgcatgttagacttagctgtgaagttttactaaaatgtagatatttaggactcactctagacttgctgaatctctaattgatattcttgaaatattcatattggtatagtcttaacatactcttggtatattttgtctcaagattattacatgtaaaaattattttcattctttttaatcaattgtaacacatactgacatggaaaactggctaatcatagtccttgtagacattgaaaattggctagttgtccctatagacattttgtctaaaacttttattttgcatgccacagaaataaccaaactttcttgtcagttgcattattcttgctatgaacgctcatcaggcctttcactttgaaaataatcagtaatcaacttaccacgttgttttaagactttatcatctacagatggggtgtgttttcctctaatgctttcctgaagactcggcaatcagctaccctccagagttgctgccttcaaataatgactacctcagaaactgatggaaaagaactgtaccatgtacttttaaactattgacacttctaaaaatagactctttcatataggcttctgtgcttagcaacttttagtctgtccctgaggattgagtcaggattttcagaactctaatggagaagcagaaggcttcataaaactgctaacccaagctaccgcagaacaagaattaattacataggaatgaatgaatgaatagagggatgattgaagttatgtgtttggaatattgttgatattgttttaatgctgtattttctggatatataaggaaattctttcttaagctatctgtaaccccataactccttatccatttgcttttgtaaacagtaataaaatatttttaaataatatatttttctcactgaccctttccacctaccgcttgaattcacaaactattatcaagtattcttacttttcatggcaatatacttattagcaaatattcaataagaaactgttctttgtttaccagaccataattggaaaaattggttatgtaattaaggccttgcctggaatgtcatatttgggaaagatgttcatttaatcaggtacgatcagacaattttgaggaactaaagaaccaacactaggaaaattctcccagggaagctgatgtggtacctggcttgtaggctgtctacaggtaagtaaggaagatcaacgctgggaaggacaggaagggtagggtattttagggaactcaaggacagaggaatttgctgattatagatgctactggtaaaatcaggtagagagaaattcttcagcttggctaagaaccaaagccttgaaatagcaaataataaaggcttttaaaagtccatctgagatccctatggtaacttccagaaaagtaaacttaagaagacccatatcataaagtaatattcttgttgcttctatgtaaaaaatcaggcaaacttacatggtttttcttatagtttagatgtcatctatgtttgccgggcgttaacattctgattaagatttatggtaaaaaaatgctattaatatggtttctatttcttctttataaatgatttatcgtaaaattccttagttcattatttaatatgaatgagaaggaaagaagaatgcactcattccattttcacaccctttagggagagacagcgtatataaggtggaagggaattagagatggtggaggggaatattgagtctaggaaattaaagaaagaaaatgacaggttaaggttggatttcagaaatatcaacacacttggcagacattctgagaaaacaatattgttgccccaaagaagtgtttactcataataatgatttgaggtaaattacattttcacctacacaaattatctatgatccatttcttattccttctagcatttttttctcaaattcaaaaaaggaggattggagaaaaaaaataagttttgaatttgttcactgtacctcacagctcacttctggccatatcacagtcttaagcattttcatctgcttttttgtgagtcccctttacttaactcatcacaactggttttaattacttggttaatggaccatattgcatcctagactataaggtaataaatatattttgttcaagacaaaaaaatgaaatgacattcaaatgtatctaaaatggaagtaactagttctagatggcatttgctccagtaggttttgcttttcctgattcactgtttgcacctccacgtccccacccaccccatgtaagagtaggggactatgcctagaagtaccgtgatagtgcagttggcacacacgtttcatgggaacttctggaaataaaatgggtggcaggggtggaatatgagtttaaaatacacactcagaactgattatttcaaaccacctcttaccatctgaaaattggttttgtgtgtgtattttaaacatacattcccccttattttatttctagaagttttcacgaaatgcctgtgccaaccgcctggcattttcctccattttcatggcacttccaggcatagtcctttaatctttttttttttttttttttttagatggagtcttgctctgtcacccaggctggagtgcagtggcatgaccttggctcactgcaaccttcacctcccgggttcaagccattctccaacctcagcctcctgagtagctgggattacaggtgcccaccaccacaccccgctaatttttgtattttaagtagagacgagattttgccatgttagccagactggtctcaaactcctgacctcaagtgacccacccgccttggcctcccaaaatgctgggattacaggtatgagccagtgcacctggctgagttctctaatcttatatggagtagttggagattgggggtaaatagccacttcacagtgtagcccagtggttaggagcatggactgtagggcttcactgttcccatccctgcacgtttcctccctgcaagcaagctatttaaactttctgtgcctccattttctattctggaaaaggtcgtcgtaaagcctaagagcagcaaatgaagagtttcatatatggccagcaacacattaagcacttagaagctagctactgttattattactacaaaattatttttagccactcggaagacatcattctcttacagagttccaactgaagtgtaaaagaaataggaagccataatacaagacataataagaaacggcaaggtggtaagcttcagatttggaggtcagctatatttcctgtcttcttggtagaaattagcattaagttttagaaaaatcagcttttgtttacagaaattgcaggataacaagtgattgggctgcttacctttaacccttcagtgttggaggatgctcatgtctagaagttacagctgggatatctgacactgttaatgagcttctcttcctgagaatcctaggaagcctggtgccttctgagagccccagcaaaggggcttccccttatgtcatgtttctctttttggcctccactcacttcagataccactagaaaggatttaatgggctattagtatctatttcttttccaccatgcttttcttcccaggtattttctatccatgcccatgtattggatgggctaacacaaagcctcccctttcttataagctgctatgtatcgccagcctctggtgctcccttgcccagagagaagcaaaaaccagtcagcgtttgagagaattgcctgcagctgacttctaggctgggcactgtcaaccttagttactactttctttccaagaagcataagcagatatctttttctaatgttgtggattttaaaaatatgtagcatgttaatcttttgaagctttgaaaattaaattgtgtttttcctgctcacttttcccataggccacttctcttggtttatatgataggaagggaattgataagagaatcctgagttgctgtcactgtatatgagtttatcatctccttcacagtgggcacttggctcatcagccacagaatatccaatgttctgaatcaacagcctgcagcaggatggcatcaacagaaaaatcaggctgacatgcccacaaaaaaaccaccctttctccaaaaactattggaaacagcctctttgagtcctcaaaagcaaaaaatattggggaccagacacggtggttcacgtctgtaataccagcactttgggagtccaaggtgggtggatcacttgaggtcaggagttcgagaccagcctggccaacatggtgaaaccccgtctatactaaaaatacaaaaattagctggacatggtggaacacacctgtaatcccagctactcaggaagctgaggcaggggaatgggagaatggcttgaacccgagaggtagaggttgcagcaagctgaggtcatgccactgcactccagcctggccaacagagctagactccatctcaaaaaaaaaaaaaagaaaagaaagaaaaaaaaagaaaaaattgacttttctttccattgagaagaaattgtttttgaaccatgtgggcaggggtataattcctccactgtgcttcactatgcttctggttgtgttattgctggtcccatagcttcaaattatataggtgatttgcatgaagaaagggaaagaagaaatttctctggaggggaaagacggtggtaagaccactaccttcttcatttcccttttttctggctcaacctcagaaactaggtctgatttctggatttaggggtgttaggcagtggttgaaagagctgttgagactctggggtacaaagcagtgccttctccagttttatagggccaaatgtcacctctgagcagctggagagatgttttctctatttctgtggtatgccatgtatatagtgtttggggagaaataaggccagaagtcacatggccccttcagcatgtggagggatttgcagctgtggaacccaggagtgctcaggaagtgggggcagcctcgctgaagagctaggagcagcagacatcagcaggaagagcagaggataacatcaagaggaatcgtgcctgacaccaccctgcatgtccagggttatttctgggaaagccaaagcctaaggggtattgggtttgctcaagactcaagtcacctatgggtaggtggtggccaataatccggcaaagtggggctaaagacaaactagacagcttgggcatgaggtttgaaaataggaggtctgggatgtttgggttacagtcaaaaaactaacatggctttagcaacttcactgaaccaagtcataaaatttgtttctctttcgtggctccaatactttggtgctcttagtactctccaaatatagatcagagatgcaggagaaatcaacttttagcaagctgaatgaatgatcttctagtgattaactcttctctaagttttaagtgaaaagcagcaggcgtcatggtgagtgtgagtatcctgtgttgaactggatcattcgtgtaggtttggggagctctagtgagcattatggtacctttcttcctggaacaccaagttttaggcagtagctacaagtacagcgattagttacagaaagcagttattagcacacttgctctattttactaccacttaaaagcaattaagatggagaaaatataagccagacttctcattagaggtttagagaatatgttaaacaaaactttacctttcttccaaaaccagggaattgttcctattatcagatagaagtgaagtttctatgcaaagaaagctgagatacttagtccattgttctaaagagcattttttcttttagtggtccaagaaatgtcactagtttccccaaaaaggtcctctggttaaatactggtaaccaatgagttaagtaatgttaaaccggtttgattactgactttttgaagactttaatatgcccacatatgtggtctgattccatgatagaggaatgtgaatacgcacctcatggacaaatacattcaggacgctgccagtacattttgtagaaggctggtgctctagaatgtaatttcaaaaatgccaggtcggacgctgtggctcactcctataatcccagcactttgggaggcccaggcgggtggatcgcctgaggtcaggggttcaagaccagcccggccaacatggggaaaccatgtgtctactaaaaatacaaaaattagctgggcatgatgtcaggcacctgtaatctcagctactgggaggctgaggcaggaggatcacttgaacctgggagatggaggttgcattgagccgagatcacaccattgcactccagtctgggtgacaagagtgagacttcatctcaaaaaaaaaaaaaaaaagtcatatgtgatagacattgagaagcaccacctaggtcccctttcaaggaggacttgctgtccacctgcaggcagtgtgacagcagactgtttcagctgtctgcttcttcacactctgccaccactgcaaagagcaccttgcccttccatgagcagtccatctggcggctgagcgaggtgggtataaaggacctgccctcttatccacccacaacagtaaatacttgctccagagctccccaggggagtggctaagacttgtcaggcccacatcacttctctctctgcccaatctttctttctccctttcctttcacagttgtttatccccaatcaacaagttggacctcagactttgtctcagtatctgctttcataaaacccaacctgagccagtactgagattaaaatatgtaggattactcttttctatgagtgaggattcctacatgtcaattttacttatttaacatttgttcatttcaatgacataaccaagcatttgttacctaggctggttataaatggaatacttcctataatgaattgttcatttactgttatctaatacaattaattaatgtttctattttaatatatttcaagttctaatattgcaatgtctaatgtacaaaaatttgttgaactcagagtggttgaaatactccacatttgtaaaagtatatactacagtaaaattagtactactaactgaataaaacaaatacaatctaatggaaagtatgtcagttgattgaccaacaatcccactggttgaactaaaagaggtttcctttgaagaagttcagagtcttagaaatatttaaggatgtgaagaaaatttctagacattttcagaacatttgattccattaaatgttgatggcccatatacttctaatccttcatgctactaatagacatagccataaaaagagaaaaagaaaataatcaatttgattagtatttagattataaatgaaacaaaaaggaggagaaaatgagttgataggagagaagttgtaaaagaaatatatccataggtgagacaactctaactcaagcaggtaaaagacagagccaaaaaaaaaaaaaaaaggacaatgaaaacatgcaagtttcccctgtttaggaaataaggaggtgatagcagagaggcagggggccaagccatgctccaagggacccaagtaacagagtcaagggtcccaggagtaggtgagagggaaaagctacatgtaaggagccactaataggcatgggaagtttgtgtgtgtttaattcaaacatttctaataaaagccagttaaaatatccaccaatgttcccactcttcaatcaagtgggagcagacatcaaatattcattgagttggtgtaaaaaccattgggtcttttaataacattaaggtgctaaagagaaatagcatggaaattaccattttgttgattttattattccataagttcttttaatcacattcctttttttatagtttatatttattgcattcttcctatgtgtctacacatgggttagctcatttaatcaagtcgtcaaggaacttgatatcagagctgctctctccttcatcaaatctaggcctttccctaaaagatttgatgtctttagcctagaaagaaagacacgttatgatgttacagtcaagtccacaaatatatggactgaaatacagagaatctgagcccctgggtagaacatgttatcagcgttggaatggatgggtgacacagccaccttcttcttggctggaagagtctggtcttgctcccaaaatgacagctgttctgtttctgcattatttatttaacttgacaatacttaaagcaaacctgatttttaaggccagttccttctgagcagtttaatctgaaaacatgatttccttaaataggatctcattttgtctgctgatttgcattgactgaggtgctttgttagtttctgctttccatgtggctggaatgacagtgctggctgtcattcctctttgaccacttaaaagtaattttatggaatttacctactatgcctctttaatcttcttcaggcacagatgagtagaaactatttagtgtgatcagagaaatggaggaatcattctttccaatattatatcaataatgactttaaaaaatatttttattacaacacatttggtgggtagatagaaggaaaggagtaatgatggtatgaaacaaacaaacaaacaaaaacccagactgctgtagttatcaattgctatgtaacaaattacttcaacaattagcagtttaaagtaataaacttttattatcccagtttctgtgggtcagaaatttaatagtggcttagcccagtggttctgtctcaggttctcatgaggttgcagttaggatgccaccaggggactttgagacctcatgtctacaaaaaaaaaaaaaaaaaaaatgatcaagtgtggtagtgcatgcctgtagtcccagctacttgggaggctgaggcaggaggatcgcctcagcccaggaggctgaggttgtagtgcactgtgatagtgccactgcactccagcctgagtgacagagtgagagacaaaacaaaacaaaacaaacaaaaagatgtcaccagagctacagtcattgaagacttgactgggactggaggatccctttccaaaatagttcatccatatggttgttggaaggaggcttcagttcctacctatgtgggtctctccatgggatgctggagtgttgttatgacacaatgtctggtgtcccccatcatgagtgacataagagagagcaaggaggaatgcacagtgtctcttacggaagcctcaggagtcactgatcatcatttctatgacatcttgctggttatatgggtcaaccttactcagtttgagaggggactacacaagggcatgaataccaggaggtgggcatgactgggctaccaaagaatgtcctctggtcccccagtgattcacctccttaccacatacaaaatactctcacctcccctcatgaccccaaaagtctaatccctttacaatacctgctgaacatccaaaatcttgctatataaatcaagcacaagactccttggatgagatttcttaagagcagttctttaagtttagctccttgaataccattctccttcatctgaagacctgccaattaaagaaacaagtaacctaccctcatcacacacaacatgcaatgggaggaaaaatataggatgtctatagttgtagacaatcctgttcaaagtcacccagtccaggctgggcacagtggctcacacctgtaatcccagcactttgggaggccaaggcaggaggattgcttgagcccaggagtttgtaaccaacctgggaacatagggagatttcatctctgcaaaaatttaaaaaattagctgagtgtagtggcatctgcctgtggtcctagctactcaagaggctgaggtggaagggatcacttgagcctgggaggtcaaggctgcagtgagctgtgattgtgccactgcactccagcctgggcaaaagagcaagaccctgtctcaacacacgcacacacacacacacacacacacacacacacacacaccaaaaaacaaaatcacccaatccatgctacctccaccttactgaaggggacggtgttgctaaattttctaccactatataacaaggatcctctttcctttcatttttttgtttttgtttatttgtttgttttggctttggctttggaatgaggaaatgaatggaagctggaaagactttgaggagagtgttagtgaaagcataacatgttgaacaaactgatagtagaagcctgatagacattcactaggctgccagtgtgggattaaagggaggtaaggaaattgccatcaaaaccacaggaggccgggcagtggcttacactcttaatcccagcactttagaaggctgaagcgggaggattgtttgaggccacatttgaggttttgttaggatagtgcctcacattcaggtacccgatatctgtgttagttatctcttgctgcatagcagatcattccaaaacttagctgcttaaaacaatgctaaatactacctcacacaatttctgtgaaacagacattgaatagtggcttaggtggataattctggcttggggtctttcttgaagttacagtcaaggtgttgtccagggcaacagtcatctgagggcttgactggggctgaaagatcccctttcaagacagtttgcttacattatgcttattgtcagcaggaaacctcagttcctcctcatgtgggcctctccacaggctgctcgagtaccctcacaagatggtggctgccttgcctcagaggaagagactgaagaaaataaggtaaaaaaacttccatgtctcttgtaacttagcctaagaagccacacatgggcatttctgcaatatcctattggttacataggtcggctttattcaatatggcacagcactactaagggtgcaagtaccaggaatctgggatccttgggaaacatcttggtagcttcttaccacgctaatcaacagaaattgagagggaattcaaacacagccaagggaggcagaccttggtggctacatgatggcctctggttgtaaagctggaaggaaacagacatggagatgtccactgcaggggctcaggttctaaggacacctcaccagccgggcagcccacatacactattcaggaggaatctgttaggccgggctgaaaactaatgttcttgggagatgtgttctttagaattaatggctcagagagctttcctgttgacattggtgctggatccatcttacccttcttttgctacatcttggcagttacatttaagatgctatttctcttcctcacttcaaactgtgcctaattttcaaataatttccattcttttttgaaaaatggcaattttcttatagttccaatgcttcagtaactggggagcttctcttgtgcctggatactacttttctttattaaaaactgatatgacccagataaagggaattttattctgagtgtttatctctaaacttcttttttattatttgtctcttgcaataatctgagcacttttaagagatgaatgttttatcctagtattcagtgctttttccagacctgacacatagtaggtattcaattaatgtatgctgccaaaatatatttcagtgttagaggccaccaaacagatatcttttcattctctcccctctgccgcctacataaggagccaatgaagcacgttttaaaaaagatagcacatttgtaattgcttcaaagttaaacctatatacttttttggttaattttattagctgtagttgctcttgttttccatactataagaagattatctcaattagtgttaattgtctccttccacgtggtccttcctccatctgacttaggggaattttcttggtgtttttccatctcattcagacataatggtgtggatggtgggtggtttggggttacatattggagctatgtaaggggtacaattccgatgacggttctgtggccctaatcccctgctccccacccccactttttttgaagagggtgtcaaatatggattaattacttatctttgtgaccagaaaaaaaaaaaaaagcctaagttaactgaaggaaaaaaaatggaaatttactaataagtgtcccatggaacttgtggattaaatagcagtcagatatcgtcacatctctctccctccctctctctcccccactctctcctgctcgctctctctctctttctctctttcctcagtgtatgcttcattcttctctttatatagattgttttcctcttctccattcccatgcatgcccaagtatggccactgagttagctgggtcctctgtgaggcagacattgagatggagctgggagcacatgaggtttgttgagatgtaatccctgtgaaagagaagaggaagaggaaggtaactggacagggaaagtcttcacaccatgatgcatactggacacctattaaaggaaagcgggaggaatcaggattgggcaagtgagtctcagatcatgatgtggacatgacaaaattcagaccaagccaatggggaactccagagcaaaaagatgatttgctagaggtgttccatgttggagagaaatgtccaggctctaggacctctgtggtgcttagtcattagctgggggttgcctagaagaagtatggctccagctcaaaaattgaagcagattctgaaggcactaacagctggaggccgtcagctaactccgctctcgcacctcccagctccactcctttcctgaaggaagagctgagcagtggtgcatctctatggctgccacagccaccaagacccaaaagttccctcactgtgaacatctatgtagagcatttacctgtagtagagtctgtgtgtatctgtcctccaaattaccatacagttctggcccaggagagtgggttcagttttacaaaatgatccctggggccactgctatggttaagaggatgagctagacatttgcacctaaagatattgtcattattatgttggataaaatttgaaggtcagagggcaccaaatagagtaatatattcactattttgtcctctctagcatgtagagccacgaagaagcatattttatttatttatttatttatttatttatttatttatttatttttgagacagagttttgctcttgttgcccaggctggagtgcaatggtgcaatctctgctcactgcaacttctgcctcccaggttcaagtgattctcctgcctcagcctcctgagtagctgggattacaggtgagtgccaccacgcctggctaattttttgtatttttagtagaaacaggatttcatcatgttagccaggctggtctcgaactcctgacctcaggtgatccgcccgcctcagtctcccaaagtgctgggattaccggcatgagccaccacgcccggccaagaagcatatttttaaaaaaaagttttttttttcgtttttgtaacctcattagcagaaagcatacttctgttcaaaagtattaagataatcatgtctgactttaggtttaattgcttcaatgataagcactgtcttctgctcccctccccacatccaacccttagaatttttccaagattcttgttatccattctattcatatttatatcatccatcatatgaggcagaggggagggaaatgtgtcaatagaaatatgtaaaggcattcaagtgggttggtattttcagcattaactaattattctttctttggaataatgtaccaaaaaccatattaggactttccggttgaaataaactactgttaactagctcaggtaaaaagtgaagaatttagtgaggaagcatgttcagctgtttggtttttttgaacccaacccaatgaggctttgggaatggcatattattacacattgctgtgtaacaaattgccaaaagcgtaatggcttgagaagaacacaaatttataatctcacagtctcttcaaggctgcattgcatgtgtcagcgggggctggttctcacttggagctcagggccctcttccaagctcattcagcttgtttgtgggcagaatgcagttccttgaggtcacaggactgaggcctccactcctgcaggccacttctctccacagacagtcacccagggctgtttgctttctttcttgagcagttaagagactctctctgctgctttttaaaggttttcaccccattaagtgaagttcagtgaggattatattccttttaactccaaatcaactgatttaaggccttcattacatctagaacacaccttttgtcatataacatagtaagttggccaggcatggtggctcatgcctataatcccagcactttgggaggctgaggcaggtggatcacaaggtcaggagtttgagaccagcctggccaacatagtgaaacctcatctctactaaaaatacaaaaaattagccgggcgtggtggcagccacctgtaaccccagctactcgggaggctgaggcaggagaattgcttgaacctgggaggcagaggttgcagtgagcggagatcgtgccattgcactctagcctgggcaacagtgtgagactctgtctcaaaaatatatgtatatatataacatagtaagttataggagtgatgtttcatatttgcagatccttccactgtcaagggtaggtattatacaggtctataccagggctggactcttagaattctgcctaccacaaatggactcagtttaagtgctggaaaactgaaaaaatcttcttctcttctatcttacctcttctctctaacagtctcttccctttggattctctaaattaccaaggaagagctctggcctaacttggatgggatgttcaaccctggtattatcaactgtggccaggggcatgattccatgttgtataaagtagcttctgggggtccactggtgtggttgagaaggtaggagtagttcacttaaggaagggccgtgtgagctgggaagatactccaaagctatttacctcgtgctgccttttattcagtgaagagcacattcttctgataggtcagacagcaatgggtagtaagtgataatggcccctgggcagcaatgaattgtgttgtgtcctcttttatgtcaccctgcaattctcccagaaacaaactcattctaaaactaggctgtgttcattcacgccacattcaacaaatcaaaacaatccaaaactgaaataaaaattcatgtagggtgatggtgaggaaatggggaatgactggtaatatgtataaggttttcttttgggggtgatgaaaatgttctaaaattagtgtgtatatattccactgcagttcatagaaatggccctagcccatagattgaggtctcttagtaccgttccccattaaaaagatcctgggctccttagcggtaatggcttattccaagtttgaggcatggaagatatcaggtgagcctggtacatcttttggggtgtctaaaagcaagagtccagggtttaatgaggtcaggtgaaaggtttggtcagttttagccccttcacattggctacaatgttgtgtgttatggtttggcctcataagcacctattcaggggagtacaacagaggaaagctttgtcactcagacacctgggaggtcctgcagatgatgcctgaagctgcagctggaagtgttgcttgtgcctgctgggtcactgggaagtgctatgcagtcacaatgaaattttcaggtggcattgtgtgccatcttagacttttttccccccaagtttcatccctcccacccctcagttcatgaaatttcactctcccagatactctgtacatcttttcttgtactatgtaataactacattctttcaccccgccccaccctgccaggacaatttttgccccgtaggggctgatatttcccttattgagaatgcatgctccactccatttgtgctggcaagtgtggagaatgtgggcatttatgtagggtggtggtagggaaatggggaaactagtaatatgtatgggggtttttttggggggtgataaaaatggaggaccccaaatgactgttattttggggcccagaaaaggaccagggtaaatacatttcatcattgggattcaaggctggaatcttttctgattgagacccttgggtcatttggacagagaaacagcgagacagatttcattcccttctctcccacaggagctgaccccaaatgtgtctcctgcatgctggtaaccatctcgagtccgctgcccagggaacccaccttgggatcattttgctaaatatctctaatatgtggttgatttattactgctgggtctaaaagctactgtttgagcatttatatagtgtgcaaaaaacttgtcactatgcatacagtgctggctgtctcccgttgaccctcccaagctactctccctctgctctgtgctcagggagactagccataaggattacatcaatgggcccgttgccacaggttcctgatgggcttggccaatggaaagcagcaggtagagcatgaggtcagagtatattctcaactcctcacctgtcagtccacagggggttgtctatttctctctgcaaagggtttctggtcctgctatgtggacccctctctatatatatttcttactatgggttcaagtggctaccttctctctttggcttcttcaggccaaaactccctgctcttgctggccctggagacactgcattatccctgtgtttctcctagattctgcccacctttgtaaatagtctatattttgaacccttcttcaatttctcagtttgcagatgccgtattccctgctgggaacatgactgacacattcaagtctcctcgaaagcagttatttccaagatggtataagatcctgtccctgcctcagaggtcaggaacagtgacctggaacagaacagctttgtggataacctaaaagcattttgcaagcatagagggtgaggtgattagctctatctgattgagttggggaaggcttctcagaagaggaaacagtatagtctgacaggaattttccatacagaaaaaggaactgcaaatgcaaacgcatgaaagcttgaaagggatggccttttggaaatctagaaaaaagtctcagcaggtaaaggtcaagtgtgtgcacacaggcttgtttgcagggaaggtaggaaggggaagaggcatgcggtgaagttgtaaggataagttggttgcggaagatgcagtcttgaaggcagtaaagtctaaaagtctatagttctctagaggtcggaaagtataaaagtctatagttctctagaggtcagtagaagtgttgtacagtgttgtaagaaatgaaggtaatacatttcataaaagcacatgctgtaactaccaagatattatcacaaggaggtagttaagagatggctagattgttgcaaccctagatggtgacacggttaagttaatgttttgtagaaggaagggaaagaaataaacacttaagtgtttactctgtgctagcgttcggacataatatttcactgtaggagacatgcctgttgactttgcatctttccatctataaagccaatgagattgccactggatagtacatcttgctttggggcttagaaaaatacatcatcagaatattccactgtgaggacccctgtctgacacatatacagacagtcccagactcatgatttttcaacttcaacttacgattttttgactttatgatagtacaaaattgatacacatttagtagaaaccatattttaaattttgtgggtttttttcctttttataaaaaagaaatagggtctcactatgttgctcaggctgatctcaaactccttacttcaagcaatcctcctgacctagcctctcaagtagctgggattacaagttccagccaccatacccagcttaattttgatcttttcccaggcaagctatatgtggtatgatattcttacatgagatatttaacactctactataaaataggctttgtgttgatttagctgatttagcttacctgcaggctaatgtaagtgttctgaacacatttaagctaggctaggctaagctatgatgtttggtaggttagatatactaagcgcatttttggcttatgatatatctaagttatgctgggtttatcagaacataacccctaagtcgaggagcatctgtagtggtaaacacatcattagggtttttaatttgattgttactgagaaattgttgcaggttgtgagtttctaaaatgaattttaattaactcccttcattgctggtcctgggtactagaatcgtaggaccacgcatgggttgtgcatgtgtccacaccccacaagccccagtttcttagtggtctctctaactcctcttgtgatcaataagctaaggtactctacgtgcatacatgctagctttcattttcatgtaaaactatgcagaatagtgtctggaacccactggatactccatacatggtctcttttgatcttaaaagaacacagcgaggtgggcattcagtaacttgtccaggttgagagtggagtcaggatttgaacccaggtgaccgtatcttatgttcttgatcatcacgcaaggccacctgtcattgagacttgaacagcagatggggccgggtgtggtgaatcctagctctttgggaggctgaggaatgaggatcacttgagcgcaggagtttgaggttgcagtgagcctctgtgctactgtagcacggagtgactgtgcttctgtactccaccctgggcaacagagcgagatcgtatctcaaacagtggaatgacaaagaaagcaaaaatcaaaaaacaaaaaccccgaatagcagatgggctgtgagcatggagcagattgcatcagctgcatgagccttcattcttcctccagaagggcctccaaagacagctttttcaaagtctaggctataaaaataccaccttgagtttcacttcttttcatgtatgagatcttagatcttagttcctgtttgctttgcaaaggacataaagagcctgcccaagcatgttcctctagaattcccaccgaaaccaggaagatagcacaggaagctgcctgtggacttaaaggaccccaagaagacccttcagccctaaaatatgtttccaatagctcatcttggtgtctgaaatgtctttatttgagggttattacttcaagtcatgagctttttggggtttgagcacgagaataaatttcttcatgctcttctgccagtatgtatttgctctttaaaggctaacagaaacctattcagtccagctttagaaataaacagaactgtatcccagtgatataagtgttacttcccagagcacaggggcagataatggcttgggaattggctcttggcaattttttggtttctgggcaattcctagttctaaggcaactattctccccgaagctgtgggatgccctgtttctgctgctcgctacagagccaggacagtgaggccaacatgaaggctggtgtggtctgccctgctttggccttcctatggcaggaaatagccgcctgaactccatgcagacctcagttaaagggcctaatgcacacctaattcatgccccaataagggcctaaagtctcagaatctcaattccaaatctccggtcaagggtccgccctgggtccactcactggacaggggttggggccgcatgccagggccatagtgctattggatcaggctttcagtcaagggggcatacaagatgggtttttcaagagtgtggggaaatgacaagaatctcccttataacatcccaaggacaaatgccttccctccaattaattaactcctcatatctgatggcagggtcctcagataaaaatgtgcttatgggccaggcatagtggctcatttatataatcccagcactttgggaggacaaggagggaggattacttgagcccaggagtttgagaccagtctgggcaacatagtgagacctggtctctataaataataaaaaagaaaattagccgggcatggtggtacacacctgtggtcccagctacttggaaggttgaggcaggaggatcacctgaccccaggaggtcaaggctgcagtgagttgtgattgtgccactgcgctccaccctgggtaacagagtgagaccctgtctcaaagaaaaaacaaagtgcttctgaatcacctgcccctctgccagtctttagtgctggagaaaaggcaaccctggctggtggtatgaaatgaatggaaagggagttgctggggctggggagtgggtgcacacagaataaaatgataatgtttttgagaacactttggcaggctatgtgtaattaacatgatactcaagtggattttttcttttttcttcatttttttttaacctggaagggactttgtaaatgtagttcagtcccttgccctattttccagctgagaagtggggttcatggaggttttggtcatctacccggtgttaggagactcattaggactcctgtctcctacctttgcctttgattgccagttcttccctctactctctgccctagtatctccaattctacattttctttatcttgacgtccttatctgatctctcagttaaactatgttgtggaaaaataactcctaaagccccaagaaccacttctgagcaagccatagcaagtatttccttggaatttccctcaggttaaaaagcagacttgagtttctcaagcttagtagctcagcaactaaaaagtaatgttaatatcaccaaagggcttaaaagtaaattgcagaaaaagaataaatatcatttgatcacagctgataaaggtaattctagtgtgatagggaagtcttagtgcattccttcccaagtgctagcttggtctgaacctcatctgtgtagaaattgtggcttgtgtagttatccagtaacatctaatatttgccatggctttgactaatatttaaagaaatgtgggcaatgctacatgctattcttttaaaaatagccataatggaattgaagtgggtcagctttttctccaaagagtttgcatcctgttacatactataaataataatatctaacatgtattgaacatttactatgtgccaggctctactgttttacgtctcttttctaacactcaaagcaacctaagagatacacatattttccttattttactggtgaagaagaaatgaaggcttagggagatcgtgacttgccctagatcaagcagatggtgaaaggcagagtgaggattcaaatttaggtctttatgtcccttaaaaaaggtttctttcatcatactaataagatgcctctttcagaatatgcatgtagaaagaaccagcataatttgtgctttgtagcttccaatcagaaagcctgggttcaacgtttacccttcaaaaattttccaaatagggaataagattctaggcattaaagaaatttttgtttccccaagcctgccacctcccaccccatataatacaagtaatttaaaagctagtcagaccaaatagtgaaatggactcagtatatggggatctttatttggaaaataaagtcaaaagacaagaagaataagaattatttgtttagaatctcagttattattaaagaaccagtctttcatcagtaaaattctagcctctcccaccagagggcagttatcacataaaccagaaagcccctcttggcttcactttcagacaccacatcacactacatctggaattaggtttacagcccagtacagatcctgagaacatctctgcttcttttaagtctgaaactaacatgtcatgcctttcttttttgcctgcaacttaaaggagcttatgatagcatagaaaccatctcttcataaaggaatgttaaaatggaccaaagacagatgcttgtattggttctattttgaggggtggaaaccctgcaccaaacactcagtgacagagtaaaaaacatttttctgtgtctaaaactttatattttattccatttatgtaccgtctgtgtttcagtaacctgtatttccccagaaaagtagctttatatgctttttcatgaaaattctaaagattagctgagaaaaaggattatagtttttgttttgtttttgagacagggtctcactctgtcacccaggctggagtgcagtggtgcaatcttggctcactgcaacctttgactcgtcggtcaagtgatcctctcacctcagccccccgggtagctgggactgcagatgcatgccaccacacctagttattttttttggtttatttttttgtagagatggggtttcgccatgttgcccaggctggtctcaaactcctaggctcaagcgatccacccatctcggcctcccaaagtgggattgcagtttttgatagacaacaaattacttttcgagtgtccagactgcttatgttttggagaaaccaacagaaacattatatatattgatcactgttgcgggaagtcaaggaccccgaatggagggaccggctgaagccatggcagaagaacgtaaattgtgaagatttcatggacatttatgagttccccaaattaatacttttataactttttactcctgtctttactgcaatctctgaacataaattgtgaagatttcatggacacttatcatttccccaatcaatactcttgtgatttcctgtgtctgtctttactttaatctcttaatcccatcatctttgtaagctgaggatgaatgtcacctcaggatcctgtgatgattgtgttaactgcacaaattgtttaaacaatatgaaatctgggcaccttgaaaaaagaacaggataacagtgatgttcaggggacaagggagataaccttaaagtctggctgcctgtgggccgggcggaacagagccatatttctcttctttcaaaagcaaataggagaaatatcactgaattctttttctcagcaaggaacatccctgagaaagagaatgcatccctaaggggaggcctctgaaatggccactttgggaacgtctgttttttttttttttttttttcttaacggttgtagataagggatgaaataagccccagtctcccatagcgctcccaggcttattaggatgaggaaattcctgcctaataaagtttgatcagactggttgtctgctctcaaaccctgtctcctgataagatgttgtcaatgacaatgcatgcccgaaacttcatttgcaattttaattttgccccgtcctgtgatcttgccccacctccatttaccttgtgatattttattaccttgtgaagcgtgtgatctctgtgaccccaccctattcatacactccctccccttttgaaaatcactaataaaaacttgctggttttgcagtttggggggcatcacggaacctgctgacatgtgatgtcttccccagacacccagctttaaaatttctctcttttgtactctttccctttatttctcagactgactgacacttagggaaaatagaaaaggacccatgttgaatatcgggggctggttccccccgatagatcacttagcacagtgcctcatagagaacatactttatggccagaatcaaattcaatctttccaacatctctggatggtatgttctgtagttatacccattttagagaagttgaaacattctcaggtgaagtaacacatcgaaggagacccccttactccatgttcttaaccaccacgaagaagtggatctgttggagatgagatgggcctaggtatagagacttggcaggtttacaagggaggcgcactggtgctcagaagtcaatgtcaggaaaaggaggctgacgcagggtaggtaactgtggaagctacccagttgctctcactggctgagactacagtctccactacttagtcaaagggcatggctgctcaagtgatgtttacagaccattactccatgaagcaggaggcatggatggctagaatccctaagtccaaaagtcagacagtctggcaggagccttgtgcgatacttgtatgtgttaacttgactgggctaagggatgcttagatagctggtcagacattctttttgggtatgtgtgtgaggtgtctccagagggatgagtctttgactgtatagactaaaaaaagaagatcaacctcaccagtgttggtggcaatcagtcaatcccttgagggcctgaatagaacaaaaaggaggaggaagggtggatttgttctttctctttatgagctgtgacatccatcttctgccctcagacatcagagctcctggttcttgggccttcagactccttggaatggaagttatagcatcagttcccctgtcttaggcctttggacttgaactgaatttcctagctcttcagcttgcagatggcagattatgggatgccttggcctgcataatcacctgagcctattccaacaataaatctccttttatagatctctatatttgcagtttatttgttctgtttctctggagaaccctgactaacacacatggctagcagattgaaggcacagaactaggatctatctccgtaaaaagaacaaatggactctagaggaaataccactgccccaaccaccagtgaagtctcagttcagggcaggatccaggcctttagagggactgtggaatttggctggggggaaagcaaacagaggagaaaatcttggccaaatgttcagctttatgaattgcaccaactccaagagtacgagtggctccggtctggaatctggttggagatttgagagcgcaggcagatgctcagctgttgaagctatgccacagagtctggcaggctagattcatttccagtcctgatgagattgagctgaggctgttgatgatttgtttgctttggttacaatcaactcagtagcaggaacagagctgagcctgagtatgggtgcattggtgagcccagcagtcgggactcaggggaggcaaagtgaacacagtggggcttgctccacctgctaacttctggttgctgacattccagtccctgagcagtgcctaatgaacctgactccatcatgacagtcccagaaggaaaaatcttataaatagtcccttcagagtttgtggccctgaagtttcatgagcacattagataccaattcaatgagtagaatcttccaaagcttttttcctgtattagttcttgaacactaactcttatctctcatgtttcctagcctagtgtctcgcttaacaatgcgtaaaagagatccacaagtttatacctaaggtgccaggtggacctcatacccagcaagtacagcaaaactgctttcagctgaagcgatatgggaactctacagggaggaggaatgtttgggtcaaggcttaaagtaaaaacacattttgagcatcctagctaatatctgtgtcagagggtgagggtatctgtattcatatcctgtggctctggtaacaaataaccataaacctgatggcttaaccaacagaaatggactttttcacagttctggaggcccagagtccaaaagcagggagctgacagggctgtgctttctctggaggctctggaggatagtctgtttcttgcctcttctagcttctaatggctgctgggattcctgggcttgtaattgcattgctttcatcttcaaggcctgcatcttccaatcctctctgctctctcttcccattgccttctcctctgtgtttctctgcctctctcttatagggacatttgtgacggcatttggtgcctagccagatcatccaggataacctcctcatctcaagatctttattaatcatgactgtaaagtctttgccatataaggtagcagattctaaagatttacagattccaaggattaagatgtagatatcttttggggggcattatcaagcctaccacagcagccctgctgaaagaaatagcatgtaaggaagaaaagacagagaaggagaaagaatattcagacagcgaccgccagttagttggagggttgggatgatacagaacaatcctataaggtatggcttcttacaaacacctatttagcggtcttggtggggtccttgaattccagaccaaagagtttggagcataggatggaggaaatcctaaaaatacagatttggaaagaaagctaagatcagattgtataatcacaacagttatgtgagaaaaccaagaaccactgcaagtatttgatcaggggaaagatgatgtgatcaaagaaggaatattggaaatcttaggaagattacattctccatccttcaactctccttctatttgtgtttattatggctcctatggaaggacaaagtccttaacattccaggctaacattccagagttgacttcagccttcaagagtgcagcagggtccaatcaaacctcctgtcataaactttttggatgcccttgggtatgtgtagatattaactgggttgccaattttatctttttccaaacaactattttcatctcctgttgtctcattactgcttctctgggtagccgaggccctttgctctaatgtatataatatatagtacagtcccttccttaattccccaaagcctagtttacattaggctgtagggctgaacaaaaccttaccaatgacttgaggatgacataaggaaattactttgtttaaaagaaatattccaaatgggatattgttcatctaggtctcagactcagacaagcacagcctgtcagggtctcttgctaaccagttctctcctatccgtcaggctaatggtcaattttcttttgtttttgttttgttttttgagacagtcacactctgtcacccaggctggagtgcagtagcatgatcttggctcactgcaacctctgcctcccacgttcaagcaattctcgtgcctcagcctcctgagtagctgggattacaggtgtgtaccaccacgcccagctaatttttgtatttttagtagagacggggtttcgccatgttggccaggctggtctcgaactcctgacctcaagggatccacccgcctcagcctcccaaaatgctgggattacaggcatgagccaccatgcccggctggtcaattttattaaaagcatcttattagacaaaacaaacctggaatttatgttaattttttcatccccttacatgcttataattgtagtttatatgtaatattcactccctgaccaactgcagtttaacttctgtccctaccttaccatggactctcctcttagttaagtcaaagacaccctcactgctaaatctaggattccattcgtaccttccttaacctcttcaacatttgacataagccatgctgcctgctcccactgcactccttccttccctacctgctcaatgcctcaccacagccacagaagaacaatcagttaagaccaccacagtcaccctgcagagatgtaattcaccccacaaacatgataaactacctgcttaataatgtaaaaacttaagtaactttccaaactatcaattttaaccaattttggggtcatgaaatcaatttagagagtttcaaggatcacttttcttaagctacatagaactgaatagagaccatcagagtgtattcacgtaggaaagctaagtgttttgtacccagtatgtgtatatgtatatccactaggtcatgatagtaaatatatttcttattgtgggtggtcagaaaagtttttaaaaaggcactgatttgggttttcctgaagttaactctattattccaaaatagaatccaaactttaatttggaaaaaaaaaactcaatagaaattttgattatgaggcgatgaagaatcgtctttaagatttctgctgtcgcagcttaaataactggtgaaagttcaggcaactttaaaaatgttattttgtctcaagaaagatgacaaggcttttcatggctggtctcttcctctccagcctcattttccccgtttcctactttgcagagtgtatcgtggccacgctgagattcttgtatcttctcttggcatgatgttttcttttggctccaggaccttgaagatgccatcctgttacctggaacactcagatgtcctccctctccttctctgctcaaagcttcctgtggcccactctgtcagccttcttatcccagctgagtcatggctctttttagaaaaccttctcggacttcaagccaagctgttattggaatttgccgcctgtgttcaatggtcaatgatctccaagtcactgcaatttaacgttcaccctactgatgactctgaccttggtttggtcgaggacagcattgctgcatctatactgtcatccttatccacctaagctcttcagcatttggcataagccatgggtgtcttgatgggtgactaatgaagcagactacacagcatttctcacctgttttattactgtatcatttatcctctcccagatatctttagatactgttcacctaatttctcctccatctccccattagaattctaataacccagatacatgtccatttatgcactgtggccctttggaggatcacaaaccattacataatatctcagattttatataatcttagattatgtgaatcttttttttttttttgctccataggaaccaatttttacctccttgtgggcactatcacccccagtgagaatgcatgcaataaaataaaactctatttgtcctcttgagagggataagaaaaaaaaatagttcccactctttaataaaagaatgtggattattttctgtatattatgatgttttgatatgttaaaaacctttccacctggaaagagactgcacctcccagggctggccaatccttagagacagcaaagggctcagctgggagtgtgcctttgatacgcaaactgcccaacccagagccatctctcctctatgtggcccctgcactccaggacacaacattcctctgccttagtcaaccaaaggccaggtaccgggcaattggagacatcctgtagcttagggcctgctgaaattattcaaactagccagttctaaactgttcatcctgccctgcctttccctgtggaaaccccaataatggctgtggctaaatcttccacttgctcctgtcttctgcctcctgactgcttatgtcttcctctcaccctccatagccagttgtctctaggacctgtgagtataacatactttgttttcccgagactctctcctgtatctcctcttgtgaccacaccgccctgatcatggcgtaaaagaatacaaaaaaaggtaaaatagggttctatgggctgggcacagtggctcacgcctgtaatcccagcactatgggaggccgaggtgggcagatcacgaggtcaggagatcgagaccatcctggctaacatagtgaaatcccgtctctaccaaaaaatacaaaaaattagccgggcatggtggcgggcgcctgtcatcccagctattcgggaggctgaggcaggagaatggtgtgaacccaggaggtggagcttgcagtgagccgagattgcgccactgcactccagcctgggcaacagagtgagactctgtctcaaaaaaaaaaaaaaaaaaaattgggttctatgatggataacaagagtactttccctagatagttggaaaagacttggctgaagaagtaacacgtgacctggagcctgaatgatgagaaagaggcaactttaagacaacttgaaagtcaagttttcagaacaaaagggactccaagtacaagaagcctgaggaagaaccaagcttagagtgttcaagggacagacaggaggccagtgtggttgaagcaggggcaccaccattttacctgtggtcaccagcatgcataaaatgtacaacacgaagactgaaccctagtgtgaggtggaggggagcagggcagaggggccagattataggttctcaaaggccatggtaagaattttatatttcattctggttgtgatgagaaacttctgacttcaagtttgaagcaagggagtgacatcatctatgtgatgctctagaacaactgctctagttacaaggcgaaggatggacaggagggcaggagaaggaagcctgacagattctccaaaaggacaaaaagtcaacgtagctgatgatcatgatgagggcagtcacgcttagggctggagtcaaagggcagttttgggaaaattttgggaaaatggcagaagtagaagtcttgaatatcgcatcagaaatgtgatgctcatttttatttttttcttttcttttagatggagtcttgctctgttgcccaggctggagagcagtggcacgatgttggttcactgcaacctccgcctcccatgttcaagtgattctcctgcctcagcctcctgagtagctgggattacaggtgtccaccaccatgccctgctaatttttgtatttttagtagagacggggtttcaccatgttggtcaggctggtcttgaactcctgacccgcctcggcctcccaaagtgctggaattgctcatttttaatctcagcagctcattcacagatcatacatggaaacttatcactcacacctaagccttctttgcctgtcttagagatccctggtgcaagaaactgtaagattatttgacacattttctctgtctcaccctaacagcctctttctagtatttgttttaaaaaacttattttttttttttttgagaagttttttagagcaagggtttggggagacagagggatgaataagtggagcccagagggtttttagggcagtaaaactactctacatgatactgtaatggtggatacatgtcaccaccatgcataaaatgtacaacaccaagactgaaccctagggtgaaatatggactcaggctgataatgatgtgtcagtgtaggtttatcagttgtaacaaatgtaccactttgaggctgggagcggtggctcatgcctgtaatcccagtactttgggagtccaaggtgggcagatcacctgaggtcaggagttcaagaccagcctggccaacattgtgaaacctcgtctctactaaaactacaaaaattagctgggcatggtggcgggtgcctataatcccagctacttgggaggctgaggcaggagaatcgcttgaaccttggaggttgaggttgcggtgagctgagatggtgccactgcactccagcctggtccacagagcgagactccatctcaaaaaaaaaaaaaagtaccactttgggggtggtgttgataatgggggaggctgtacatgtgtaggggtaggaggcatgtaggaaatgtctgtagctttccctcagttttgctgtaaatcttactagtgtttgaatgccaaatccttaagatcatatctatttcttgtcactggcagtgagttctgttcttgactttccactaagagcagtactgatgacaacatcccgcagtattttatgagccggagaacattaacatatctaaaagagtacattttcctctggagggccaccagcctgtaaactgcaggtcaaaaagctgagtgtgaacagcattgttaggacatgtttctaagtgtatgccaatatgtccacagaggtttttttagacttataaagcgagctaaagaagacttttgttccattttctgatttttaatttatatagacattttttcatttgaagaaagtgcatatatttttaaaggaaaggtactcttaagtctatccatttaagaaaatattaatctccatggagaagaaattttccatattttaaaatttattgtgtgtaggtatattccatatacactctataaataaaaagcacactggctgggcgcagtggctcatatctataatcccaatgctttgggaggctgaggcgggcagatcacctgaggtcaggagtttgagaccagcctggccaacattgtgaaaccctgtctctactaaagatacaaaaattatctgggtgtgatggcagacgcctatagtcccagctactcaggaggctgaggcaggagaatcacttgaacctaggaggtggaggttgcagtgagccaagatggcactactgcactccagcctgggcaacagagcgacactccatctcaaaaaaataaataaataaataaaataaaaagcacacactatcacaaagaagatggtggcaaaaataataataaaaatagtaagtaaataaatagcacagaagtatttacagtaaaaaattaggtctccttccagcccccacctgccaatcactctcaggaggcacccactgtcttcagctacaaagctttcagagagattttattaatataagcaaatacatactttttaaaaaagtataaataaggcctggtgcagtggctcacgtctgtaattccagcactttgggaggatgaggtggaaggatctcttcaggccaggagttagagaccagcctgggcaacataacaagacccccatctctaaaaaaacaatcaaaaaaactaactgggcatggtggcatggttctatagtcccagctactcaggaagctgagagtgagggatttcttgattccaggacttcgaggctgtcacccactccagcttgggtgacagagcaagactctgtctcaaaaaaaaaaaaagtataaacactagcatatcatatattgccctggacttttctttttgatttaacatatcttggagattcttccatagctgtggataaggagttgcctcattctttttcagggtaagtttagtataaagggtgatatagtggggaaattatatttaatttatttttgccaactcagtagcagagctgtgacaagattaatccttagatttttggaggttcatatcaaatcattcaaagctttgacatttttctcttctttgtggctctattttcatcactaaaattccccatcctatgcccctgcagcccccatctgacgtttgtcacttctctagcttagtcatctgatctaattttgatgagtcagatgtaaataaacccagataatgtgtcttttagcccaaaagactaaaagataaaataaaaggaaatgcataggacacagggcagtttgttgaatggctgagatttgaatatgtgtgtattaattctttctgaattacagctagattctgccctccccagctttgtatctggagacgagggaaaatgtgatcccagttcatattatgagtgaacatctctgactgttctaagaagtcctattcccttagattactgaagttcacagggagaaagcacccacccagatatttttggtttttgtttgtttgtttgtttgttgagatggagtctcactctattgcccaggctagagtgcaacggtatggtcttggctcgctgaaacctttgcctcctggttcaagcgattctcctacctcaacctcccaagtagctaagatttcagacataagccaccatgcccagctaatttttgtgtttttagtacagacagggtttcaccacattgttcaggctgggcttgaactcctgacctcaggcgatccacccgcctcagcctcccgaagtgctgggattacaggcatgagccaccgcacctggcctcacccagatatttttcaaataccattttcgattcccactctctttcttgaagtaagcaaggcagacacatttgccaaggataactgagaatgtaagggcaatccatgactgggcagcttgtgcaggctgtgtgctaaatgcactgggaaacatgccctataaatagccgttcattgtcagcatgtgtgaaaagacaagagagcattccgtgctatgattcaggcctaattaagtgattgcgtctgggcacggctataaaccactagctgcttcaactggtaatccagtcagtaggcaactgcaggggctcgccactgactgaaggcagtggaaggttggcagaaggaggctgttcaaggctgtttttgccttcactatggcaaaaatcattttgaggcacctcatagagattccagtgcgttaccaggaagagtttgaagctcgaggtctagaagactgcaggctggatcatgctttatatgcactgcctgggccaaccatcgtggacctgaggaaaaccagggcagcgcagtctcctccagtggactcagcggcagagacgccaccccgagaaggcaaatcccactttcagatcctgctggacgtggtccagttcctccctgaagacatcatcattcagaccttcgaaggctggctgctgataaaagcacaacacggaaccagaatggatgagcacggttttatctcaagaagcttcacccgacagtacaaactaccagatggtgtggaaatcaaagatttgtctgcagtcctctgtcatgatggaattttggtggtggaagtaaaggatccagttgggactaagtgacatcgtatcggttcctgttcagatgacatggggaagatgatggttcagccactggtactacgagaatgtttgtattacccacatttgaaatgatttgctatgatttttatgaagattaaaaatatatacacagttcctggtatgttgaggttgtctttattattcttactcagaaaggaaaatttgtaaatatgtttgtgtggctcaaactgatactattcttacaactgaaacattgaaaatacagaaggctgtatttggatattagagaggactccgaattgtttcttattattccaacaatgccagctgcatttgtaatcactgatggcaaaagagctatacccatttaaggaattcctatccattttatgaaaatcttttattttgccaaaaagagttgtgattcccttcactcgataagcttttctttttaatgtattttaattaaaatgaggttttataaatatggagtgcaaaaattaaaatacagtatttggaaattgggtctgatatctatttatgatttagtatagttgttactgccttaaaggtcaatgggaattttcagatataaatcttatttttaaaaagttcaaatatgtacctcattcatctttttaaagatatactgaatcctatctgaagtgttttgactttttaaagatagtataagttctatggacacgtacaaaatgttcatgagatatgtatttacatatcctcttgtaaattaatatgaagcttaaggacaccacttttaaaagtttgattgctgaattcagtgagttttaatctgtgctttttagatgctccataaacttagatggcaaaatgtaacacatctgctatctctgcataatccttagctttaaatagcctggcagccaatggaagttcaacacctgagcttacactgcgtgtctgagtttacacagcacatctgatgattggtgcttattatattctcccaaactactgccttggctcaaggtggagacattggtagaggttaaggactagtgccttcaacagctgctctgggacattccaaaggtttgctatctcattctgtatacattaagtatttcttcagaggcagtggctgcctgccttttaccccgcactgaatgtgagctgacaagcagcccaaggacagtgctaagaatagacatggaatgcagggtgtggaaaacaccagggcaaatgcagattgctgacagtatcccagtactcccccacgttgttttactgtagctcaagttaaaatgtaaaagacatgaagcaatagaaaaacgaatcaaacagttctaaaagttattttgaaaacaaatgtaatctgagaagaatgtttactgtctaattaaattgaaaagattttgcagttatatgcatatctgaggtttatgcctatacatggaggtttgtgtgtccaactcagatatgaaaaattttgtttgaccaagtgaatatcacagatcagcttggctgcataacaaagttaatagcagtcgttgagattccagatctactaatatgatcagaactgggataccatttgtctggattatcattctttcccagtgattggcagaatagtgtgaaaagaaactaatgtggtgagaaacaaaaaaaccctctctttcggccttgatcttactctagatgagatcctcctcccgggaaaattcaggaggtgaaattcctaccatgaggagccactgatagaaaatattctctttaaaaataaaattaaagtaaacacatgtctaatgagctcttgtttttacaagataaattttaaagtcttatagataagatatagataagttttaaagataaattttaaagtcttatagccatttttttgatttgggaaatataccaaacactataaataataaaaatcatctatggttcttctgctaccatgaggcagctattttaaatatcttgttcaacaacaggactacataaatacatgtatcacttttcacaaaattaggattatatctgtatggagtttgatatcctgattgtactggctactgtctgttgccctccccactcccaccaagtcaaaccattctctgcccttctcagccccactctgagcccaagcaggctgaccctgatgggccacatcattctagtttctggttgggttcagccaataagaggcactgactggagaccagagattgcagagagattagtgggcaagaggggagaatggtcagggaattcttctgtcgcccttaacctgctgcagaccaaggccctgtcagggctgcatccttctatgactgagttcctccagggctgccactctcacagggcttagggttgtaacactgtctcttcctttcgtctgttcaaaaggaggaggaggggtgactctctgctctttcttgtaccctgtgtgtcactatcccttattgattctccttactttgcccactctctcataaatggtcctttaggcaatggaattgttttctgccagaactctgattgtttgaccttttaatcaattgcagagtaaatgcatgtgatagcaaacatttaagcatacctttagaaagacccagtacggtagatgtacctgaatgtgtgtttcaagttaggcaatctgtgcatggccaacctggagattcgtttttttatctatacatctgagcccccacccagcctgttccatggaatatgtgccgtacaggagattgaggccttgagttttgagttaaatgatggttgccaggtggagttctttcgatggagggtgttaagtgaaagtgctgtagaaactgcataatgtttgcaagcagttgtgttctcccagccagcctgccgctactggactctctcttctgtattaaccccctaataaaacaccgcatttcatctgctggctctgggtctcttctttggcctctttaacctggtgctttccctattggggttgataggtgttcatcgcaacagtgactttttaaaaattagtgcatcgctttctttttctaccaaacaagaactgatttgtaatggctattcactgttccaacaaagcttaattgtattagcatttaaccatttcttttcattcttggttccagtaggaaacagttggaccctatcaaattggaaaaattcaagaagggtttatttataaagagacattacaggctgggcattgcggctcacgcctgtaatcccatcagtttgggaggccaagatgggtggatcacttcaggtcaggagttcaagaccagcttgaccaacatggtgaatcccagtctctactaaaaatacaaaaattagctgggcatggtggcacgtgcctgtagtcccagctactagggaggctgaggcaggagaattgcttgaaccttggaggcagaggttgcagtgagccaagatggcaccactgcgctccagcctgggtaacagagtgcgactgtctcaaaaaacaaaacaaaacaaaaataaaaaacaagagagagagaaacattacaaaggagtggggagggcatagaggcactgcaaaggaaagcggagtaatctgacgttcagtgtggagttgttacgtcccccaggtccaaagggatgggaggaggaagcaggtctcagaaatcaaaaggaaagtcgcatagaggagactaccagctgtgactttcatctgagggcatgaccagtccaaggagacctcttacagggagggagccaggagaacaaatacttcctccttcccatctcctgctagggtcccccattggctggatctgactggaggccagagggcatgggagtcctgtcatctagttcaacggccccccagggcaaagggcaggatggagaaaagtgaggatgaccctcaggggcaggaggataatatccagtactccaatcaaatgagtcctattgtcagagttctctgttagaaagtctctttctacaaagtaaagcttgggatgaggatgggatgaggaagagctgacactttatttggaaagtgtcaagcccaggatagtaaagatgaggaaataggggaaatgagacaaggaaaaactggggagctaagatggtgtgattaggggatgtgtcactgtgctgaccaccacgccacagggagctgtgaagaggctcagcatgtctgtgggcagggatgttggctcagcacagggaatcgctccatggagaagttttcttcagggagaaacaaatcttaaagaagtccccaggaaaatcaaggggagagagggaatttgctcaccttattctctacaatatcccatctcctattagtcaaggttcagctcacaggggataaactttcctgtacttctgggttctatcattcaatgccttgttggaaaccagaccctgatgatgtgacatttcatccaagctgggagcagaagaatgacagcatgattaggagcagaagaatgactcagcatgagtagggctcaaggcttcagtcagtggactcttgctgccttggaagcctggcaaaactgctggcaaaagtggcagcagcatggtctgggaggcaggcgatgccttcagaaacaaggtgtcagtcaaaaagatatgcaaggtttgtatccagtaaaccttaaatacaaaactgcaggaagagaatgccaggcagatcagacagtcttatatcatctactgctctgcaacctacactgccttcagattttatggaccctaatgtcactttatattttgatctaatttttaatccacttaggtgcaaagttagtcctcttaaacatctccaggatttttctttttctgtaaattgtggaccaaggttgtgtgtttattatttaaagctgtctgccagaaagctagaagtcaatgaagattttcaagatttttgttctcagtgatctctccaagtccaaactgcactgaggtatcagggaacctgccccaatattcatgtaggttcttttccattttccttaagtgtcagccagcttgaaaaataaagggacagagtacaaaagacagaaattttaaagctgggcgtccgggggagacatcacatgtcggtaggttctgtgatgccccacacgccgcaaaaaccagcaagcttttgttagggattttcaaaaggggagggagtgtgcgaataggtgtgggtcacagacatcaagtactttacaaggtaatagactatcacaaggcaagtggaagcagggcgagatcacaggaccacaggactgaggcgaaattaaaattgctaatgaagtttcaggcaccattgtcgttgataacatcttatcaggagacagggtttttgagatcaacgggtctgaccaaaatttattaggcgggaatttcctcttcctaataaatctgggagtgctatgggagactggggtctatttcatccctgcagtctcaaccctaagagatggctacgcccagggtggccattcataggcctaccctcaggcgtgcattctctttctcagggttgttccttgctgagaaaaagaattcagtgatatttctcccatttgcttttgaaagaagagaaatatggctctgttctacctggctcaccagcagtcagagtttaaggttatctctcttattccctgaacaattgctgttatcctgttcttttttcaaggtgcccagatttcatattgctcaaacacacatgctgtacaatttgtgcagttaatgcaattattacagggtactgagatgacatacatcctcctcagctgacaggattaagagttaaactaaagacaggcataggaaatcacaagggtattgattggggaagtgataagtctccatgaaatctttatgtttagaggttgcagtaaagacaggcataagaaattataacagtattaatttggggaactaataaatgtccatgaaatcttcacaatccacgttcttctgccatggcttcagccggtccctccgtttggggtccctgacttcctacaacactgaggtcccccacttgtccttggcctatttttctcacctacttgtccttcaaggtagagacacagtcctggaaatcttatttggaaaacgaaacatcaaaaacagaagaaacaacatgcttcccagctagctctcctcattatcctttctgccatcacagcatactgtgccccacactatgagcagcatgccaaaagtgcctggttcctacccaaaatacttcctgaaagatgtccagctagtccaaggctactgttagccaccagcgcactgactgcatttggcaatcgcatgcacttaccaggcacgctggcccttctcaaagagccaccttgaagggttttgtttgtttgttttgtttttttgcctgagtgtctcctgtttgcccactgtgtgcaattgtgtttggaccacgtcttttagcattttctgatattgggaagacagtacagtgttatgaaagactgagaacttcaactggagttccacaggtttttctttcatgaaacattgctttaacacaatcctattcaatttccatacttaccatgaaaccccaaacgagaaaaatgtatggaggtcttgctttacagtagggtgttactcagtaagttacaaaacacatcttggctgtaaccctttgctgggaggcgatgaggctctggatatgaggaaggaaaatggccagtatcagggatatggacaatgctttcttccttaattcctgattctcctaagcttttgctataggcatagcctcttgtccctggaatggattacctaagtgtacacttgtcactgttgaaaatgttatatggatggggacaggaggtggggttggaagcatcatatatggaagccctatgcttaaaaatatgtaatgggatcatgtatggtcagtctatgtagagattgctaacaagtgatcaaaaaaatcagtggattgggtcttgtgtttgtccctattgatgtgattatctgaaagttgatctgttaaggaccttagcaagtcaaaaagttattttcatttattttttattttattttatttttttttgagatggagtctcgctttgtcacccaggctagagtgcaatggtgtgatctcagctcactgcaacctctgcctcctgggttcctgggactacaggcgtgtgccaccacgccctgtagcacaaattttttttttgtatttttagtagagacggggtttcaccgtgttagccaggacagtctcgatctcctgacctcgtaatccacccacctcggcctcccgaagtgctgggattacaggtgtgagctactgcgcccagccaaaaagttattttagaaaacatatgaggcaaggaaaataaaatgagaaaaaactgggaagccaacttggtgtgatgatgggatgtgttactgtgctggttaccatgtcacagggagctgtgaagaggctcggcaggtctgtgggcagggatgctggctcagcacatggaaccgttccatggagaaattctcttcagggagaaacaaatcttaaagaagtcttagccagttgctaggctcatgcctgtaatctgagcactttgggaggctgaggtgggaggatcacttgagctcaggagttccagacaagccttggcaacatgacgagactccatctctacaaaaagaacaaaaataagccatgagtggtggcacgtgcctgtagtctcagctactctgcaggctgaggcgggaggatagcttgagcctgggagggtgaggctgcagtacagtctaggcaacagaacaagaccttgtctcaaaacaacaacaacaaagaaaacccaagaaaataaaaaacaaaaacaaaaaagtcccccaggaaaattaagggaatagagggaatttagcatacaacctcaaatttttaaaaacccatgatttccactagtttaacaaaaatactttttactaatgatcatagttctcttcagagtctgtcaaataattagtcacaaagaagaattaaaaattaaaatgttggtttggtacagctcttatattacattttgaaaataattttatttagtggttgagtgggccggatcccacctccacccctgaccccccgcaaaataagagaggtagtatttttaatttgaaaagcaaatgattcaaactgctgtttacatttcctgtgttgtttaatacacagtgtgtgtgtgtatataaaaatataatcctgtttattaatgttttctaacctcaaggaaatacaaagaatgtgcaatgtggtaagatcaaatgatctgtatgataccattctttgtaatgtgttgttcaaatattctatgttcttcccttttttcccctgatactagaaaacatatagattgttgtcttcgaatctctcaaaattggagattcgaaattggaaaaaaggcagttttccatttttaaaaaaagttctggcccattttttactttgtgtatttttagattatgttgttatacttttaagtttgttgtataaacttatataactttcctaattgtaagtttaaaattgtaatttttttctatcgaattgtttcttatattattatgtaggcccactttttatccctatttaatgcttttagccttaaattctattttgcctgaaaaataccacgtttttattatttacatggcaactcttgttcttttatattcaatatattgaatacactacagtatttaaatgtgtctcttaaaagcagtagcatatagctgaatttttaaaaatgcagtctgatcatctgtcttttagtagataagtttaatccatttacttattggaattaaatatttgaatttatttcttatttcatatttctgtttatcatgcttttctttgcttttttccctttcagattttcggtttacttctttgttttttctactgatctttaagatgttaaaacttaaacactgcctgaaaatttataggctaatatacatttttgaaggaaaataatacaagtataaaaatttaaacattttctttgtctttttttttttgagacagagtctcaccagggtggagtacagtggtgcaatcccggctcactgcaacctccgcctcccaggttcaagcaattcttttgcctcagcctccctagtagctgggactacaggcatgcaccaccatgcctggctaattttttgtattttgagtagagacagcatttcaccatgttggccaggctggtctcgaactcctgaccccaggtgatctacccgcctcagcctcctaaagtgctgggattgcaggcgtgagccaccgcaccccaccaaaaaaactgtcaatatccttctcctgattgtgactaggtcatttgtgtccttactacccactgaatactgtcctccatcttgttgctattcttaattttacttttagactgggctcaatggctcacgcccataatcctagcactttgggaagccaaggtgggaagacagcttgaggccaggagttcaagaccaacctggccaacaatagtgagaccccacctcttatttatttaaaacatttttaaaattaaatttagttttgggctgggcacggtggctcacacctgtaatcccagcactttgggagactgagtggggaagattgcttgagcccagaagttcaagaccagcctgggcaacaaaatgagaaccctgtctctacaaaaaaagaggaaaaaaaaaatcaaaaatgagatgggaggattgcttgagccacaaggtcaagactgcagtgaactgtgatcgtgccactgcactccaacctgggtgacagaacaagaccctgccggaaaaaaaaaaaagttttacctttaaatattgactgttaaaatcctactattggccgggcatggtggcttatgcctgtaatcccagcactttgggaggctgagtcgggcagatcacctgaggtcaggagttcgagaccagcctggccaacatgtcaaaaccccgtatctactaaaactacaaaaaattagccgggcatggtggtgtgtgcctgtagtcccacccactaaggaggctgaggcaggagaaggagaatcgcttgaacccaggaggaggaggtttcagtaagccgaggtcatgccattgcactccagcctgggtgacagagcgagactccatctcaaaaagaaaaaaaaaaatcctactattaaaagaaaatgtatgaatttctgtgctcacctttgtttcttgttttccacagctgaactttgggttcctatctcttccggttaaggtttctagttattttgaggctctgtaggtgaaaactgtctttacattgcttcactcttgaatgatatttagcaaggtataaaattctagatgaatggtaatttttacctcaacactgtaattattctgttgtcctctccacttagagtggagttcttattagcagcaacataatcgttcctttgtatataatctgttttctctggtagtctcagatattttctctgtgatgttctgtggtttcactgtgatttgtctgggcttggatctggatttgtttgtgctgcttaatatgcagtctgaacaaatatctttttttaaaggtctggacatttcatggctatttcttcttcacatgctctccacaaaggctccattcccttcagttagaactattactatatatagattgaagcctctcaaaagcccttggtctttctgtgctctatttctagctgaattcctcagtcctttcgttctttctttccttttgaaatatgccatacatatagaaaaacttaattattattgttcatatgtttttttaaaagatcatccatgtaataaatcacccagcataagaaatcggtcactgacagcacccagaggctactctccttccagaggcaaccaccatcctgtcctatgtgatgattaagaaaagataaaaatgttactacatgtatttgcatctctaatcaatgtagtttagtttttacttgtttaaactttatataactggaagtatagcctatgtattttttgtgacttacttcctttactcaagattgctttagcgccatccacagagaacagtactctgttcatttttattgatgtatatagttcattgaataaatgcaccaatctgtgaattctattgataatagtcattcctttatgatattaaaatatattttgtttttatagaggcagggtctccctgtgttccccaggctggtctcaaactcctgggctcaagggatccccctaccttttctcccaaagtgctaggtttacaggcatgagccaccataccggggcgataatagatattctcttttaaacattaaaaaataatttgttaaagatggggtcttaagctaggtgtggtcgctcatgcctgtattcccagcactttgtgaggccaaggtgggtggatcacttgaggccaagtgttcaaaaccagcccagccaacatggcaaaacactatctctactaaaaatacaaaaaactagccaggcacattcctgtagtcccagctactcaggagacatgagaatcgcttgagcctgggaggcagaggttgtagtgatctgagattgcaccagtgcactccagcctgattaatagaaaaaaaaaaaaaaaaaagacaggatcttgctctgttgttcaggcttgggtgcagtggtgtgatcatagctcactgcagccttgaactcctgggcccaagtgatcctcccatctcagcttcctgagtaactaggactacaggtacatgtcacaatgcccagctaatcttttaattttttttgtagagacagtcttgctttgctgcccaggctggtctcaaactcctggcttcaaacgatcctcccgcctcagcctcccaaagtgttgggattataggcataagctttcatgctcaaacaataatagacattttttattaatttagagctatagaacaataccactatgaatatttttgtacatgtctattggcttccggatgcaggaatttctttctttttttagaagcaaagtcagtgttgcccaggctggattcaaactccttggctcaagcgatcctccaacctcagcctccctagtagcttggattagacatgtgccacttcacctggctaatgtgcaggaatttctttaaggtatatacctaagaataaaactgatgaagtattgagtgtggccaccttccatttaataaatcataccagcgttttccaatgtgatttaacaatttatgttaccgttagaattatatgagggtttgaaattatcctaaatcctcatcaaaccttagcatactcaggcttaaatttttgccagtctaattgtcttcatctgtatgtgctgctataatggaacacttgagactggctaatttatgaaacacagaaatttatcttttataattctggaagctgggaagtccaagatcaaggaactggcatctggtgagggccttcttactgttttctcacatagtgaaaggcaaatgtgcaagagataacaaacaacactctctgtcaagttcttatataaggacccctaattccattcatgagggaggtgcccttgtggcctaatcaccccttaaaggcccatctctttgtactatgagattggcaacacctgaattttggagaggacccattcaaaccatagcactgtataatgtaaagcacagagagatacgaagtctcatttttaccatgttactgagtttatctcatgtgtgttctcaatggctatggttttaattacattttttatcaaactattccttttttctttttttgtgatggagtttcactcttgtcacccaggctggattgcaatggcatgatctcggctcactgcaacctccacctctggggttgaagcgattctcctgcctcagcctcccaagtagctgagattacagatgcctaccactatgcccagctaatttttgtatttttagtagagacagggtttcaccatgttggctggactggtcttgaactcctgacctcaggtgatccactcaccttggcctcccaaaatgctgagattataggagtaagccactgcacccagcctatcaaactattctgcctgccatttctttcataatttcttattctttttaaatagacataattctttgagcatcctaaacataattattttcaaagtctttattggattgttctatatattaattttatctggagagaattcaagttcaaagtatggactagtttgattttcttagcattaagttttttgaagtacttgggaattttggttttcaggcttgttttgtgtgaaacagtagttgttgttatcttccctctatcccataatcaaccttccctatctagaggatttgctgttaactttgctctagactttaacttgaggattttagaaatctctgcctcaaagtgaccttgtgaatactgcagattcggtcatcaaacaagcatgaggcttggtgattttcttctttcttcttagaaagcctgcaagtggtttcagttccctttactgggcaggagggtctccacacaccacagctcccagtctcacatggtgaatctgtctcctgtcctctgaattccttgattctcattacttttcaagacccaaagttcccctgtcactgtccatttctgcctgaaagccagcaggcacacggtgtcaatccactgctttctgtttctgttttgtttgagtctacagagctgtttatcttatttttgagactggctatgtctttttgtttttttctgttttatttataatcgccaagggttatggcagtacagtgttctactagattctaaattttctcatgaaatatgtcaagtgatgggatggaaaggagagattagatatctagtaaagaatacagtaagttcaagcattgatgaacccctcctttctcattgcaaattgtctcccatcggtggcagctgtggctaaaattagctgttttccctccttcctccctcattttccaatgctttaaaaatagagtaatgcagctgcatttaagatgcttaagacttaacttattttttcagaactcatttcaaacttttctcattcctggagcagatcatttggacaaaatgatatctcatttttgttttcattcttttgcaattacgtgcatatttgaactaagttcataatgcacatgattcacaatgcaaatgcaaaccacatttagaatcaagagacagaagataaaaggtctttggaaatgttgatagaactcttttctttaatatttccaaataagtatagaggtgtgttggaataaagatggccaaacatttttagactccacctctaatgacaagagtagcaatttgctctcccatggggtgtagactgtccttgtgtccctccttgaccagcagaataagaaggaaggggcactatgtaacttttgaggttgggtctgaagaaatctaaagctttcctattcacactcttccatacactcccttttaaaacccaagctacatggtgaaactccttggagaagaaccaaagctctctctgagctctctcagctaagctcctatccaacaagcagtcctagctattagctatttaaatacccctccttgacatttcagcccaggcaagcctccagatgagatcatatggggcagaaggaatgcccagctgagcccattatcacagagaattgtaagaaaatacagattgtggttgttttaagccactgagttttgagtggtttgcatcaaaacaagaggaaaacgaattctagtgactttggtatcttgccaaagcaaaattatatggctaattatcagatattcctatgtttatctttcaaaaaaactccacctcttcttgtacaatctagtaatatatattgagttcctatgttagggaactaattagaatttgtacatatctcttaattgtacatatcacttcaaaatatatctgaataagaaacctttttgtatttgacagttcccccagttttcaaacctattgattccctattagtttttcaccagaactttagaatacatgggagctgctctactaaatgttaaaacataatgttacggtaattaaaataatgttaacataagagtaaatcaatagaaccaagtaggagacactgatcagaaccccatcacatcctagagtttagtttgataatagtagcagttgcagttgtaatacatgttaacatgattctgagagaggagaaaggaagaaactggtcacgcaagcagttagggtgagtcttctgttgaattgtttcaaacaaaagaacaccccaaaacatcaagctaccggcacagataagggaacttgcatgggagattgcctaagacaggcccacagccacacagataagaaaggctatacagctcagtttcccagacatgcccacaatgaaaaattttgtcccctgacacatgcacagtaaggggaacaaagcaatatggaataactcaagctaagggcccccgtgtgcactaggaggatggggtggagctaccacagattcacaccttatgcaaatgagatgcccagctctcatcagtttcctataaaatcctctgcattcaactgtaaaaacagcaaccctcttccaggtcccccctgcacaggagagagctttcttctttcacttattaaacttttgctccagtgttacccttggcacctgtgctccttaactttcttggtcgtgagacgaagaactttgggtgatatgtcaggctatgagagactgctacgttgtggtgtattggtgagacataacaattcaatgtatgtacctaaggtaactgtagacctgtctagaaaaatgaaattaaaagctcatccctatcatatatatctcaaaaagaaaaattccaaatggactaaaaagtaaatgtaaaaacaaacaaacaaaaaagctctgcatgtctgctgcgctggttgttctcattcttccatccccacccctgacctctgatcttctctgccctgttctgtgttctgggggtctgtcctctggcttcaggctggattcactcaatggaaggcaccagcaagagagcagagggtggaaggaaagggggatttaggaaatttcttctccaactctcattgcttcaggtccaggttctggcaggggctgcctcctgcagtggctgcctctctgatgagactttctctcctggctgcagcccacactgggcaagtagttccattttctttcccttaatccttcatgctctggggggtaatggcatcccctctattacaggtctctgggtgtctcaccatttttgttcatccttcagtcctgcccacatctctataaataatcactttattgtatctttttaaaatccaagctgaatatgcattttgtttcccttcggtactcagggtgatatatctacctatatattcttctagggaagacttttaaaacaagcaaaaagacaacaaaaaaatagcaaaacatcaaaggaaattttaaaaaaaaattttttttatttttttgagacggagtcttgctctgtcgcccaggctggagtgcagtggcgcgatctcggctcactgcaagctccacctcccaggttcacgccattctcctgcctcagcctcctgagtagctgggactgcaggcgcccaccatcatgcctggctaattttttgtatttttagtagagacggggtttcaccatgttagccaggatggtctcaatctcctgacctcgtgatccacccacctcggcctcccaaatgctgggattacaggcgtgagccaccatgccgggccttttttttttttttttgtcgagacagagtcttgctcagtcgcccaggctggagtgcagtggtgcaatctcaactcactgcagcctccgcctcccgggttcaagtgattctcttgcctcaacctctccagtagctggaattacaggcacacaccgccatgcccagcttatttttttatttttagtagagacggggttttgccatgttggccagggtggtctcgaactcctgacctcaagtgatccgctgtgtcggcctcccaaactgctgggattgcaggcatgagccaccacgcctggccacacctggtaattttgatcagtttgcttaacccctctatgcctcagtttcttcatctgtagaatgggggtaattatggtaccatcacatacagttgtttggaagactaaatgagatgaagatgtagagtgaccaacaagcctggcttgtccaggcctgagtggtttctcaaaacacaaaacttacagtgctagaattgggacatcccaggcaaactaggagagttggtcactccataagatgtcaagtactcagcacaaagcgtggtacagaatatgagttcaataaatattagccattattttatatatttcaaatatgtatttgagcaaattcccagtcatgttttttatgtagtttaattatgtacatctctaccttatttaaagactaaaacataattttaaaaaataaaatgcttcattagtgaatcaatatcactgttcatttctaacgtctatttggttatttctaaaattctatgattctgtcttttttggttttcattttgttttgtttctgagacagagtctcgctctgttgcccaggctggagtgcagtggtgcaatcttggctcactgcaacctccacctccagggttcaagtgattctcctgcctcaacctcccaagtagctgggattacaggcacccaccaccatgcccagctaatttttgtatttttagtagagacggggttttgccatgttagccaggctggtctcaaacttgtgacctcaagtgatctgcccacctcagcctcccaaagtgctgagattacatgtgtgagccactgtgccccgccaattctttttgttgattgctctgtctctgtctttgcatggccaccttctccctgtctgtccctgtgtcttcacaaagtgttctctccctgtgtctctgttttcttattaggatgccagtcacattggattaaggcctaccttaattgggtgacctcatcttaactttattacatctacaaaggccctattttcaaacaaagtcatattcataggtactcaggattaggatttccaacatacctttttgggggacataattcaacctgtaacaccgtgaaagaccagctcagtttcttaacaagataattgggttagaattctttacttttaaggtactgcccaagcagcctgaacttctccagaagcttaatctcatgtttagcatgttgtctcacatgctacacatctctaaagatttcctccaaaccagtataaactcatgaagaaagacaatgagcctcaagttattctttttaaaaaaataatagctttatcaagatataatttacataccataatttacccatttgaagtttgcaatttgatgggttttagtgtatctacagaggtgtacaatatcaccgcgatcaatttctgaacatttctgttgcctcaaaaagaaaccctggacctactagccatcactccatctttcttcaacctcccctgtctcccctatcccccagtgggcaaccaccagtctattttctgtctctctgaatttccctattttggtcgtttcatataaatggattcatataatacatggccttgtatgtttggctcagttcaagttattcttctattttaaatgggtgaaagtctgacatgtgggtgggatgaatgagtgggaaccttgccctgaaaatcacttgcaccttgtaattatttcaacatggcctcacaaagagttatcacaacgtccctgcattgcgtgggcttcaacaagtgatgatgattgggttccgcgtgtgtagatcagctcctataattacatccaatgttgtagaacatgggtgctcttcaccccaagggccagctggtccattctgttgtagcatctcattggccagggcctccacctctcttaaggggaggatgtgtccactcagtgtccagcctggcaaaaggtgctctgtaatgtgcactcccatcctccatcccctccactaccaccctataggcccgtttcttgtgcagatggatccacattcttccaccaatgaagtggtgtattttcttattttgatttttctttttgtattttttttcttccacaaatgcctacttaccctaaagctgtacaaactgaaaaggccactcaggtcatcttttatagggcaaagaaaatcaaattctatccctccttagtggtaaatagaaaagcatgtgaggctacaaaaccaaacactggaaataggacaattactgaattcaacgaaattccatatatcatttagacacttcgttaatatttgttaactataggacttaacaaaattacagatatcccaaaggagccagactaaatataggctgacctggtaattttccagcagatgatagtatcactctctttgagagacaagggaaaaatacatttatacaagtaataatcatttttatctgatttattcctgttcttttctccaaacattatacaatgctatgttttataagtaacacgaagaaaaagatgtactgtttgtttcagaagggacattttgaaagaaaagaaatcaccatgtgtagaaggatatattttaacaggacttctttattcctttccaactcactgctcatcaccatggcatgtatactcctatttctatttttattccctttaggactgttcctagatatttgtaactagttctctatacctgtaagttttcatttgcccagggttatgtcttcttttattttgatttttcttcttgtattttcctcttccacaggtgttctttcattcctccctccccgcaccatgcttactttctgtcaacctacttctctttccttcattttctctctagcatttacttccttccagttttctgatctagagtcttcagtgcttgtgttatttcttggctgtatgatctaggatctgttatagagtgaccaaccatctgcttagccctacactaaaacccctcagtcctgggccaactaggctggttgatcactctacttaacaagttacctggggaaataatatattgacactaacgtagagaggatgagtgactggaatcagtagcatcctactatgttgctgttgctttttagtgaataatcattggaagagaatgcaaatgcaaaaaaaaaaacaaataggggttataaccgattattagcaagattctgatgaactgagggaccacagaaactaagtatgtgagtaaaacagactttgaagatgagtgtgagagactgagttggtcattagagccatcggctgtaaagtttgtgtgcagcctgaaccactgtgtgctgcactcaggagaaaataggatgccttctgcactgaggagtttggcttggataaaaaccattgtactgacaatgtagtctactccagagtaactgacaaaacagggggagacattgaggacataacaacatggctcttccttctcctgagaagcattgtcaaagctgagtagttgcaccagtttgagttacagcattggggaattcccccagaagctgagtgggagctctacccggggctcagtctgtggctgtcacttgtcttcttgcacagagcttacttatgagggaagtaaggggctataatccttggaaaacacaggcttcactacccttttcattcgaccattaaaaggaccattcctctttggatgtggagaaataggaacacttttacactgttggtgggactgtaaaccagttcaaccattgtggaagacactgtggcaattcctcaaggatctagaactagaaataccatttgaccaagcgatcccattactgggtatatacccaaaggattataaatcatgctgctacaaagacacatgcacatgtatgtttattgcagcactattcacaatagcaaagacttggaaccaacccaaatgtccatcaatgatagactgcattaagaaaatgtggcacctatacacgatgaaatactatgcagccataaaaaaggatgagttcatgtccttcgtagggacatggatgaagctggaaaccatcattctgagcaaactattgcaaggacagaaaaccaaacatcgcatattctcactcataggtgggaattgaacaatgagaacacttggacacagggtggggaacatcacacactggggcctgttgggtggggggaaagggggagggatagcattaggcaaaatacctaatgtaaatgactagttaatgggtgcagcacaccaacatggcatatgtatacatatgtaacaaacctgcacgttgtgcacatgtaccctagaacttgaagtataataataaaaaaaaataaaaaataaaataaaataaaaggactattcctctttcatcttcagattgtctttggacatgccaatctccttggtaagaggtgatgctataatataagtaatccctgctaagatgttattaggccagacccctattgactgcaataaagataacaccatgtcctggagaccaaaaaaagagaccaagagacagtgaatgagatatagtgcttatataggggaattacatacaggaatggtccagttgtggtgggctggaccggaaaactactaccatgtgtaaaaagcatgcagcttccatagcattttcacttagtaccctctacctagcaacctccagtttgcaacctccaggtaacccaaaacaaagggcctccatctcctgtatggcctgcattccaagggaagggctaggggttgagatgcccttcatggataaggagtgaatctctaggttggccactcccagattccttagcctggaactctgaacacacattcttcttagaccatagggccattttcagggtattctcaagttcagttactgctgtcaggtgtgtctcccatatagctgataattgatgacttaagctatttttagaagtcatatgaagaaaggatcagtagtcccttcacttgccctgtgagagagtgtgtcctgctttcagagacacacaatggccatttgacaaatttactaagaccattctgaatacatgagaaattatttcataatacacccattctaatggaaagcatagaactgtgagattatcaatggataaaggaagtagaatttacgattcccaagtagttatgtggaaagtcagactaagccattcttccttgcctttttcatttggcaaactgccctgagcattcactatgtactgagcaccctgcttggtgttgcagataaaaatatggaaacagtatgattcttgacctcaaggcacttatgctaagacttctagaatggaacatacgtataaacaaagaaccgtaatgagggttacaagtgctattgtataatcatactcagatcacaacgtaggtactaaaaaaggtgtggtctgctaagaatgatggtttccagcttcatccatgtccctgcaaaggacatgaactcattcttttttatggctgcatagtattccatggtatatatgtgccacattttctttatccagtctatcattgatggtcatttgggttggttccaagtctttgctattataaatagtgctgcaatatatatacatgtgcatgtgtctttatagtagaatgatttataatcctttgggtatatacccagtaatgggattggtgggtcaaatggtttttctgattctagatccttgaggaattgccacactgtcttccacaatggttacttctctctgagccaggggagggtggctgtggtctctttaatgatctagcctactatatcttgagggtaaagtctatgactgtggtcactttattcatcattgtatctgtaccatcttgcacatagtaggtgctcagtgagtagtatttaaatgagcaaaagctgatgttgtcggagggcatggtgtacatgaagcaatgtaagcagtttagcccaagagtcaagatcctgcatgatcaggccctgattccctcgccagcttcatctcccaagcactgctccccttctgccatgatgaacagtttgagctttatcctgggtcagtggggacccataggagaagtttaagcagggccatgatgtgacaagctttgtgttttagaaagctctggctgccgtgtgaaggattgactacagagggcaaccctggagctaagaagatcattcagttctgtagtagttcaggtgggagaatgcacctaagaatcccctggtgtttgtccagggcccaccccaggccatttaaatcagaatctctggtgatgggatctaggcatcagtagtttctaaatccttccagatgattccagtgagaaaccaaggctgataatcactagtgtgaattaagagagttgcagaatggaaagggggctatagatgcaaaggctgttagaggtaaggggacagcatgcctagctaacagagcagggccaatgaagaaaggggaggaattgaattattcacaagttctgattggagtcattgaaaatgggaagtagggtgatcaaccttcccattttgccagggactatcacagttctcttactgaagatctctcattctgcaatagttcgttactgacatggcttggatctgtgacctcacccaagtctcatgtcgaattgtaatccccaatgttggaggcagggcctggggggacgtgattggatcatgggggcagaatcctcattaatggtttagcaccatccccccttggtactatatagtgagtgagttctcatgaggtctgatctccctcctctctctcttcctcctgctccagtcatgtaaaacgtgcctgcttcccctttcccttccccttccaccatgattgtaagtttcctgagacctccccagaaacaaatgccagcatcatgcttcctgtacagcatgtggaaccctgagccaattaaacctcttttctttataaattacccagtctcaggtatttctttacagcaatgtgaaaacagactaatacaacagggaggatggtagtaccattcaccaagataggcaatacaggatcagagtgtggttgggggaaaggtgattaattttaaacatgtaacagctgctaagtattggtgactaatgccattctaagctcacagctgaggatcatatgagttaaatcccccacattctaaattcctagaaccacagctgttggagtgggtcagccacaccctgacaaggtttgctaagaggaaccaggaagcagaaccagcagcaacacctctcaccctaatataaagtgagactgaaagggagaagactgttgccttttgcagaagtgcagtgctcatttaggatgatttactcccaagaacaagggtagggggtaggttgcctcccatcctcaaagccaagggtaagagctgtcgagagaaccactcacaggtttgtaagtatctgatatgtgctacctgtctgaacagctgaaggatgctaggctcactgtccagcccctgtgccaccacagtagaggaaaaaatacattgggaagagatggcatgatggggggctgccaagcagggcaggggtcgaaactgtcttcacttgaagtcatggtgtcctggaggcttgaaaggtggattccacaaaagcctgaagacccaggagttggctgtggtgagtagaccatatttggagtcttggtcttgtctggctatgctgcaatattgggcaaagaggggcacacatcagaggaatgggacataaggccaccagctcgagggctgggcttgaagttgagaatgaatctcttataaggaacccctagcatctagaattactggttgggggcaaatcccctgtctgaagatgttgtcttccttcatctgtccacactaacacaatggcaataagctgggtctcacggggcacctctcccttccatttttctcctccatggtcattaccagcaggaggtatggtagacttacaagttgtgtgtgacccagatcacatctctattctgcagggcataggagaggaggagagagccatgcattggatatgaaactaaagctttaaaataaaatcattggatcttaagaataggaagtcttttttttttttttttttttttttgagacagagtctcagtcttgctctgtcacccaggctggagtgcagtggcatgatctcagcttactgcaacctccgcctcctgggttcaagcaattctcctgccttagcctcccaagtagctaggactacaggcacccacccccaagcccagctaatattttttatatttttagtagagatggagtttcaccatgttggccaggctggtgacctgcctcagcctcccaaagtgcaggagccaccacacgtggccattttttttttaacagctagtagtaactattctaatgactaaaagtgaccaagacatgatatggggctgaaattattaaggaagtctgctttacatagaaaacaggattttgacccagcagtcattgccatgttgtgggcaactttatagagaggccaaggtagtgagagactgaagccttctaccaacagcaatgtggaccccagccccttcagatgtgacagcttgactgcaacagcataagaaaccctgagatggaaactgaagctaagatactcctggattcccgaaccccacatattgagagataatagatgtttgttgttttaagttgccagttttggggtcatttgttatgcaacaatagataaccagtaattgtcctgagttgggccaaggggaccagacctttacatcggactcattgattagtcgttggatgcaggctgtgccggaaggaagcgtgactctggacgaggccgttttcttcagccaaggcagccccccagaaggcagtcagctgaaggctgttttcgggcaacattcgcagcagccgggtgaccaagtcctttattgctaaagaggagggatctgggcagttcatcaagtggttagtgggaggctcctgtgggtctcctgaaagaagtttctctacccaattaaccaccttagcccaagatgtcaccagccaagggagaaattggagtttgaggagcctgggagccatgcttcgtcttctactttcctcctgaccactgctctctttttaaatggtggtgtttcactgggctttatccttgactccctcctacatctgtaggaggggatgtagggagagcagtgtccatcaggttgaggaagaagagggcattaggaagacagtcgtggtcagtgagtgtttgctgaatgtattggttggggtctaaggtgaaaccagacagcacacacaaggcgagtggcagaaagtagcttaacaaagggactccttacagaattgaggtcaggggtgaggggccccaacagggaccacaggattcttccctcctctaggcctggggggtgtgagagcatggagtgggtgccagcacttggagagggccatcttcatggagaaatctgactgttggatgaagccatggccttcagagaggaacacaggcaaccgaagtttggtactgcccataagtcatcctcacggggcacacggcagggtgaaggagggcaggaagctcatctgcaagggcaagaatgaaagggagtcagcagacaagagttagaaatgttcggccaggcgcagtggctcacgcctgtaataccagcactttgggaggccgaggtgggtggatcacctgaggtcaggagttcaagaccagtctggccaatatggtgaaaccccatctctactaaaaacacaaaaattagccaggcacagtggtgggcgcctgtaatccccaggtacttgggaggctgaggcagagaattgcttgaacccgggaggcagagattacagtaagccgagattgcgccactacactccagcctgggcaacagagtgagactccgtctcaaaaaaaaaaaaaaaaaagttcacgactgatctcccttttaatagcaatttaaaatgtgaatgtttgggtacactcctaaactttaaggatgatatcagagaaactagtactctttttctgtaagtattcctggtgccactgacagatcctagctaaagagaccactggtctgattcagtggagtattactttcctaggaaattataaagttccctaggacactgtaattggctgtgtcagtgttgatatgctagctgtgatagtgtactacagttttgcaagatgtcaccattgtgggtaaccagctaaaggatacaagctatctctgtattattttttacgactgcatgtgaatctgtaatcatctcaagattaaaaatgtaattaaaaattaattcacttattctacttgaaggaactaagaacatgctactccaaactatgctgctctggtatattggctattttgtgtttagggactgaataaaacagcaggacaagaggatcactcagcccttccttttatttttttgaaagcaagagatgaaattcccatgtgaaagatgccctccttataccagaaagaaggtattattcttatcatcaaggataggagatctgtactaatgaaacttgttaaattaatccttattttcctagtcacttctctacccagttaaccaccctagcccaagctcctttaccttgtcacattttaataattcatgactctttgtctaattcagtataagtgttcaattctgcatctttgaatcttcatttccttagccatgtaacatgtgtattacatttgtatgcttttctcctatgaatttgtcttctgtcaacttaattcctaggcccaaccaaaaaaccctaaaaaagcagaggtcaagttttactctccctacacgcttatgataattaaatgtgaggctttaaacttcgatgtagagttccccagtaataactcaactacttagtattctaattttaccggaatgaaatctttgagttacttgatctgctatgacttgaattttatttctgtcaaactcggctgtcgttgccttgaataggaagaataaatccaaagcctgggagagaggcctgagtccttgcaaagccagtaaacaaaatcgtaattggatctgcctcatgtgcacacagggttttacctctcctgttgatcttgtggtagaactcctctgcatggtgtgctgttctcctacagacagatttggagaacttacatgctgttgttcttgaacaggcttttcagttcttagaattaactagctcatgtatcattagaacaaagtagtaatttaaaaaataaatctacattaatgggctatttggggggaacaacagctgctccaagatcacagaggagaagagggtgttaaaacacccaatcctaaagatagttctagatcagaagcttgatgactaattcaattaaaatgagtgtgtgtctgttggctgcataaatgtcttcttttgagaagtgtctgttcatatccttcaccaactttttgatggggttgtttgcttttttcttgcaaatttgtttaagttccttgtagattctggatattagccctttgtcagatgggtagactgtaaaaattttctcccattctgtaggttgcctgttcactctgatggtagtttcttttgctgtgcagaagctctttagtttaattggatctcatttgtcaattttggcttttgttgccattgcttttggtgttttagtcatgaagtccctgcccatgcctatgtcctgaatggtattgcctaggttttcttctagggtttttatgagtttaggtctaacatgtaagtctttaatccatcttgaattaatttttatataaggtgtaaggaagggatcctgtttcagctttctacgtatggctagccagttttcccagcaccatttattaaatagggaatcgtttccccattttttgtttttgtcaggtttgtcaaagatcagatggttgtagatgtgtggtattatttctgagggctctgttctgttccattggtctatatcttgttctggtaccagtaccatgctgttttggttactgtagcactgtagtatattttgaagtcaggtagcatgatgcctccagctttgttcttttggcttaggattgtcttggcaatgctggctctttttcggtttcatatgaactttaaagtagttttttccaattctgtgaagaaagtaattggtagcttgatggggatggcattgaatctataaattaccttgggcagtatggccattttcacaatattgattcttcctatccatgagcatggaatgttcttccatttgtttttgttctcttttatttcgttgagcagtgctttctagttctccttgaagaggtccttcacttcccttgtaagttggattcctaggtattttattctctttgaagcaattgtgaatgggagttcactcatgatttggctctctgtttgtctgttattggtgtataagaatgcttatgattttgcacattgattttgtatcctgagactttgctgaaggagatttgcttactaaggagattttgggctgaggtgatggggttttctgaatatataatcatgtcatctgcaaacagagacagtttgacttcctcttttcctaattgattaccctttatttctttctcctgcctggttgccctggtcagaacttccaacactatgttgaataggagtggtgagagagggcatccctgtcttgtgccagttttcaaagggaatgcttccggtttttgtccattcagtatgatattggctgtgggtttgtcataaatagctcttattgttttgagatacgtcccatcagtacctagtttactgagagtttttagcatgaagggctgttgaattttgtcaaaggccttttctgcatctattgagataatcatgtggtttttgtctttggttctgtttatatgatggattatgtttattgatttgcatatgttgaaccagccttgcatcccagggatgaagccaacttgatcgtgttggataagctttttgatgtgctgctggattcggtttgccagtattttattgaggatttttgcatcaatgttcatcaggtatattggtctaaaattctcttttttgttgtgtctctgccaggctttgatatcagaatgatgttggcctcataaaatgagttagggaagattccctctttttctattgattggaatagtttcagaaggaatggtaccagctcctctttgtacctctggtagaattcagctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagacagtgtggcaattcctcaaggatctagaactagaaataccatttgacccagccatcccattactgggtatatatccaaaggattataaatcatgatgctataaagacatatgcatacgtatgtttattgcagcactattcacaatagcaaagacttggaaccaacccaaatgtccatcaatgatagactggattaagaaaatgtggcacatatacaccatggaatactatacagccataaaaaaggatgagttcatgtcctttgtagggacatggatgaagctggaaaccatcattctgagcaaactatcacaaggacagaaaaccaaacaccacatgttctcactcataggtgggcctgtggacacaccagggcctgtcgtggggtggggggattggggagggatagcattaggagaaatacctaatgcaaatgacaagttagtgggtgcagcataccaatatggcacatgtatacatatgtaacaaacctgcatgttgtacacatgtaccctagagcttaaagtataataaaaaaaattgaaattataagaatgtatacaaacaaaataaaaatgaaataaaataaaataaaatgagtgtgtggaatatgtaaagtctccaggtatgtttttacccccagatttttttttttcacaaacttaatacatggggctgggagtggaggctcatgtctgtaatcccagcactttgggaggccaagttgggaggattgcttgagctcaggagttaagaccagcctaggcaatatggtgagaccccatctctttaaaaataataataataataatacattggtaggctaaagttgcagaacaaatataattcttggtcctgtatacaaaagaaccctcagtgatagtatgctttttattcaaatccttgaagatcaaggtttaagtagttttattttagggtaggatgtgtttcatgcagcattaattttattgtctttttttaaaaaagcatgtaattggtgtagtcaggactgaaattttattcgtctcctcagatgaaagtagtatcttattaaacagccctagaccaggaaatacaagggcattataatgaataattctaagctcattatgatctcagtgaataggttcagattcagcacaatactagaactgatgtttattaacactgatggcacaaagtacatgtctgatccacttcaatggagtcattatttagtgtgacactgcactgccaaatgcagccatgtttgtggaaagacaggaagttgtcacagggccaggagcagtggctcacacctgtaatctcaacgctttgggaggccaaggtgggaggattgcttgagcccaggagtttgagaccagcttgggcaacgtagtgagacctcacatctctaacaaaaaaaaaaaaaaaaaaaaaaaaatagaaaaaataaaaaaaaaactagaaagtcattacaacaaaattttatgccagaaaatgtactatcaagacccatagacatatgtaaacatggtctctttcctaggcatggacacttatacctttatcacctaagaaagatgaaggtctaaggcagaaacacagctcctttattagctaaaacgtcttgtaacatcagacgccttaaattatccactaattacatttaaataaaaaatgtggggacaaattagctttaatcgaattaaaatgaaatttctagtgcagctagatggctgttttgctagaatctgtttagctgtaaattccatttagagttgttaatagtattcctcttcaactctgtttaacccacccatcatcatggtgaattgccaaatgtcttacaaggtagaataaatattcttggacctcttttcaggtcaggcatcattggaaatttctccttttcactttactattatttttgagacagagcctcacacaggctggagtgcagcggtgcaatctcagctcactgcaacctctgccccctaggttcaggcaatcctcccacctcagcctctcaagtagctgggattacaagtgtgcaccactatgcctggctaattcttcttttcttttctttttttttaatctttttttttttttttttttttttttgagacagagtttcactctgttacccaggctggagtgcagtggtgcgatctcggatcactgcaacctccacctcccgatttcaagtgattcttctgcctcagcctcccaagtagctaggactacaggcgcccactaccacgcccaggtaattttttttttttttttttttagtagagacggggtttcactatattggccaagctggtctcgaactcctgacttcatgtgatccgcccgccttggcctcccaaagtgctgggattacaggcatgaaccactgtgcccggcctaagtttcccttttttatttaccagtcctgagctgggttcacaacctgaattaagtccttgttgtgcaattgtgtgatgttatgactttgctgagcttcaatttcctcatctgtaaaatgaggataatgttgcagcattcagagacaacatatataaggcacctagcacagaacctgcccacagtaggccctaaatcaatggtagtcaacatcaaataaagctgattaaccagcttgatttgaaacttatttctactttagataatttcacaataagtctgagacatgctgtaacaaattttcatgcctctccttcataaacatgaatgacatgaatgaagcaaaacgaacatttaggcctcggttttcacagataaaagactaggtagtgacctctagtggtaaacaggcaaaatgcctaaaggcgatacattttctcccttacttaggattcagcctgaaattgatcacagaagtgcaatgtaaagctatgagatcaaatgtaattaatacttggataagaatttagccttcatgccattctgtaaaacaatgaaataaaggaaaatgtccttgccttctgttatgccaaaaattgcagtttaatcatatgagtaacaaaagaatcggggccaggcaaagtggctcatacctgtaatcccagcactttgggaggccaaggcaggcaaatcacttgagcccaggagtttgagaccagcctgggcaacatgtgaaaccccgtttctaccaaaaatacaaaaattagcctagccaggcatgatggcatgtacctgtggtctcagctacttgggaggctgaggtaggaggattgcttgaacctgggaggttgaggctgcagttagccatgatcacacccctgcactctaacctgggtgaaagagcaagaccctgtctcaaaaaaaaatcagagccagaaaaaaatcaaattatatttgatttttttgacaaatatgagctattttgattcatttttgcacaaatgaccagatgttacattaaaatttatttcagtagtaccttaagtggaattataaacttctttccaagtacatagagtagttcataatggatcattttgcagaatttctgatagtgtcgtaaaaagaaaatgtgctgtaggatcttcactgatgacattgtctaagcactagttattacttacagagcttgccttcactggacattagcagggctggttcccatccagcttctgaactcttacaatctccatttctgccaacattactgctcgtgaaattcaatcagtacagtataggatggtggttaagagcatgaactctgaagccagactgggtttaaatcccagctttaccatttgttgactatgagagattgatgcctcagtttcttcatctataaaacatcagtgttaataccagctaccttataggtggttctcatggtggattaagctaatatatagacagtgattagaacagagcctggaattattattgagcagatgttatgcacctataccattctagggactatagagaatgcatccaaagctgaaaatccaggccctgtcctcaagaatttatagttgacatggaaagatcttgctagaggaatgggccttcattccacttgttggtttgcaggagggggacttttttttttttaaacatatgcctggcttcttatgtccctattcttgttcccctgcaagatgtggagcaactttcttggagtgaagtggcattgggcgcagtcccacaaggaaaaggacacatatttttgaatgcagttaggaagtatgtttggcccttactctatagtatatcctacaatttgcctccatcaataataaaggtaataacctgggttctgggggtcaactaccggttatggttcatttttttcagaactcagccagaagtggcaaactatttactgaggagacacttagagaccccacaaaacacaagagccattcagcgccaacttctatggtgtgaacctactataaaagcatttccagaaatgagaatttggtgtagactgaagcaacaggaattgatttcatggaagtgggacttaagctggttcttgaagaatgagatagaatttggatggggagaaggaggaaaagcaagagcccttctgcaagcaaagcaattttttttgaagtttgtacttctatgtaattgaaatatataaaatattgattaaaattagttatattcctgtttgatgacacatggtgacctagccaggctgtggtggagaaatagatgacataggtccttgctgcctgattttttagtattatgtgacccaattgccaggaatgttctaagcactttgcacatattgagtcacttactcctcacaacaactgtatgacatagacatcatctcctccactttacaactgaggttactgaagcatagagagtagttatcagcctaatgtcacactgccagtaagagacagaactagggttcaaacccaggtagtttgacctgcatcccattctctctcatcattcagctttacgatttctcagtccaagggaagaagttgggtggtctctcttgtgaaggaaaccagtgaagagaccagagtgatggcttggactttggaggctgccacataaagctgggaggtagtgggggctcatcaatggagggtttggaaagccaagcacaggaacttggctgtggagaaagaaaaagaagattcatctttctgtgttcctgaccaagaacaattccatactgttcattgcattaattccaaagatttcaagggttccagtttggtagactggacattatgtacatatgagaagagggtaaaacaaaaacagaactggaccctctatgcatcccctgggctgctgctgggaaggcacatagctgaaagtggaaacgtgttctcttgtcctttttttccaagcacctgcctagaagacaaacaaggctggaggtatgaatttgaggtttcacctatatttgagagctgaaaccacaaaatgttaaactccctgggaaaaaagtcactaaagaagcagaagagaaacaccaacagaggagggcatatggacagcacggtgctgtggaagttactctgcataatttaagaaattcccagtcagctacttcaaagaggtggtagaagatgagaactgggatgaagccaggaaatttaacaatgagcctaagaatgttgaagagaggaaatgaaacttggctctgcccttatgatgctattgcatagggtcaaaaaaggcatgtctggtttatgtgagcctcctcactgtttcccaccctcccgggacataaggcccctttcaagttggctgggatgggcatgggagtgaggaactgagtcctcaagttacaaagttggaattcctttttatgcattaggcttggctccttggtaccacaccttagccctctcccatgggctcttcgcacacctcctactctcctgatctttgatattccctctgctgtcagctggatttgcccatgtcacaggcagttcagttcctggtgaccacccctgtccagctgtgaccttcaagaggggccctgccccatgtctctctcagctcctgcccgaccccagtctggattgtcgcactccttccaggaagcattagcctctcctccttgcccctctggctccttagagctactctgccacccccaaattaccttggaaaaggttagctgtgtctgcatacttgttactttgtgcatctgctggccttctgctcaccccacagacagggtggtggacacacagtaaggtgacccccagggagtcctgcccttgtgtagtcccttcccctgagtgctggtagaatctgtgatttgcttctaaccacaagaatatggcaaagttgatgagatgtgtgatatgattttatatatatatatatatatatataaagcatgaaagtcatagtttctggctgataactcccatagccctcttgttatagcctttttggctataacaagacattggctggggcattttaggcctcaggaacaggcctcaggaaacaatctctctctgtctctctgaacttctttcctcctttcacctgtccaaggcaagtcaaaagaccctcattccagaaagcgtgccccatactctgaaggaagcaatgctgcacagaggccaggaagaatctcaacagtgggtcttactgggtttccccgctcagcctatttgtatgcagtcatacccttttcgtccaatcacatttctgcactgttgtcaatcatgcctatgtaatgaattctcttttaaaacacaagagggccgggcacggtggctcatgcctgtaatcccagcattttaggaggccaaggcaggtgaatcgcttaagcccaggagttcaagaccagcctaggcaacaggtggaacctggtcctacaaaaattaccaaaaaatagccagatgttggtggcgggctcctgtaagtcctaactacttgggaggctgaggtgggaggattgcttaagcccaggaggtcgaggttgcagtgagccatagttgtaccactgcactccagccttggtgacagagtgagaccctgtctcaaaaaacaaccccacaaccgttccccgccaacaactccaccacacacaagaggacagggttcagagagcttctgaagaggtgaccacgtggaggttcctggagggtggtatacctggagacggccttcaagctttgtaccccttcccctataccttgccctacacacttcatctatatcctttgtaatatcctttataataaatgagtaaatgcaagtaagtgtttccccgagttccgtgagccactctagaaaattaattgaatcctgctggactcagtggctcacgactgtaatcccagcactttgggaggccaaggtggatggataacctgaagttaggcattagggaccagcctggccaacattgtgcaatcccctctctaataaaaatacaaaaagtagctgggcatggtagtatgcccctgcaatccctgctacttgggaggctgaggcaggagaatcgcttgaacctgggaggcggaggttgaagtgagctgaggtcgggccactgcactccagcctgggtgacagtgcgaggctccatcttaaaaaaaaaaaaaaagaaaaagaaaattaattgaaaccaaagagggggttgtgggaaccccaacttaaatctggtcagccagaagttccagacacttggactggcgattggtgggactgagccctcaacctgtgggatctgacacaatctccaggtagacaatgtcagaactgaattggaggacactcagctggtgtccactgcagaatctattgtttacttgctggtggagagaaatccccacatatttcggggtcatagaagtcttctgtgtttattgtgttgatatgagtagaggagtttggcttgagagatttttccaaacaggatatcattcccttgatcaatttcattatagaagactgtctaaagtaactagagagactttcttgctgctaatttttgtactttttgtaaagacagctctcactgtgttgcccaggctggctcctgctcttgagtgatcctcccacctcagcctcccaaagtgctgggctaacaggcatgagccactgtgccctgcccttgctggcttgttgtttggggctgccatcagctcctagaagccacccacagttccttgccacatgaccctctcacaacatggcagttcctatcttcaaagccagcaagaaagtctctctagcatacccagcaagaatgtatagggctgttcagggctcacagtagattacctttctcaacagatggagtagggggtgacttaaagtgtgcataatctttaaaaattagcattttccatttgtactctctaaatttgggttagctggatccaaaccccatgattctgctacatatgggatcccagtccacctatctctagcatacttcctctattaatcattctctcttgacatttgccacctcattttagccagctgtgcttgttttcacttatgttattttatgagcagtgcttattttgacagcagcatacatagtggaatgatggctggttctggcatttaaaaagctggattcacattcaagctctaccatttgccaaataagaaaccaatactcccatcagccaactcaagtagtaaagttggaatagcatagtgcctttgattttttcccttacaggggtgtagtagtgaagggtatgtaactcaaaataatcttcttgaaagtcaagcttctcctcctttccccaaaacttgttccccacctgaattctctacttgttacagtcaccattcatccatcccgacctcctcctcttcatacctttgcatcaaggcttgccagttttaccttctaagcattgttcttctgcccttttcttgacctcccaactgccattgtctatctttatcatgtgtcaatccagtagttccctgaagtagcttctagcatcatgctggccaccattctatgatgtcttactactgcctgagcttgtcatttctctcatttcaaacacctttcatcctcatacagtccaatttccttacacatgtttttgccttaattccttctacatctcaccttgtgttgttttacactgtaatattacttatttcttgtatttcctaatatccaccatggcatttaacattttttgtgtctttgatgctcttcctacctggaataccaatcctgtttttgactaattccaactcatttaaaaattttgatcagcatgggacatggtggctcatgcctgtaatcccagcactctggaatgctgaggcaggaagatcaactggagaccagcctggcaacatggcatgacccccatctctacacaaaatttttttttttttgagacaatgtctcgctctgtttcccagactggagtgcagtggtgagatctcagcttactgcaaccgtcacctcctgggttcaagcgattctcctgcctcaacctcccaagcagctaggattacaggcatgcgccaccacgcccagctaatttttgtatttttagtagagacggtgttttaccatgttagccagggtggtctcgaactcctgacctcatgtgatccacctgcctcggcctcccagagtgctgggattacaggtgtgagccaccatgcctggccacaatttttttttttttttttaattagccaggcatggtggtgcacacctgtagtccaagccagctgggaggctgaggtgggagtgttaccaggatgtgtggagtcctctgttcttagtcttcttgggagaagaaatttggccaagagaccaattagtaaagtaaacaaagacatattaaggaaataagaatatgctccaagagaggagtgggctgaccctgctgggagcagtagtagtagcagtctgtttaaagagatagtatgctctgaaagaaaagtcagagtgggctgctggaaagagaatgagccagcagcccctagggttctgcattgagatttttgttatgttgggactgtttctttaagttcccacctctgtctcaagtctccacctctatctttatctagcttcccccttctgcattaagtccctgcttttttcctgcctagttcctgctctaggtttatgggattctcctttactggtagttaaggcacatgcaaggactggtgttgggtacaatcctaatggcagctttgcttattaccctctagcgttgccctctaggaaggtcatatagcagttatatgtgtacatattacccctgcatatctctcagactcttagaaatttcccctttgcccttttttttttttttgagacagagtctcaattgtgcaggctggagtgcagtggcatgatctcggctcactgcaacctctgcctcccaggctcaagccattgacctgcctcaacctcctgagtagctggaattacaggcacttgccaccatgcccagctaatttttgcatttttagtagagacagggtttcaccatgttggccaggctggtcttgaactcctgaactcaggtgatccacccacctcggcctcccaaagttctgggattacaggcgtgatccactgtgcccagccatcccctccttatcagcatgtggctagctccattctgaccgattagctgcagcgtgagtgattactgggcatcttaagagttgttctgaggtgtttcttcgtgcacaggtattttccctcctttatgctcatatctagcatgcagatttccagtggtctctgaggtgtgagattttccagacctccctttcttcaggctccccctcctgctcatgtctaggtatctgcctgctgtaacaggagaactgcttgggcccaggagttcaggctgcagtgagccatattttggggtgaaattccctgtgctccctcagtatgtccacataatgggatattatgttgctataaaaaatgagaacactctattaattgggtccaggacaagtcacgccaaaatatgactttaggagaccagaatatgccaggccaaaatatgtctctttaacataaggattattttgagctgttattttgagaaattgtagacacagtagaggctctgaaaagttatcctgtgtgagagaaatttacatctatcaaagaaatctccatttgtgagactgtgtccctgtctacaccaggaagaggaggacactagatcactagactcttaatcaatggagaaggcattgacttaaatctgcatagcagaacttacctttgtttatggtgcttttcctggtcatcttgtcatactgaaactgctgttgcaaaattataactgagacagtaaaagagatctgacctaactaactccatcttgcttctaacctccaagctgtccttgtttattcgtgggtgtaggccaaactaacatcaggagaaacttagtttataatttaaaacaaagacaataacagccctttcccaaaacagacctgctgagaccagctcggtcggggagaccctaactcagcagcgctagaggaattaaagacacacacacagaaatatagaggtgtgaagtgggaaatcagggatctcatagccttcagagctgacagccccaaacagagatttacccacatatttattaacagcaaaccagtcattagcattgtttctataaatattcgattaactaaaagtatcccttatgggaaaggaaggaatgggccgaattaaaggaataggttgggctagttaactgcagcaggaacatgcccttaagacacagatcgctcatgctattgtttgtggtttaagaatgcctttaagttgttttccgccctgggtgggccaggtgttccttgccctcattccagtaaacccacaaccttccagcttgggcattaaggccattattaacttgttacagtgctgcagagattttgtttatggccagttttgggggggcttgctcccaacatgtctcccttctttgatttgcagagagataaaagcaagggcagctttgtcacggtaagctacttctcgcaggagtcaggatccgcacctgcagactatacaaagacaaacaacacagattaaaagcacagtcatcattgaaatcacagagcttccaggtgtttttatccattttaatgggttactagctgctaatttgtctgcagctcctttaagcactccagttcctggcattaacatcaggtgtgccagggatgctttaaatatttgttcttttaattttgctatatccaaaaacaagtttgtagagtctccttctagaagcttttttattctttcccaaattttgatcttattaagagcatttaatagtttccacaaatccttatgtttagctcctacagcggaccatatcatttgagtttgaggtgccactataccgccatgtttccagataataggaacttttgccgtacttcttatcatttctaccatctgaccattttgttcagatcatctgaacacagtgtggccatggcacgcagactgagagtgcaattcaagctaaatatccccttaggggatcaattaataatgattccataggaattgttgtgcagcacctctgctggttctgaaaagcaatcttcctaaacaactactttcattttttctaactgggtccaatcctgtttacaaataggtttttgagggcagtatgcctcaattataggagcagatttattatggtaaatactgagaccagaaagcatgtgtaattctcatacagtgattgcatccaggcattattaccagcccttattgaaggaatactcacagtagtggtgataaccactatcatagctaccattaaattattcattgtgactggttgtcccactttcctcaagttttcttccaccatctgtgacagcttcttgatctgcccccagatgggtggctgtgttcgacaggtgttgcttgtgacagttggggtcctcctcagcatcagtctcgacatggctgcaaccgaggggtccttgggatcctcccggaatctcttcctcagcatctggctcatgataaggtttcaggtgtcttgatggtatccaaatcggctgttgattttggcctggagaaatacaagcataaactctaccccaagttattattttacctatttcccaactttttgttatcagatctctccaacaaatcagttgttctgtttctgtctttgcagctggtttctgtagatgctgttcagctattgataacatctggcctttgggcaggctcaaaaaatttaaagttaataatgctaggttcagttgcatctgtgctgttccatattctctgtctcttcctttctgcttttgcaactgctgttttagggagagatttattctttccactatggcttgtccttgagaattgtatgggatatcagtaatgtgtttaatattccacatagagaaaaatgtaactagagcttggctattatagcctgggggcattgtctgtttttatagaagctggaatgcccatcaccgcaaaacaccgcaaaagatgacgtttaacacaggcagaagactctcctgtttggcctgtagcccagacaaagtgagaaaagatgcccacacatacatgtacgtaagctagtctcccaaacgagggaatatgtgtgacatccatttgccaaatagagttagattccaatcctcgaggattaactcctcctgtgaaagatgaggaatgtaccatttggcaagtcgggcatagctagataatagctttagcttctttccaggtaatgctgtatctgcatttgagaccagaagcattaacatgggttaaattgtgaaagtgtctagcattagatattgcagtagcaagtaggcaatcagccatttgattcccttcagtcaaaggtcctggaagaggtgtatgagctctaatgtgagtgctgtaaaaagggtgcattctactcctaactgctgtttgcagttgggtaaataaagtcatcagttgttcatctgtatgaaatcgtaactgagcattttcaattaactgtgtggaatgaaccacgtatgaagaatcggaaatcacattaataggcatatcaaaagcagtcaatacctcaattacagctacaagctccgctttttgagctgaagtacaggacgtctggaaaactttactttttgagccaaaataagaagctttaccattactagacccatctgcaaaaacattctcagcaccttcaattggtttaaatttagttattttaaggagaatccaattagttaatttcagaaactgaaacagcttcgttttaggaaaatgattatcgagaatacccacaaagtcagctaaatgggtttgccaagtaagactatttataaaagctagttgtatttgtgccttcatgagagggacaataatttttccaggatcatatccatgtaattaacaatccaagttctcccaatccctatcatagtagcgatttgatctaaataaggagttagagtccgtgaattagtatgtggaataaaaagccactctactaagtcctgttcttggacaataacaccagtaggtgaatgctgagttgaaaaaattagcaaatctagagtcttctctggatctattctatttatctgagctttatggacttgcttctcaatcagttgtaactctgtctccgccttctttgttaattgccaagggctagtgagactaggatttcctctaaggatagaaaacagattactcatggcttaggtaggaaagcctagagcaggtcgtatccaattaatatcccctagtaatttttgaaagtcatttaatgtttttagttgattcctacgtacagttactttctgtggcacaatggtggtgtcatttactaaggtccccaagtaggagtaaggagtagtagtctgaattttgtcaggagctataactaaaccagcacgagaaattgaattttgcaagtgatcataacattggagtaatatttctcgagtgggggcagcacgtagtatatcatccatacagtgaataatgtaacaaagtgaaaattttttacgagtgggttcaattgcttgccccacatacgtctagcaaattgttgggctgtttaacatgccctgtggccacactttccaatgataatgcttagtaggctgcaggttatttactgcaggaactgtaaatgcaaaccgttcacagtctggctcagctaaagggatagtaaagagacagtcttttaaatctatgactattaaaggccaattttttggaattatagcaggagaaggcaatcctggctgtaatgctcccataggttgtataactgaattgatggctcttaagtcagttaacattctccatttacctgattttttcttaattatgaaaactggagaattccaaggagaaaatgtggagctatgtgcccattttctaattgtttggcaactaatttctctaaagcctccagtttttctttacttagtggccatttttctatccaaattggcttatttgttaaccattttaaaagtataggttctggaggcttaacaatggccaccatcaaaaggcgggcagatcaccaggtcaggagattgagactatcctggctaacacagcaaaaccccatctctactaaaaatacaaaaaaattagctgggcgtggtggcaggcgcctgtagtcccagctattcaggaggctgaggcaggagaatggtgtgaacccaggaggtggagcttgcagtgagcccagatcacgccactgcactccagactgggcgatagagtgagactctgtctcaaaaaaaaaaaaaaaattatttcctaatctttggtgagaactttgtttttccacttgaagcggttctttcaaaccttgcaaatttttttctagtcccataccagggacatacctatttcctgcattgtacattgactttgaggactatataattgttctggaattagaacttgtgctccccattgttgtaataaatctcttccccataaatttataggtacagacgttataattggttgaatagtcccaggttgtccatcgggccctcacagtgcaaaatataactaccttgatatacttcagtggctttaccaattccaactatgttaaattgagtgggttgaattggccacgtggacagccagtgctgtagagaaatgattgaaatatccactcctgtatctaccaaacctttaaatttctttccttgaatagttatttcacaggtaggacgtttatcagtaatttgatttagccaataagctgctttgccttgtttatttgtgcttccaaatcctcctgttcatttaatttcactttttcccattcccacatatggcacaatcaggagctgtgctatgcactctcctggctctgctttccagggaacagaagtagatataacaatttgaatttccccaatgtaatctgaatcaatgactcctgtatgtatttgtaccccttttaaatttacactagaccttcctaaaagtaatcccattatccctgctggcaagggtccacagactcctgttgggaccttttgcaggggttccccaggcagaaggctgacagcttttgtgcagcataaatctactgtggcactaccagctgtggcaggggacagacattgtacaggggtgagggaatggcctgagctggaaatgtcctgatttagaatggggcctgggacgggctcctcatggcgtttcccaaaattgggttcccttctttatcaaacttagagtgacactgactagcccagtgttttccttttttacattttggacatatttcaggctcaacagttttcttttttcccctatctggcggcctgacttgctgattttttctacattcctttttagtatgaccatgcttcccacaagaaagttaaaacaagctccaggaaatggagtatttcctttatccactctccgtcctgccactgcctgtgccaacaaagtagctttatgcagattacctccaataccatcacaggccttgacataatcaactaaatgtgctttccctctgataggtcgcagagcagcctggcaatcgggatgagcattgtcgaaagctagtaactgcaacactatctcctgagcagccgaatctgcaatcatctttttaagagactcctgtaaccgagctataaaatcaacatatggttcccttggtccctgtttcatagcactaaaggaagggtattgttccccacctgaggtgatttttttcccaagctctaatgcgcactcctctaagctgttctatgggatcatcctgcatggacaattatgcatctaaaccagcccagctgccaacccccaaaagttggtctgcagttatattaatttgaggttgggcctgggcattgcgagcagcctgaatggaggctgcatctgcccaccaagttttaaattgtaagaactgagcaggagttagacaagctcgagtaagagtgtcccagtcagtaggaatcttctgactggaaactgtaacattctttaacagtcccattacaaagggagaacctggtccatactgacttattgcttgtttgaattctttgagtaatttaaaaggaaaaggctcaaatgtagctataatatttccctgttgatctggggggtgtattctaacagggaactgccaagcctctaaatcaccctcttgtctagcttgctgaatgcctgcctgaatagaactaagagcagtccctcgaggtgctgctcgaacagtcacgggggcaactacttttcgcccagtgtcctccggaaaagaaagatctggggggtcattttcttcaaaataataatgagggggtgcagaagggtagggatgaacctctccctcctttgccactttggctttagctggcaaataaacctgctctgtaacctcttctgttacttcactatactcttgttcctcctaattatcagtgtgaaaaagttccaaggtgaaatgaaccagaccccatacctgtccattgttaccctgacgcttccgagctccccttcttactcaccatgcggattgctttaagagtacttgggtgtcctccagctagttttctgttccaaccgttgctctggcaacccttcgacctggattcaagcccccacgaatggacgccacttgctgagaccagctccgtcagggaaaccctaacccagtggcgctagagcaattaaagacacacacacagaaatatagaggtgtgaagtgggaaatcaggggtctcacagccttcagagctgagagccccgaacagagatttacacacatatttattaacagcaaaccagtcattagcattgtttctacagatattcgattaactaaaagtatcccttgtgggaaacgaagggatgggccgaattaaaggaataggttgggctaactaactgcagcaggaacatgcccttaagacacagatccctcatgctattgtttgtggcttaagaatgcctttaagtggttttccgccctgggtgggccaggtgttccttgccctcattccagtaaacccacaaccttccagcttgggcattagggccattatgaacatgttacagtgctgcagagattttgtttatggccagttttgtgggggcttgatcccaacacagacccctttctttactgagaactagactgcctttgtaagactaacaaattagccaaaagatatgaaattatggtttaggaatcatgcagctggaggctgcaagattctgaccctctccaagttgtttctggggataacatcactattgtaaggcctaagatcactgcttgagatattttgcagagccatattttgaggtatcacctctgtaggggtgaaagtataactgcccaacaggttcattttgcccactgcccagatagagccaatttatcaagacaggggaattgcaatagagagtttaattcatgcagagccagctgatactagagttttattattcaaaccagtctctgcaaattcagaggccagggttttttaaggataatttgctgggtaggggctagggaatgggtgctgctgattggttggtgagtgcaatcataggggtgtggaaaatggtcctcttttggtgcactgagtctgtttctgggtggagccataggacaggttggtgggtctgaatggagccatcagtcatcagaaaggttaaaaacctgaaaatatatctcaaaaggccaatcttcagttcaacaatagtgatgttatctgcaggagtaattggggaagttgcaaatcttgtggctagtttgttagtcctacaaaggcagtctggtccccaggcaagaagggagtttgtttttggaaaaagctccaaattctgcctcctgggttcaagcaattctcctgcctcagcctcttgagtagctgaaactacaggcacacaccaccatgcccagctaatttttgtatttttagtagagatcggttttcaccatgttggccaggctggtctcaaactcctgacctcaggtgatccacctgcctcggcctcccaaagtgctgggattacgggcatgagccactgtaccaggctgataaaatttctttaaaaagattttttaaaaaggaaactccccatgttcacttaaaatgttttatttcctgaattttaattaaaactttttaatgtccttcatatactatatgatggtactgaattttaatctttttgatttattttatatgaaagcagaatctctgggggtgggagtgataccctggttaattgttctctaggtatatgtgtgtgtgtgtgtatataagtgtgtgagtattttatttattttatttttttgagatggagtcttgctctattgcccaggtgcaatcttggctcactgcaacttctgcctcccaggttccagtgattctcctgcctcagcctccctagtagctgggattataggcatctaccaccatgcccggctaatttttgtatttttgtagagacggggtttcaccatgttgcccgggctagtcttgaactcctaacctcaggtgatccacctgcctcagcctcccaaagtgctgggattacaggattgagccactgcacctgggcttctctaggtatatttttgagttggtttggaaaattgtgacaataatgcctggtgcatatgtagatctttatgtgaaattcgttgacatcagtgctatctatgccattgaaagatcatctgatccatttctccactgctcctctaatgtttataaaaatgttctcttagtttggctaatatacatataatgaaatggggaaaatgtttaagcacagggaacccatcttttcctgttatgagaaggaacatttgaattaatgttaaagagaacagagattttctctaaaggaggggtttgtctacaactgctctggggaaaatctgtccaagtgtttgccacgcctatggcctgaactcctgaaacatctttcaaaacatccaagacaggtggggcgtggtggctcactcctataatcccagcactttgggagactgaggtgggcaggtcactttaggttaggagttcaagaccagcctggccaacatggtgaaaccccatctctactaaaattacaaaaattagctgggcatggtggcatgcacctgtagtcccagctgcttgggaggctgaggcatgagaatcatttgaaccagggaggcagaggttgcagtgagctgagatggcaccagtgcactccagctcgggtgacagagtgagaatgtctcaagaacaaagaaaacataatctccaagcgagttatagtgcatgctacacagcatcacctcccagatctcaggtattttttctacaatcaggattaagacaggtaggaaataacttggtctttcaaaaacggctgtggcatgctggaggccaggagggcaaatcttgccattagatacatgttggctggcgcacataatgtttttaatactacttttttatacacaaacagaatttctggcttcttaggaatatcaagctatatgacaacacaaggtccatattcctgcataaaaccataggggcaggggttcagtccaagtgtcccctttaaatggggcaagtgctcctcagttcaccaaaggcccccacctccctaccactccctacccctccaccaggcccacacattagttacctgtcaataaaaagagttgaactctgtaacatatttgaagagatttattttgcgccaaatatgagtgaccatggcccatgacacagccctcaggagggcctgaaaacatgtgtccaaggtggttggggcacagcttggttttacacattttagagaggcatgagacatcaaccacacacatttaagaaatacattggtttgttccagaaaggcaggacaactcaaagccgaggcttccaggctatggtgaatttaaacattttctgattgacaattggttgagtttatctaaagacctgggattgatagaaagggaatgttcaggttaagataaagactgtggagaccaaagttcttttgaaatcttatagtggctgccctaagagatgatagatgacaaatatttcctattcagatcttagtctcttcaggattgggaggatctgcaataaaaagatctagctatgttaagagattctttacagatccaaactttcccccacaaagaacagctttgcaggacaatttcaaaatacggcaaagaaacatgttttggggtaaaatattttgattttcttccttgtctcaaaatgttatgatgccagagtcagtttggaaagtaagtcatgatatatagagttaaaacccatctgatgtgaatttatgatttgtaggttatgactccccagaccccttaggtaggaatttgggcaagataaaaaatcaagagtttagtccttatatccaatgagggcatttgaactaatgtaatggcttctgtttgttgttttgttttgttttgttttgctttgttttgttttgagtcagggtgttgctctgttgtccaggaaagtgcagtggcacaaacatggctcactgcagccttgacctcccaggctcaggcgatcctcccacctcagcctactaagtagctgggactacaggtgggtgccactacacctggtggatttttaaaaattttttgtagagatggggtgtcattatgatacccaggctggtctcaaactcctcagcctctgattctctcaccttggtctcccaaagtgctgggattacaggcatgagccactgtgcccaggcaatggcttctttaaaatgctatttatctctcctatttaagtgcccctctctatatttaaatagtagtcctgctggtacccacctcatgcaacttagattactggatttgtatagttttaccctttaaaaatctattttgtaacttgctatactctcctagaatactatgcggattaagttcttaatgtgataaatattctattatatacatattcatttctcttccaagtgatttccttgtcttagggacccattagttacttgctattcaatgggtatcaatatattgtgaaaattaatctttagtaaattttcatttaggttttgtttgattgtttattcttttaggtttgattgctgatttacttctctgaattttagattcttctgtagtttctgacctccaggcaaaggtggatgaatggagttctgatatattagtgagataaagggctcaatagaattcatccaagagacacagctgctccagggagagccaccatcattagcaataaggaaagtaagagtacaaggctcctttgctagaacaactgggtgcttctttctttttttttttccctcttctcttcctgacctccatattctaactttacaagtgatttttttttcttttccaaagtaaaggatgagaacagaagattctttctacttccatatccaggaactgaaactcactatatttatccccaaacacctccttccattcttctcccagattggctaatgtccacatttatatgcttaatgtttcctatagctactacacatttgatcacttccaacatgaaacattggaacaaccctgaatatcactgccataaagatagccacagagattggttactgcttggtgtttgccttatttgaacacagtttgaacacttagcagtctgagtggttgcagtatggcttctgggattggccaaaactcagctgttgttacaggtgcatacaactaagttaggttttcaattttgtctgattattaagctaggttacagttcatccacaaggactcaaatatagaagtacagagtcctggctgggtgcgggtggctcatgcctgtaatcctagcactttgggatgcccaggcgggcggatcatgaggtctggagtttgagaccagcctggccaacatagtgaaactccgtctctactaaaaatacaaaaattagccaggcatggtggtgcgtgcctgtagtcccagctactcgggaggctgaggcagtagaattgcttgaacctgggaggtggaggttgcagtgagctgagatcatgccactgcactccagcttgggcaacagagtgagatttcgtctcaaaaaaaaaaaaaagaaaagaaaaagaaagaaagaaaagaaagaaaaaataaaaaataaaagaaatacggagtccttctcaggccatatttagttagctttaatgctgcatacaccttaaccataccacatagcatatggtttccatgtcagtttcacccaccagctccttaagggataaagcaggtatcttctttagattttggtgcctacttgtttgatgaaaggaaagagggaaggaaggaagggagggagggagggagggatgctgacagacattctgagagcagtgtctagatatcccgagggccgtggcagagagggatgtgaattacccatggtgatgcccccaaggtgatggctctttggcccagaagatgtgtacagggcaaactcttacgcctacagggacagtgaaggaaggtagtcttaggtataaggcaccaaaaagtagtggggactgtggtgaacagacagagaggaaatgctctgtctaaagggaacaagctaataattgctatgcagaaatgctggccctgtgtggccagaccttctgattggatttttttttcttttttgagatggactctcattctgttacccaggctggagtgcagtggcatgatctcagctcactgaagcctctgtctcccgggttcaagtgattctcctacctcagcctccccagtaactgggactacaggtgtgtgccacacacctggctaatttttgtatttttagtggagactgggtttcactatgttggccaggctggtcttgaactcctgacctcaagtgatctgcacctcagcctcccaaagtgctgggattacaggcatgagccatcgtgcctgacctggattcttctttttttttttttctttgagatggagtctcgctctgtcgtccaggctggagtgcagtggctcagtctcagctcactgcaagctccgcctcccgggtttatgccattctcctgcctcagcctccctagtatctgggactacaggcgcccacccccacaccccgctaatttttgtatttttagtagagatggggtttcaccgtgttagccaggatggtctcaatctcctgacctcgtgatacgcccgcctcagcctcccaaagtgcagggattccaggcgtgagccaccacgcccagccctggcctggattcttttttgactgtttttaaaaaaaattggatcattattttaatcagttaatactgattgtattttttcccccaaagaagtcagaatcaatattttagaatgagaaatctcctacattttaaatattggtcacattaaacattaggctagattctggtcttggtttgacaatttgtggtttctggtacaagacattgaggaatgttgatttgtaaaactataaaaatgtgagccagtgcagtggttcatgcttgtaatcgtaacactttgggaggccaaggcaggtggattgcttgagaccaggagttagagaccagcctgggcaacatgtcgaaaccctgtctctacaaaaaatacaaaaattagctgggcacagtggcgtgtgcctatagtcccagctactggggaggctgaggtgggaggactgcttaagcctgggaggtcgaggctgcagtgagccatgttcatgccactgcactccagttcctggcttgggctacaaagtgagaccctgtctccaaaaaacaaaacaaaacaaaatgggacagttgcagagcaaatggcgaaatatatctacaagaacacactcatcaatcaaaagctgagttaatttagttaaatacacattggagaaaagaggaaaatgtattaagggaagtgtcaggtaataaatattgaatcaggtccttgatttgattttgaagcagaaatgagctatgtatgaaggaggtccagtaataaaaacaatgggagatttcttcaataggggtgaataattttgtaggtacttatgcattctcagctataaatacccctgtagaagcagctaacatcattaaatccaaatatgaaaatttatccatgctaagtattcactacaagaaccaattgcacaagttggggacctgattttaataattggactatatttttatattaaaattacttttcatcttgagcactgtaaaataccatacaaacttattacttcattaagtcctgatattacccaatgaagtagattatttgtattcccacatttgctaagaaattaaggtttggaaaagtttcattcattcatttgacaaatatttaatttagtatgcagtagtgaacaaagcaaaccaaacctcctgccttcatggagtttcaactccaggtgaaaccaagtaaacagacacagtaaatagccttcctttcagacgcagcactgtttttgaattcaggcttgccttccttccttctttccttccttccttcccttccttccttccttccttccttccttccttccttccttcccttccttccttccttccttccttctttctttctttttcttttcttctttttttctttgaggctggagtgcagtggcatcatctcagctcactgcaacctctgactcccaggttcaagcaatcctcatgcctcaacctctcaagtagctgggattacaggtgttcaccaccatgcctggctaatttttttatttttaatttttatttatttgtttatttgtttattttttgagacagagtcttgttctgttgcctaggctggagtgcagtggcatgatcttggctcactgtaacctccacctcctgggttcaagcgatcctcgtgcctcagcctcctgagtagctgggactacaggtgtgtgccaccatgcatggctaatttttttgtatttttagtagaggcagggttttgccatgttggccaggctgttctcgaactcttgacctcaagtgattcactcaccttggcctcccaaagtgctgggagtgcaggcttgagccaggctttctattaagcctagctacaaaccttctagtaaatggctgttgctcttcattttactttatttataatatataaaatatataaagtataaaacaatattacatatacgtgtgtgcatatgtgtgtgtacacacatatacacacgcatgtgtgtgtacacatatatacacgcatatgtataaaatgtatacctatataatttttatttatatataaatttatatataatatatatttatatataatatataaatttatatattatatatttatatataatatataaatttatatatattatatatttttatataatatataaatttatatataatatatatttatatataatatataaacttttatattatataaatttatataatatataaatatataatatataaatatatatgatatatataaatttatataatatataaatatataatatataaatatatatgatatatataaatttatataatatataaatatatatgatatatataaatttatataatatataaatatatatgatatatataaatttatataatatataaatatatatgatatatataaatttatataatatataaatatatatgatatatataaatttatataatatataaatatatatgatatatataaatttatataatatataaatatatatgatatatataaatttatataatatataaatatatatgatatatataaatttatataatatataaatatatatgatatatataaatttatataatatataaatatatatgatatatatatttatataatatataaatatatatatcatatgtataaatttatatattatataaatatatatgatatatataaatttatatattatatagaaattttaatatagtatatataaatttttatatattatatataaaatatatataatatataatatataaataataaaaaattgtatatataaatttttatatacataaaacatatatatgtaggtgtgagccactgtgctgggcctggatgctgtttaataatagtagtagttttgaggcgccagcagagtgcagacctgtgacacagtgaaccgaagttctcaggacagctgagtagctgctgggtcattcctcagtcacctgacctcagcagacgaccctctctgcagttggctgtcctgatctgggatagtggggatggcaatatctgctccatgcatggatgagttggtgtgaaaatacggcaggaaataacacaggaaaggtgtaagtgcatctaaaatcatatgtacatatttgtgtaatgcttgatgcattacatgagtgttttcaagtaaaatatagtgttaattttaataatgacccactctgtaatagtgaaatttctaacaatctgaaaatttgcagtggtgttctgggtggttgtgttacctttaacgttgttgatttaaagaggagtgttacttagctgccttagaaacagttacagctgggtggcagagggcaccaggcaagctgacccagacacaataagagctactggagagagctgacttcatctagggaggatgtaagtggacattctttcattcatctaacaaatactaactggttgcctaacatgtctgttttgttcattgctatatcctcagtgctcagaaaacctcattgccctgaaaaggtttatgttgtaataggggaggccgttaatgtatagacgtgtttatcttaggtcatagttgctacaaagaaaagtgagactgtgggatggacaggggatgggagggagggagggagattatattagcataattagtaccagctgcctcagcaatctctgaaatttcagtggcttagtcggacaaaggatttttctctcacaaagtatgattggggtcggtgactcagggacccaggctccctctgtcttccggtatctccaaggaaggagaagaaaggagggatggaaagccccatggttctgaccgaatgaagcgatgatgtggcatggtggatctcccggggaagagggctccagggagagagaaaagcgaaggcaaaaacttcagcaagaaacgtgcttgacttgtcccaaaaatagcaaagcaaccactgtggcttctttcagtggaaaagggggctggaaagatagccaagggccaggctatctaaggcctctcaggccaagggaggaagtaagaaaatgcaattgtttggggtcatttagtgtcccctaaaaactttacagaagcatatgggtggttataatgattgtgtaaactaaactgtgaataatatgctccattttctagagaaatctttacaaaatgtgttactgtatctatttccctgagtgaacagttataggttgttaatactggagcacaattttctacatatctaagaccctctagaggtaggggttttcctgccactagtggccatagggccaaacatcatgacagcctgtcctcatccttctggaagcctgatgcgcggcaagcacagaggcctcccactggactcctacaaagtaagcacctgcagacgcccatgccccagtgctacaaacaaccttggacacccaataattcctcaaccaccatttctacagagtagctcaaccagtctgtaaaaaatcatcaccttaaactcctggaattttcacacctgaaataagcccaaagttactgtacttaactctaatctaaaaagtaactactaaacgaacagaaggggcgaaactaaatttatttatcttacatattctaggttagcttttcagaagtaaaatgagtcatattctagaggtttagttaatgtggacttcatgtttctgaccacatgaaatgttggcattgaaattcaatgatccctgttgcttactgtgagaatagtcaaaacccagaattttcagctaaaaatgtaatttagaatatgcttactgaattgaattaaggttttgcattaggataaacactgtgggagtgattctggtatagtgggtttgtgtttttgtgcaagatgcttacaataccacagcccttagaataattgtacactcttctggcccgtttcccaggtttccttgaaaagggtcagaggacaggctgaaattaatgacacatgaatgcagaacctcaattagaagtgtcttcaaaggaataattaggctagacttaataagaggggattaagagaagaaaaagctttgggcaaattatacactgaaggaaaggaagataggaaacaaggcaacgatagattggagctgattatttcaggaagtgatttttgttctatttatcttaaaaataatataaatatagtgagacatagagacaacagatggatggatggtcactgacctcttactaggagtggcaatgtgaacattgggacgcttcctggtgcatgtaccctgcaattgttagtttagtacccctattccctttgtgaaagaggccagggattttgcttcccccaaataacagtaacagcagcaaaagcagcaacaaacccttcaaatctgcttaccctgccagatattgtttcactttcctcatctgtaaaatagggattactttatgatggaatccccacaacaacccccggaggtaggtacgatataagtgccttgttccaggtcatacagctaggtagtgtcagaacacagattgaaattcagaagcctggctccgaagtttgagctctcattcaccgcactacatatatctatgggaggataggcgacacatgcatgtaataaatgtgtgagcatttattgtactggaaactctccagctcctccctctctacatgatcctttgcttctaattttgtcaatcacagcaccttccctggcccttactttgttcttgccaatctcctctccttgagcagaagagggaagggagcctgctctgtaggtgaacagctcctccgcagaggcatcctgttttcttagtgcaatcactaattcgcattgcaaaatgctttattacatgactgggttgccattctaggagcattcactgagcgctcagagtgggaacgtttatcaggcatgcaaatgctaacttactttctagagaatgtttaacttaaaagcctaaagaaatctcagataattcacttcggagtagaaacctccttcagccgcgctcactacggcgcccggcttcgcggcaccggccactagagggcagtggccgccgcaaagccgacgcgggcggtgggctcggcggctcggccatcgcttgctctcgcctggcaaggggctctcggccgtggattagcgcagctggagacgtgggaggccgcgggccccgcccccgaccggcggcggctgcggcggcccagcgcggcagtcggcgctgcgaagtggaggcgctgcgagcggagccgcgcggagggcgcgaccggctggtccgggcagcgtgggtttgccgccttcggggctccagtccgcgcgccagggctcgagcagtaccgcgggcccctcaggtgggcctcggctcgggacgccgggagtcgggaccgccagtcggggcgccgggaccatggcgctgcgcgcccgggcgctgtacgacttcaggtcggagaacccaggagagatctcgctgcgagagcacgaggtgctgagcctgtgcagcgagcaggacatcgagggctggctcgagggggtcaacagccgcggcgaccgcggcctcttcccggcctcctatgtgcaggtgatccgcgcccccgagcctggcccggcgggagacggcggcccgggcgccccggcccgctacgccaatgtgccccccgggggcttcgagcccctgcctgtcgcgccccccgcctccttcaagccgccgcctgacgccttccaggcgctgctgcagccacagcaggcgccgcctccgagcaccttccagccgcccggcgcgggcttcccgtacggcgggggcgccctgcagccgtcgcctcagcagctctacggcggctaccaggccagccaaggcagcgatgatgactgggacgacgagtgggacgacagctccacggtggcggacgagccgggcgctctgggcagcggagcatacccggacctcgacggctcgtcttcggcgggtgtgggcgcagccggccgctaccgcctgtccacgcgctccgacctgtccctgggttcccgcggcggctcggtccccccgcagcaccacccgtcggggcccaagagctcggccaccgtgagccgcaacctcaatcgcttctccaccttcgtcaagtccggcggggaggccttcgtgctgggggaggcgtcaggcttcgtgaaggacggggacaagctgtgcgtggtgctggggccctatggccccgagtggcaggagaacccctacccgttccagtgcaccatcgacgaccccaccaagcagaccaagttcaagggcatgaagagctacatctcctacaagctggtgcccacgcacacgcaggtgccggtgcatcggcgctacaagcacttcgactggctgtacgcgcgcctggcggagaagttcccggtcatctccgtgccccacctgcccgagaagcaggccaccggccgcttcgaggaggacttcatctctaagcgcaggaagggcctgatctggtggatgaaccacatggccagccacccagtgctggcgcagtgcgacgtcttccagcacttcctgacgtgccccagcagcaccgacgagaaagcctggaagcagggcaagaggaaggccgagaaggacgagatggtgggcgccaacttcttcctgacccttagcacgccccccgccgctgcccttgacctgcaggaggtggagagcaagatcgacggcttcaagtgcttcaccaagaagatggacgacagcgcgctgcagctcaaccacacggccaacgagttcgcgcgcaagcaggtgaccggcttcaaaaaggagtatcagaaggtgggccagtccttccgcggcctcagccaggcctttgagctggaccagcaggccttctcggtgggcctgaaccaggctatcgccttcaccggagatgcctatgacgccattggcgagctcttcgcggagcagcccaggcaggacctggatcccgtcatggacctattagcgctgtatcaggggcatctggctaacttcccggacatcatccacgttcagaaaggtaaagcctggcccttagagcaggtgatatggagtgtattgtgcaggctgaaaggggcgactttgacagcagtaccactgtgggtttcagaatcatattctacaggtgaggaagcgagcagagacgtggacgcctgggtcttttccctagagtgtaagttggattgctcgacaggcagcttcctcctcgagtatcttgcattagggaatgagtactctttctcgaaggttcaaagagtacctttgatgacagtgctatcattttagagtttgaatagttgagtaatgagctgctcaaatctgtaatcttgagacgagggtagaattagaaggggacctaaaccatgttaggtatctgtttgaacactgcactgtcacttagtggtgagtttcaaaaagtgaggaaataatggagaagaacggatgtctgtaaatagaaatctgctttcacccttccacacctctcaatctctgctttggtagaggaattaagatcaattctctgagtttaagaaattcctgcaaagaattcttgcctgcaacctttacgaagtgaagtaatttcaggaaaagcgtactcattttgagtttgaaatctattaatgtactgaaattgagaacgttgtttaggaaaattgtttagggaaactacatagaatgaatataatctgagtattggatctgagagcagcgttgctggtatcccagtgagttagctgtccaactatcagagttcatgagttattaatagttgttagtgtctctgacctttgctaaagcaccagaatttgcaaattaaaaaaatatatagcagta

SEQ ID NO: 1260 - DNA, 7354 bp, Homo sapiens
taaactgcatttattctgggcttgaaccacatcaaggcagtttcagaaataaccttaaaaaagaggagccagagattaaatactatccccactccccataattaagatgcaatttgaaactttatctgaaatcattgagtcaatggaaagccgggaggaaaacaatgttaaatcaatatctgaaaagctgtttctactaaagatgtctatacacacacacatattatatatctatatatcatgtatttggactgattcaaggaatctgtgcttctcaaggcaacttcaagaactgttgatagtacagagaaatggatatcacagcttttttcttaaagaaaatataggttgaggtagggactggtaaaagaagagactgctttctttcattttttttcttttttaaaacaacttgtctacatcaccaggtatcagtaattgattcccactggacacaactacaggatacactccatgtttattccttgtgagaaataaacacagtaacaaattttcactagcatcattatgtagaacataaattcatgtttccttaattcagtaggtatttattagaaatctatgaggtaccaacatctatgtgaagtcctggttataatgcaaagaagccagtctagtgaatagacaaatgaatttattaaattaaaatacaatgatatatgtcatgagatgttcaagagctatgggggtacagtagagaaatatctgaggaggggtaaagaataggagaagtttccccggctgaatcttaaaagtaaggtattttaagatgctactataccattaccacttaacaagtaaggaaaaaaaaaattacaaaaaaaaaaaaaaaaaagaaaacagccatatgattacatgaaaattgaataccttctcctgaatgatttttaggtagacaatgaaattaaggcagaaatcaagaagttacttgaaactgctgagaacagagatacaaaataccggaatctatggaatccgactaaggcagtattaagagggaaatgtatagcactgaatgcccatatcacaagttagaaagatctcaagttaacttacaacttaacatcacaactaaaagaactaggaaaccaagagcaaacaaatcccaaagctagcagtagacaagaaataaccaaaatcagagctgaattgaaggagattgagataagaaaaatcattcaaaacataaatccaggagctggttttttgaaaaaaaaaattaataaaatacatagatcactagctagactaataaagaagaaaagagaatattcatataaacacaaaatattcaaataaacacaatcagaaatgataaggggcgattgcaactgaccccacagaaatataaccatcggaggatattatgaatacttccgtgcacataaactagaacatctagaagcaatggataaattcctcaacacagctaccctcccaagagtgaaccaggaagaaactggatctctaaacagacaatatcaagcttggaaattgagacagtaataaatagcttaccaaccaataatgtccaggaccagacgtattcacatctgaattctcccagatgtatgaagaagagctggtaccatttctactgaaactatttcaaaagttgatgagcaactcctccctaactcatcctgtgaggctagcatcaccctgataccaaaacctggcagagataaaacaaaaaaagaaaacctcaggtcactatgcttggtggacattgatacaaaagtcctcaacaaaatactggcaaaataaatccagcggcacatcaaaaagcttacccacccccatcaagtaggctttatccctgggctgcaaggtcggttcaacatatgcaaatcaataaatgtcattcatcacataagcagagctaaagacaaaaaccacatgattatctcaatagatgcagaaaaggcatttgatacaattcataccttcgtgtttaaaactcatagcaaactaggtattgaaggaacatacttcaaaatgagagtcttctatgacaaacccacagccaacatcatactgaatgagcaaaagctggaagcattccccttaaaaattggcacaaaacaaggatgccctctctcaccactcctattcaacatagtattggaagtactggccagggcaaataggccagagaaagaaataaagggcatccaaataggaagagaggaagtcagactatccctgtttgcagatgaaatgatccaatttctagaaaaccacatagtctcagccaaaagcttcttaagctgataaacaacttcagcagagtctcagaatacaacatgagtgtgcaaaaatcgctaggattcctatacatcaacagcagtcaatccaagagccaaatgaggaacatactcccattcacaatggccacaaaaagaataaaatacctaagaatacagctaactagggaagcaaaatatctctacaagaaaaactacaaaacactgcttaaagaaatcagaagtgacacaaatggaaaaacatttcatgctcatgaacaagaagaatcaatgtcattaaaaatggccatacttcccaaagcaatttatagattcagtgctattcctattaaacctccattgagattctttgtagaactaggaaaaaaaaaaaactatcttaaagttcatctggaaccaaaaaagagactgaatagccaaagcaattttaagcaaaaagagcaaagctggaggtatcccattacttgacttcaaactatattacagggctacaataatcaaaacagcatggtattagtacaaaaaaagacacatagcctaatggaacagaatagagaacccagatataaggccatatacctacaactatctgatgttcaacaaacctgacaaaagcaagcaatggggaaaggattcctattaaataaatagtgttgggataattggctagccgtatgcagaaggttgaaactggaccgtttccttacaccataaacaaaaatggattaaagactgtaatgtaaagcacaaaagtataaaacccctggaagacaacctaggcaataccatgcaggacaatggcacgggcaaagatttcatgatgaagacaccgaaagcgattgcaacaaaagcaaaaattgataaatgcgatctgattaaagagcttcagtacagcaaaagaagctatcaacagagtaaacagagaacctaaagaatgggagaaaatctttgcaaactttgcatccaacaaaggtctaatatctagtatctatacggaacttaaatttccaaagaaaaaaacaaaacaacctcattaaaaactgggcaaaggatataaacagatacttttcaaaagaagatatacatatggtcaacagtcatatgaaaaaaagctcaacatcactgattattagagaaatgcaaatcagaaccacaatgagatacccatctcagtcagaaaggttattattaaaaagtcaaaaaataacagatgttggtgaggttgtggagaaaagagaacacttatacactgttggtggcagtgtaaattgcttgaaccattgtggaagacagcgtggtgattccttgaagacctaacagcagaaataccattcaagccagcaatctcattgctgggtatatacccaaaggaatatattaataaaccattttattataaagacacatacgtatgttcattgcagcactattcacaacagcaaagacagggaatcaagctaaacgcctgtcactggataaagaaaatgtggtacatacacaccatggaatactatgcagccataaaaaagaacgagatcatatcctttgcagggacatggatggagctggaggccattatccttagcaaattaatgcaggaacagaaagcaacaaccacatgttctcccttataagtgggagctaaatgatgagaacacatggatacatacaggggaacaacacaaactctggggtctattggagggtgaaggtgggaggaaggaaaggatcaggaaaaataactaatggatactaggcttaatatctggttgatgaaataatctgtacaacagatccccatgacacaagtttacctatgtagcaaatatgcacatgtacccctgaacttaaaagttaaaaagataacacaatatcaaaattttatgcaatacctacaaatttaataaaagttgtacaaagaattactgacagaaatttcaagacctaagcaaacaaaagaatcatattcactgaccaagaataccacttttactgctgtgagtagaaaatattgtgctaagccaaaaaaaaaaaaataactgagcatttttctttaagctctataccagcatgtgctcacatcagaatatttattaaacagtcatccttctatgaccttgaatttctcttaattacaatttaggagtgcataaattgacttaagtgtagcttttggacagcattgaaagtttcagatacagatggatacagatggaactacaaggcagccctgtgagggataattagaaaaagtataatattaagagttaggcatttgtaaagcaggtaacctgtttgacagaaaaagaattaaggttatttacaacaaagactccggaaaggtaaaggaagataggagagagtaaagcccttagtgctgatctatgccaggtgtgcgagaccctagttaggtatcaaaatagcctgtacagttctgtttttgttgtaatttggttttgttttgttttaatacatttgtcctggtctaaagacttgcacaatttctgggagtggccttctgtatagcagttattcatacaggtctctgttggttctgttagagacaaagttgagttactgtggcctggctgtgcaaatactcttgttttccttttctaccaactttaaaaacaacactaaaataaaaacaaaatgtgtcatgtgaagcaactcatgtatgttgctatctcttggatccggaaatatactgacaaaattgaaatggaagaccagagacagaaaaaaacaaaaaagcaatttctcaccatgcatattatttgaaacaaaagaaatttaagttactgacatcttgtttgaacatcttgtttggagatttctaaaatcaagtaataataagtaacagtaaatggtactgtgcccattattatacttttaagctgtgttaaatgttaatgatattgtctttagcaatttttattgtttttagtgaaagaaaaatatattcacatcagagcatggttaccattcatattcttcctttaaagtcatatttttcatcataaattcttattaccttggtatatttgggactgctatggttggggctatttcagataacaaataattgcaaagaagtatttacttttcattgaaatattctttaattttgttttatgacaggattgaggtatgccctcaaacattatttcagtgattattgtagataagtattcgaatctttcatctgttggatatctggataaatcaaatggcctggccatggcaaaccacaaaatccagtttcgtagagctcatttgtttcaatgaaagattttaattaatcatattggttgcatcacaatgattttgaagttactttgatattaaataaaaaagaattcttatataagcaatggtaataaagtactaaagtattaataaagtattgagaatttgaaattgactagagaattcaaaaatgagaagagacaagtcaaggtaaattccctcatattcacatctacaccttatgggttacaaacatttgaattctgaaagataatgctggcacgactgtgatggtcaatgggtttatatcaaataaactatattgtagtttataaaatggttttctcttactatagccaattaaaatcttaaaaatagagtgtgtaatgtagtacagattttaagttgcctttatatggcttatgcttcttgttatatttgtgttttggggggaattcttggcaagagattaggtccacatctgattttatgaaatgaatcaacaatgacagtaaagtaataaagtcaacataatgatttaattgtctatgattcacataagtcacttaacaattatatttgtttagtggtatgtttatcataaagttaatatgtttccagattgttcaagttttatattgttatatttttcaaatttcattttatgaataatgataatttatattccctcaaacttccatgtattaccatagttgatcttttctgttcattctctgttttgaaagaaatctgactttttactttcaaacatctagttttcattatcttggagctaattcaatcgctgtgatacctggaaaaaattacattttttatcttttagtttgtaaggagacttttgaacctgaaacagaaactgaatatttttgagattcactagatggattggttttcttaatatgcatttggtatagtaataataacgtgttatctttcaggtataattttcaattcatatgaatatgaacaatttatattgaaatgctgtggcgtttttatttgtttagttcttagaaagggtagctgttctatgggtttacagagacaagatttttatacataattggagatactagatggaagtagtttggctaaaaaggaaaaaaaattctatttgattgaagatggagggctgagcatacatgatgacttcttatccttcctgacacctcacctcatagaggcatatacataaaggaatagatccatgcagcaaagaaaatcagagagacttactagcacttggtatgttttcaagaaattactaggagaaggaaaaatgggaatgagctaactgatggaacaagcagtgcagaggaggagatgggagggaactgatcagcctgcctgaaccttggagagtctctcttctgagaatctgcaaggatgaagatacagagctcaaaacaggagactcaattaaaggaccatatctgcaactgggacaattggctcacctacttcacttttacaacccagattagaaaccagtctgatttcagttcttctgagcaatgaaccatatgggaaagggtgacgtttctgttgtgcctcttggcatgccactactaagcctacattattctggcttgggttggggggtgcagttttcctaccagttcctgccttaagtgaaattcctgcctaaagtgaagcttgcccgtatccaaagctacccatgtgcacagagctcctagttaatgctaccaagtaggcaagaagataggtgcaacctgtttttattattatgcttgttcattgttttctgaagctgtcatttcaaatgcttgattttt

SEQ ID NO: 1261 - DNA, 13419 bp, Homo sapiens
actatcagtgcctttaatcatgaaaaagacaagtagaaggaattagttctctcacccagggacatcagtgtgtatgtataccagtgggaaccagacatcgtgtctaggtaaaatcacttatcacactgcagctaattttttcacctggtaattttagccaaactaggtcatgttataaatgtcagcaaggcaaaagagagaataaaatgtcatcagaataatgcacatacatttcaatggaggttaaaatcttttataggaaacaggattatgaggtaggagatttttttcattgcagcagtgaatgtgaatacagttactatgattcttaaggtattcactttggcctcattcctgctttctttaaattagaaaaaatatctcaagtttgcttacaggtaagagttttaagccaaataaataacagttattgtagtgatttggttgaaaaataaacttctaattcccctttaaaaactgagaagaaatgaaatatagtgcaacgtcagccacaaaatcattattttgatagctaacatcatttgtattctaggctagaattttaaaatttaaagttcaaaaaataaaattttattcacattgttgattttgcccaatgacacaagctatatgttaatattaaattaatatagacaaattaaagaaagtaccacatttatcactttcatatgtagtaatttttatttcaataaccagaattgtaggtttcaaaaaatgtttgaaaatttgctttaattaatagttttgacaaagaacctttaatagaccgctgcttttcttttcaaagtttcagttaaacctgaagaaataatatggtcctgctgtgatttttgaatgaatgcttttgtggttgcataaattgtgttttttcatgaatattaggattgtaaatgaaaattaagtctggattctgatccttttcctttcaagcttattaaaataagatcttttaggatcactgtgactctctccttgttagttttatgtcataacttagccctgattataaacaaactttaactgtttcttaattcagttttttcttttgtcatgagcaaagaaaaattactgaaataaataagcattgagacatattcttgtagttgaaaacttagtgtgggaatcatatttttgactcccagctcaggatagtattaggtagggtagattattttatcttcttgtaaaatagtgtaaaataaatatttgcctatagacattacagtttagagtagagaagtttcacattagaaagatgctgattcgtctttacatttaggcataaaagagggagtacatagagagcatttataatttatctactttaaacataattattttttattatttccctttgcactatttttaatcctactcatagaatgaaagatgaggcattgaacttgtatctaagattgatgatttgttttgagtctggggcagacagacacagtaatggcttagtctgatacaggcattttgggttcagtctctagggacaggtattcatatgtaataaaaccacttgaactggcattgattgccattgttgataatcctagcaggatcaacattgattgagtaaataaaaagatcgaatttaccttcttctggcaaggcaggcagagaagcaggacaaagcataaagacttgacagcactgtagcattacctctattcaactgtgcttcagagaaaagaagtggcaatgattaagggtactgttcaattcagcaagcaattattgagcagttctgtagcgcaacactgttagctgctaaaggactcaaaaggagaagacagtatgattttgcactaaagtagtttatcatctaaattggaagacaaacggttcatatgtgaaacagctagaaaacaaattatgacagtatataattgagtgtacagttgttcatgcaacagaatacaagcacaatttatttgtccagcaagtgaaaagatatatctttataatgtttataatgttaaattttgtgtggcaacataaagtaacatagcctgagttaattcaggtctttggttatttaagatgaaaaaacccccagcaatttaaatggtatttatttaaaatatcctttattttatttatcgtcctttatttagaccacctaaaaacactagatatatgattattcatacctgagcccccccaaaaaaaaatcaagactagcttactccctgttaatgattcaatcaattgagtataaactttattaggttttgttcactattgattctttgcctcatatatcataaaggttcattctgtctattttgcagtattttccaatgtctaggtattctgaattatgttcactaaaaagtaggtctcaaagagcatcgtaatctccttagctttgtataaggaagccatgtaacaaagcagccttactacgtttctgtttttgcttttgttttatttttatctccattacttgttaagtggtaatggtgtagtagcatcttaaaataccatactattaagattgagccggggaaccttctcctattctttgctcttcagatatttctctactgtaaccccatagctcttgaacatctcatgacatatatcattgtattttaatttaataaattcatttttctatgcactagactggcttctttgcattataaccaggacttcacatagatgctggtacctcatagatttctaataaatacctgctgaattaaggaaacacaaatttatgttctacatcacgatgttagtgaaaatttgttgctgtgtttatttctcacaataaataaacatggggtgcctcctgtagtagtgtcctatgggaatcaattattgatacccagtgatgtagacaagttgttttaaaaaagaaaagattgaaggaaagcagtctcctcttttaccagcccccacctcaactatataattttaagaaaattgatatcaaaagctgtgatatccgtttctctttaccatccaaagttcttgaagttgccttgacaagcagagattccttgaatcagtccaaatacatgatatatagataaataatacgtgtgtgtgtgtagacatctttagtagaaacagcttttcagatactgatttcatactgtcttcctcctggctttccattgacttactgatttcagatacagtttcaaattgcatcttaattgtggggagtggggatagtagctagcctctggctcctcttttttaaggttatttctgagactgccttggagtggttcaaaccagaataaatgcagtttactgcctatcactccatactcttaagatggttttgccagcttttagagcctctcagatgttctaaaataaggtcaagctgattctacatcctattggtggtaggtgttagtgatgtcaatttggcacaatgtttttgacttgagatagaatcattaatccagggatatcttgttaataaatttaccgactactcacttggaatttttgatgtagcagtttttaataatatagctttttcatgtcaacaagagtacattctgactgattctatttataaaagtatgcaatactaatgtttaatattagaacagttagcagtagttaactttggagaacaaaaatggtagaggtaaggggtcagtaagaggacttctgaggatgcaggtaatgtatttattcagcgagtcgtggttatatgggtgtgtttattttgtagtaactcattgagctgtatgattgctatacttcactaaaatctatggagatcaaaggctactttggcagctttagtctaatgacaaacttattattttcttaaacaatgggcaaaattttcttctgactttcagattcctacagtctaaagggaaagataaaactattttagtatgatagctaaaatgcttttgctcttttaaaattctcattataaagtgtattgtttattttaacttttatatgactgttattggctacttaaaagtctttaaagaaattaattgggaaataacagttgaacatgaatatgggagtacttacttcaagacaatccagaaaaaaaaacaacagaatataaaatgtaatgtttaacaaaaaacaaatgtcattttgtatttaaagaacagtttaaggtatgtttaaaacaactacttctgaactgaatgatactacttctcaccccctccatggcaaaggggtcatctaaattagttgtagtcagctgcaccaagctgaagagccactttacactgaactgaattttgtatggaagctggaaagaaccacagactttactaccacattctaattggcaggaaccctgcttctgatgctaaacagcatgtcaggattgcatactgtatcaatttcagaagtccaagttacatttgggtttattgtttatccagccacaagtaagctgccttctgtaacttacccattggcttactgggttatgattttctaattagaaatggaggactttgagatgttaaaagtgggggcccaataatgagtattgcactgcagatacacagactgaatatcactgtcctaaaaaaaaaaaggcttttaaattgaaatatcaaaatcatgattaaaatcgaaaggtaaacaagcaagataggataaattcaatccatggtgttggtaccagtactcttcacgtgaaaaggacctcggcataagtgttcagaaataacaaagatcaaccagcttggccaacatggagaaaccccatctctactaaaaatacaaaaattagctggacgtggtagcgggtgcctgtaatcccagctactctggaggctgagacaagagaattgcttaaaccccaggggggcagaggttgcagtgagccaggatcacaccactgcactccagcctgggcaacagagcaagactccgtctcaaaaaattagcaaaaataacaaaaatcaataagctgaaaaatgttataaaatttgacgttgaataattcattagacatgaaattacagagtgcttacatttgttgggtactcttttaattgctttacatatattaacttgttaaattctcaagcaacctatgagatacaggacaagacaaagagaagttaagtacatgtagaaggtcacacaaatgacatttaaatccaggcagtctgattgtaattctatgctcttacccttaaaaggattcgtcaattccggctaaatggtgtgcctgaataaaatgtggagcacggtagcatttataatatttattcattcaacaaatatttattgaacgcttacgattgggccaggcactatgctaggtatttatggttataatattcccccacttatttttggggttttacttttcatagttacctttggttaactgtggtctgaaaataggtgagtacagtacaataagataatgtatgtgtgagagagaaagactacattctcatgactcttattacagtatatagttataattattctattttattattagttattgttaatcttttacagtgcttaatatacaaattaaattttatcataggtatgcataataggaaaaaacatagtatatataagggtcagtgctatcagcagtttcaggcatcctttggaggacttgaaatatatctcccacagataagggggaactatacataacagtttatgaaagtccttgacccttgtgaagtctgtattctagtagaggtctacagacaataaacaaaaaagtaaaacaactaggttgtctaataaaatatttacatagaagctatgaaggggactgtaatttcataaggtggtcaaggaagacctcactgataaggtgacacttgagtaaagatttgaaagatgtgagaggataaaccacgaggaatgttctggaagcagaacattccaggtaaagaaatcagcaaggacaaagtccctgagaagaaagtgagcttggtatcttcatgaacaaggagagagttttaatgaagcacagtaagcaagagggagattggaagaggagaggtgagaggggtgtggtaggacagatgatgtaaagccattgttaggattttagctctcgttttcagatgggaagctatttgaggaatttgcatagaaaatcaaacctcaaaatgttgagagaagggttctagaagaatccttgataactggaaaggtgaagtttttacattaacagaagaggtaaagagtaataatcaaaaataggaagatcttcagtcagtgatgctaatgtgtctgaagagtcagggtccccagtaggggaaggaagaggaagaaagtgaaaggaggctaaaattttcactggcattgtaggtagaaagactagggtttgagtggacatctgctatggaagtcaggtgacagtggaggccaaagtaacaaaagcaggcagggaaattctcagcagcatcagagtaatacaatgaaattcctcatagaaatactatcaaggaaagacagagaaagccattggacacctatgtcaatcaactagggcagctttgctaacgaacacactcttaaatctggcaatcgaaagctgcctgtttaaaaacaaaaaagtaatgaatagcaatgaaaagaaaaaaatttcaattttagaataattattagcacaaggtcacatggacaggaacaattacccattgtttacataaattctcatggtagcaataatgtaatgcatatggctttgaagatgggtaaaattattactttaatacagtaaaacaggtaaatcatgaatgatgtagactgcttgtgccagtatatttgaagtaaagtaaaattcagtgttcaaatggagaaaccattgaagtgtccagtaatgatgcatttaaataaggtgatttggctgcaactgcattcatctgtaaataatttacacacagatcgagttaggaacttccgaaaaaatagtactcgttctaaaaacatccaattggataatttcacttataagggtaaagagtactgattttaaaaggttctcagagtctgttttgtgaagagatcccttaaagtataatggtggcggagcacagggaagagctcacatgcagccgcaggagagctagggaaaaagggtgacagctctgctaagccgccacttagaaaagagttggataagagcagtctcttcagagtctgacacctttcattttacggaaaaccttcacctagtctgtctatctcttaccagtgaacttcttcaaatgtaaaggtgtttgtaaaaggacataaaaatcaatcatttgtataatataatttcagatctgtgccttttatatatatacttttaccacttattttttccatctgtgaaatgtgctgacacctactttaacaaactgatacaattgagaagagagagtgtgggctgctaataagaagctctcagtcaaaacatagtcaaaaacagagaacagattgataatgaatacttaattctttttaggagtgtttttggtcctacaggattcagaattataaaagctgtaattccctttggctgcaaattgtaggcatgttgcttgcttgttacatttcgagttccaagttgaatcagttgctttcttgaacagttgaaaagctgtcatttaagcatttcaggtatttcattttcctgttacaatcctgggttagatttgctgttacttagctctcacctcttcatctattacagttttctccctcatttaattggagtatatcctcaaagatcttccacagaaaaggcatactggagatacaatttcagagttcttgaaggtctgaattatctgtttgctttcatatttaatagatagtttgggtatatagaattctgttttcaaaatcattctcctatagaaccttgaagacatttcctccattgtgtcctggaatttagggttgctgatgagaaatagaattccaatttgattcacattcttgtgttggtaacatctttttccctccttggaatctcttaagggttttcttctttatcttcgatggataaaacttcaagagaatatatttggattcaagtattttattcattcagttcgcttgatacttgctcagcccttccatcttaaaatcaatagttttcttcaagtctggtggtttttaaaaattacttgtctgattttctttctatagcatacatacattatttgtgcccacctgttatctttggttatctttgaacactcttttatatgttttatttgcggcattatgttacttagaaataagaacatcatatagtttgttagaaaaggatacatgttattgtaacagaagaagtagagcagaggaggaaatgtagataaccttgggtatggaagcatccaagatgtcttccagaggataagtaaacttggtacaaccagacaatggaatattattcagtgctaaaaagaaatgattcggctggacccagtggctcacacctgtaatcccagcactttgggaagctgaggtgggtggatcacctgagcacaggagttcaagaccaacctggccaacatggtgaaactctgtctctactaaaagtacaaaaattagctggtcatggtggcaggcacctgtaatcccagctactagggagactgaggcactagaatagcttgatcccaggaggcggaggttgcggtgtgccgagatcacactactgcactctagcctgggtgacaagagcaagactccgtctcaaaaaaaaaaaaaaaaaaaagaagtgatccgttgggccgtgaaaggacatggagaccccttaaatacacattactaactcaagccaatgtgaaaagactctatactgcatgattccaactatatgacattctagaagagacaaaactgtgaagagagtaaaaaagatcaggggttgggggtgggagatgagtagatggaacacagatgatttttagggctccagtaaataccatgtatgatactataatttattcaaactcacagaatttacaacaccaagagtgaaccctaatgtaaactatggacgttggttgattatgatctgtcagtataggttcattgactgtaacaaatgtactactctggtgggggatactgataatagtaggggttatatgggaaatttttatatcttcctctcaattttgctgcgaaactaaagccgatctaaaatagatttttttaaaaagtagagcagagtaaaggggttaatgtattggggtgggggtatgcaaattgcaattattgaatagaatgatcaaggtaggcctcattgagaagctgacgtgagcactgagcaaagactgtggctatctgaatgaagaatgttacgggcagaggatataactagtacaaggatcctaaagcagaatgtctctgatatgtttgatgaacagcaagcaggttaatgtggctcaagtgaattgagtgagggagagagaatggtgggaaataagatcagagaggtaaattgaaatgggctgcgtcactagtctagactttgtaggctagtgtaaagatttcttagtgtgacagagatgggaagtgtttacagagtagaatagtaatggttatatttgagtatttttctctttggtagttttattaaaacagatgtaacattgcagttttacaaatcacatgattttcaatttagttctatcataagttcataaacttgaaaaaaaatactacatcaagcttttattttaaaatgtagataaacgttacagaaaaaaaattgccaagcgcaatggcacatgctatatagtccagctacttgggaggctgaggtgggaggatcactggagcgcaaaagtttgaggctagcctgggcaacgtattgagaccctgcttctagaaaaaaaagaggcaagatttttaagctgaagtactcttaggaaatatttcacatgagcaggtattatctttaatctgctttttattatcatggttaaattatgagcaaagctcataaaatgcaataaatgcattttgtatttcttgcaagttagcagtggtgttaaatcttaaatctctgatctgtactaatatcatcaactcctactgagaattagaataacagtagaaactttgggaaagattttaaatgacaacaaagctaaagggtcagaatgtcgtcgtttcaaagcaattttcttagttgtaataaaggtaaatttaataaaagtaaaagcaatctgctcccagaatgttacagtattttgttttgaataaatttatattatctggaaatcaatatggctcatgttgcacaaaaaacaaggtctgaaaatagtaatgccctagagttccagtaggaggccatcgccttgaactgtttagaccaatatgaaaggctacttcctggaagaaacaatgcttctcagcaagatatttcttaaaataccattttcagaattatttgtagccactataataaaactatcagtaaattgtcagattgttcttggcattggtgacagaaaaactgcacatatttactggactgcatgacaattaagaacagagtttttcatgattaatgggttaaaaggcaagagttttgaatgaacttaaattgggcaattctcaaatctttgatgattttattatatgtcatcctgaccacttttagctggtttaatgtaattttgaaatgtttccctaaatgttacatctgttaatagttagaaaccagcttaaattcccattaagttttattcaacaaacctaaagcttctgttctgagaacctcataagtaagtaccctctgtgccatagaaggactaacagtatacttcaacattttacaattggttttgaaaattaaaaaatatgtaggctccccaggagttcatattcaatttaacaacatcaattctacttaagacataaaaatctatttctactggcaacaagatgaaaatctccagctcatactccttatatggggtaaacacccagggaatgattccagcaaagcacagaaccaggtttgtgagggagagactgggctttgacatagtaccactggataatacatacatcagtaattgtttctgtcacttacaaatatgtatctgtttaatgtcttcagttgtttagacgaacgatttggatgatcctaaatttctttgaaacttttacatttagagttccaaaaatttgtttttctccaagattaaagcaattctagcatagtagcagcatgctgcatcaacaagttgatttttttttaaagtgtatgtcttctattgaagagctcgatgaagttcttaactgttgtctctttaattaaacagagaacagcaaagcttgtttttttgccaatcgcaaatttatactcaatttaaaccatggcttttaacaaaattcctatactaaaataactcttcacacaagaatcttagtggattttttataggttcttggttaaccagcaaaactcaacaaaatttgttggcattagtaacaaatactttttaaatatgcttctatttctcccatcagaactttgatttctcttcaaagaagcctcatcatagacttactcacacatttgtgagagttattagaattgccataatcaatggatactgaagaaaagggaagatttgagggttggtttttgtttttaatttttaaaaaactcgtatcatgattctggagctaaaagcagctcacatgggccttatatgagctttgcctctctttgagcagtacattttaaaagtcaggaagaaaataaaatctgactcttgtagcatttagctttgtattggagtggcctttgcaggtaatgccaacttccacgacatttagaagattcataaagtgctggtcaaaataatggaaaaaatagcagctgtcatttgatcagaatctgtgtgcaaaccaattaaaagccctgtcataactatttaagcatgtaaggtgatttatgattacctttcataaattaatgaattctaccaataagagcagggtgctacattgggtgctcctgttctcgcagagtttacagctacacattacatgaggactgctccaggtttgctgtgtttaaatgattgacaaggcagaaactttgtcttttcttcaactgattggcactatctacttataacttataacttagcttatttttcactcccccccaaggagagtagagtccagaatggccggtggtagtctcagagtagaagagttgaggtgtcataagataacgacacccttgaatttatttctcctatactttgctttataaaagtgagcacaaggacagacaggcagaaaatagtagatcactatgtgaggctagagagagtcctctttcaggttcaacaaaggaaagacagaagaaaagtgaataaggtacataaatataagaacataagtgtagacaggtagatgatgaaaaatgggagaaatggaagacgtaacaaaaaagaaaaaagatgaagaaaaatatgggaagagaaaggtaaggtgagatgaggagggcaaaagaaacagaatggagaagagagaaaagaatggaggcaaaggaaagaagggagaatacagcaatctcctcctgaaatctgcctgtcccaagcataaagattaattgtaatattttaattacaaattagcttttcctgagaaaacttcataagcacataattcttataaaattgtgttacctcaaatatttaaaatgctttctagtcaaatatttagggggtcatcattctccaaaactagctagccttatgcagctggtaggagttcttcacagctgttctttaagccatgttgcatgagaacttcatagagaacctgagaagttccattttaagagtttctcctgcttcggtatcctaggcaagaaatcaggagaaaggaatgagaaggaagaatcactagtgtcaagtgacacatgaaactccagtaaatctgggtattacttaggtcaactagagtaattcaacataaaggtagaatagttgttaagattttaaaagccaagtggtgatttcgaacttgtagctattgttctaatatgatgggtaatcacttcctgcaatggtgaactatttataaactgctggctcctcaaaatgtaaataaagaaaaattattccaggctacaagattaattttcctctatgtctttaatctgaggtagatccattttttgttaaaacacacttgttttatttatttagtcaaattcttcacattaagaaggaggaatctgagacccagtaagattaagtgactagtttatggtccttgggtagaacaggaatgaagcagaggtttccattcctaggtcacttcagaactactaattgaggttcatcagaaaaaagacataagccaaagaaattagaacatgaagttgagtatcatctttagtaa

SEQ ID NO: 1262 - DNA, 20648 bp, Homo sapiens
aggtgggaaacataacagattatcagagaagactgctctggataaaaattgttttgtgaaacctttgtgtatgtgtgtcagttcgcagcataaaaagtattcttgctgtgggacatagtcgaaaaaactttaatgctgctgtttttagagagcttctagtaaaaatttagctggtaaatttacattttcttttcctattttgaggagttaatgtagtaattttgtctaatttgagatgtgcttagaattttggtttacagagtaattgtaagaatttaagattatattgaagttataatattttgaggtgacattttagtaacattctcaggtaaaaggtaatgtaagtgagatgcctaactactgtgttaacagttttggcatgggttgaaaaccattataaatattagtggcttattttcctgtgttttatattattttgatcatatttaaacctaggacattaaagtgtaaggaccctcagatttaaatttgaatatgaaataataaagaaattacattaatataattcattgatatgatgtacacaggatagttttattttaaatagaagcaaatataattagctaacttaaggcaaaactctatactgggttttatttcacatgtaactaaaatattggtgattgtcttatttgcttagttatgagtctcaggaataattaaatggtatgagatttttcatctttgtatagtaactgtatcttgtttatgtcagcaatgcctactataggtctggcaaataatataagaatatattctaaacaatgtaaggaattatttattccctttgcttttaggacattgatatttctgaagtatacgtgccacttattttatggcgtatccctcaatttttatttttctgttgttaattcatgatcagatttagattgtgattttttggttagaatactgtgtaagtgacgttgtgacttttgcagaatatcacacctacaggtgcttgatgttcattagccactttttgataatgttaattttgatcccttgggtaaggtgaggttctccactgtatcactactcttttcttttataaataaagagcagtcgtgggtagatactttgtgactatgtaaacatacaattccacgtgagactttctccactttgattcagtatctactgatgattcttacttgattgaacttcttgtaacttttgattttgatataatttatataattttaaacttacagagaagttgccataatgatgtaaggaagccccatatattctttatcctgattcaccaattgtttacatttgttttacgtttttaatctgtaaaatgggggtaataagcgttacctgtctcacagggttgttagttttctttgtcttcttttttgtatatatagtatagtatatatatgctatatactatagtattttatatatattagtatatatacactatatactatgtaatatacattagtatatatatactatatactaatgtaatatacattagtatatatatactatatactaatgtaatatacattagtatatatatactatatactaatgtaatatacattagtatatatatactatatactaatgtaatatacattagtatatatatactatatactaatgtaatatacattagtatatatatactatatactaatgtaatatacattagtatatatatactatatactaatgtaatatacattagtatatatatactatatactatgtaatatacattagtgtatatatatactatatactatgtgatatacagtatatatatatactatatactatataatatacattagtatatatatactatatactatataatatatattagtatatatagtatagtatatatactgtgctatgtagtatagtattatatagctattaagtattagtttgtaataatagttatcctttctatattttctattcatttaagctttctgaatactgattattctctgtgaagctgtgtgtgtgggtgtttgcatgcacaaacacatatgaggtcagcaattttatttactttttttattactctgtcatatggccatggaacaaatatttttcaatgacaaagtttaatagaaaaggctctggaaattaagaaagccaatccatgaatacttttagtcatgactcttttaaaaattactttccttgtgcatactctttaatttatttcaattcaattctacagatagatgtagaatgtgcttactgtatgcgggacattattttaagtgctccgggtatagcactgataaaaagggcaaaatcctttgttctcaaggagtttagaatcttaggtggtagtcagcaagcaaataaatactatatgttatgatagatggcaaaaagccctaagaaaataaagtgaggcaagtagtgacacagttcacttattagttttctgttatccggggactgagaatacagtttgttaatttattgaccctgcttctccgtcttctggacgtttgttatgtcagtcattcttactgttagttgaggccaaagaaactgtaatctagaagttatttagtcctctacttagggagtgggtagtgaatgagtctttcaaaatttgatgcaattatccaaaattagtgaatgtgtatgcgtttttctgagacaagtttctatacttttcattcagttatcaaatagtctgtgacccaaaatatttaagtggcgactctaatttgtcctttcttctagccacatggctaaggagttttgtgaatgagtaacacagtcttgattaacatgaggtttgcaggctagcctttgtgtacctatctctagttagtaacttttaaaattagagttgtatccttttgtcagatggctttctaataattttctaaaatgaacataataagtataacattgtaaatatttaaaatatgcaattttgtttgtagttttaaaatcaaaatacttgatagtttcttgtgtgatgatatatattttgagtagtattttccaaagacaatttataatatcaacaaagaaggctaactcatggcaatattacaaatatacacgtatctagttggggaaagaatatactgattggacagaacacttaattggagaaattgggaaaggaggtgccactaactcaatatttgacaatgtatcatttaaccctttacaacttagtgaggcaggtcttattgtgtccattttgcagatgagaatatcgaggcccaaagaggtgaatagaatatgtaacttgcttaaggtcaattagtatggaacttcacagcccacactcagctgctactttagcaaaccaaatgaaagctagggtaatgtttactcattataaaaaggatttctggacatgctttggcctgcagataatattgtatgtgtgacaggtgggaggggtatgtgtgtgtgtgtgtatgtgtgtatgtatgtatgtatgtatgtatgtgtatgtgaagaaccaaccaaatattagctctataggttgcagtcctgcctcctaccaaagccatagccaagtggaaatacaactttttttcttcctctttcatacattcattttcatgtgaatacttctccttgaaagtttgtatatgttatgtgattgatcacttgtctgagaggaatctttagtgttgactctgtcagaggctgttgtaggtcacaaggatataaaggtgaataagactccagctgtctcctaatggagattgcactctactctgaggagatagacatgtagacaaattattgcaatacactgatctaaatgttaatagagaaagatgcagagtgctgagggaacagagtagcagactacagagggaagggaaaggaaaaaataacagaggaggtgacactggagtcaaagaagaggcatgtgaaacagcatagtatgttttgggaatcttatttgtttcactgtggctaaattatagataattagtaatatgttttagaacgtaggagtggaaaggttgttatcccatcctgaggggttttgtatatagagtttggattttattttgtaggtagtaaggagctattggagaattttaagaagggaagtgggatgatgggacgaggttctataggaggcaggtagcccagttagaagactattgtgatagtctgggaatatgtggatgatgagaatctgaaatgagtcatgaattttggaaaatatttgaaaaatatttagaagatactgtagaacaaattaggtgaccaaaatgccttatatttataatactttatagtttccaaaatcctttaggtgtgcatgttattggatattatcagtaacccagaaaagtaggtagttcagatggatttatttccattttatatgaggaaattgagatcttgaaagattgtggcttagccacggtcacatagctggtgatagtttaagcatgaaccaaatcataaacttcaaatatagggttctttttaatttgtctgcatcatctctatgcagtgcctaagcatacattagttaatatcaaggcctgatcacagtggggtgtgagttttaatttattcacttgatatctctcttcattagttatgttaagtgcctaatggagagggataggatcaattaaataaggtaaatgcaacattttacaggtctatataaatacctagaaagtgcttttcaattaagacggcatgtatgccagtgcttttttatatatgagaatggttatgacatttattcctattttattggagagtctattgcatgggacttgataatagtggcaggctggtatcagagactatgcttgctgtaatcagtgttaaagatcagtatgtaaagaatccttacttaacatgtaccatgaaattgattttttattagttattatagagatattatagattatatctctacaacatcttccttctttttacccataacctctaaaaggcttagtgccagaaggaacagaactgtatctttattttctcatcacatcctctctcaaatagataatacttccattgctgtctttccaacttggctttgagtcactgctgtgattctagctgttgaacagtctttcaaattaagtgattagtattctagtcaaggaaaaattgtgagcctgccattcttacccagtattgctaaggtagttttactaaatctattattagggtcatgttctcagaggcatatgacaattgcatttcacaaaacttccctaaatattgatacttgagatttacaggaaattaaatctaaaaccttacacttctgaagctggaggcaccatagagctgtgaagttcagtataaagtcacatctgtgctcaatactttataagaaaagttactctgccttagtcttcctttactatttttgtcttacttgattaaaattttgctgttgtattaactaataaattcaaaggaaatgttctgattagtttctgtcataactgggaacgatagtaagagtaccttggaaagtatgatagtctgttgcgtaacacttgctgggtagtagatatcaattctctgcctgtttcaatctcattgtgtctaaaggtgtgaacctcttaccatctggatactttagtttccctctaaattaaaaagaaaaaaagcaaatcttacctgtatagtacctacgcaaagattttggaagatagtgggaagtcattaaagtgcttttcaccaatttatgcaatttactagttgaaatttgtaactatttaaaaatcattagttttaaaaaatactattttaaaatagtaatttactatttaatatttaaaaaccattggctcttttaatatatttcattgcttggtattagaattttttatttttagaatagagtatatttaaagatgacttttgctgttaaatttgacaggcgtggcaggaggccaatctaataagcccaaagggagaattcgcagagtatgcaggttaaaagagccctggaactgactttctgtgaagcctaggctatccatatacattcctgctgagtggagatttgcttaaagttgactgttttcttccttctgtaccatctgattccaatctgcacctgtcttttatagctagagaccgttggatggcagcttaaccttcagatggctcactctgctcaagcaaaactaaaatctcctcaagctgtgttacaactcggagtgaacaatgaagattcaaaggtaagaaatggtatcccattaaaaggatgtattttgtttgttaggacttaaactttttattcttagcagtctttgctctctggatttagaatttaaacataattcagttaaacagttattaataagtggatcttttttgacagaaatagcttatcttgcaaggtgcctttcttacaaaaacatttcataatgtcttcttttaaattctgcagtgaaaaaaaattgttgaagaccatataaaattatgattttaatgttttaggtatttgcagatattcctgagtgtttcatgttttaagctgaatatatgtggtagagagaatattgtttgttgtccagctagagcctggaacaataaatatgatggtgacctgaattgtgtttttgtgtgtgtagtagtatagtatgcctgcatgtgtttaaatcccagcttttgagaaatacaatttatttattttttttgagacggtgtcttgctgtcgcccaggttggagtgcagtggcgcgatctcggctcactgcaggctccgccccctggggttcacgccattctcctgcctcagcctcccgagtagctgggactacaggcgcctgccaccttgtccggctaattttttgtatttttagtagagatggggtttcaccgtgttagccaggatggtctcgatcccctgaccttgtgatccacccccctcagcctcccaaagtgctgggattacaggcgtgagccaccgcgcccggcctacaattttttttataccacaggattttactttattattaatttcagaacaacttgaacgtgattattaaagatcaaagcattgctatgaaatactttttgttactgcggcatatagggaaatatatctttcagatatgataagagctttttatcatattttatactgtaatggattatcttttaaggtagaaaagggggagtgactttttcctcctaagtagataagactatctcatcttaagacaaaatagaattgagaatgaggtattagagaagatctgaggcaggagattacagtgactgaatgataatagaataatggaagaaatgttattatttataacaggaattgaaggatgggaatattattacttttttgttaaaactttcgctattcattctattatgcaggtttctggcttctttaagaagtatctagcccagattatatgactataaaattctgtggaattgacttgagtcttacatataatgtattagtttattacagtgtttcaaaagtatcattttatttcacacattttcactggaacgtaatatgaacttagtggttagagtcaagctattagagtatgtctggtggtttccctttatgtgcagtttcactttccatagtttcagttacccgcggtcaactgccgtttgaaataggtgagtacagtacagtaagatgagagaaagagaccacgtccacataactttattacactatgttgttgtagttgttctattttattattattgttgttaatctcttacagtgcctaatttataaattaaactttatcataggtttgtatatatgggaaaaaacagtatatattgggtttagtactatccatggtttcaggcctccactgggagttttggaatgcatccccccacagtgggcagggggactactgtgtgctctgcagtttagtgtagtgtaacctcaggcaaattacttaatctttgattctcagtttctttatctgtaaaatataggtaatagtatctatctacacaatttttatgaagactaaatacctagtatatgtaaagtgtttagtccagtgcccagtattacagcgtgtgctcaataaatgctggctactaccatcatcatcaataaaacttttttgtttttggctaaaataaagaaatcaatccatttgttttaattcagagctctcactaaatttatttcctgatgaagttattacctcttcccttgttccttgcattccctctcccttttttcttgattatatttttcacatgtatccttactggaaattaggaggggaaaaagagcctgaaaagtcccttttgtttcttctgtgaactgagtaagttattcctttaggtgtaggatgatgatctggaactcactagcatagactggagctattccatgagtgaaaatacatacatacatgcacattccaagtagctatatacttcctttgttttatttttcgtgactacctaatgttaagtctgcgtagctaaaagcattttgtatgttggaagtgtactattttgaccacatacattggatatgctttaagcatcatgagttcagcaatgcttgtctttgggattctcaagtccttctagcttctttgttacatcttcaaagtatgcctatgtgtctgttatatttttaggcagtaggaataaaagagtaatgcttctagtaagacagccatgttaataagacattcagattattcaggaagatgtgaatatctagatgtgaaatctaactcatttgaaatatgagcttgagtacatttatgtttttctgtgtttgtattttgagattttggatagatgcatatatgcacattgattaatcttataacttgcagagctagagcaccattttcattaacaaatatgctgaggaagaagaggagaagcacacatacataaaagatatttctctttcatcttgtatgtagacttaagtgacttctttgtattgtctttctcttctatggcattgtacacattttgtgcctgtgtcttatatctcctaaacaatagacagacacataatgaggtatagagctaccatcacctaggcagaagcatgccatctccaagtgttatggtgtgccctagctgtaaaggaacagttaactactatacctcttttcctcaatgaactgctgcctggaattactgctctttctcttgtttaccttctccttgattttatgatttggtattctattctttgtactcttcatcttattccttatgttaatttttatgtgactcctgttattaaggaccacaaactacttttctttcaaatatttacaaatatgaaatgagaattcttcacaggttggaatattaagtaaaaaggaatgagggtatagagcatgttttaaaaaacaagtttattaaaggaaaggaaagcttttacaaaaagggagattaaaagttaccactgcttagtttatgatataaagtatcttaaagtacaaaactgtcatacttatgaagttggtgttggtttaaaacaggaagcattgggtacagttctcataaatgtgtattttatagggtagttatcctgaaaatatacatatattaaactactgggaggattagaatcactgtaaattgtgagggattattttggttgtatttacttttgagctgttgtactgaaaacttactgtaattcactgaagagtacggtttataaggagctccttatcttctttttcacttctaacatacaaatgaaaaatgcagcctgcagtgaagttttaattgctatcacactggataacactgtttgactgtggtctcctttcttagaacacttctgtctcgaggctttcctgttttgctattaattttatcacaaaaactaggtgattgtagctttcctgcagtattttgatatgtattctagttgtttttggttaattgtcttagtgtttgtctactgtgtttagcaaagtgagattattttcctgttccacagatacctcaaatcgagttttctgacttaaagtttttttcgttagggggcagtagagtgctttgcttacctagccttttctggcattcacagtgttatttgaaataacattcaaaataatttgtgaagtcagtagttgaaggaaatgctaagtgtttacatttcaaatctttatagaacaatagagttctcttatttatttccataaacaaaattaatgcttattaatcatatacatatagaacaaataaatgaaatcatcatgatttggcttttgaaatttgtatatgatcatttgccaaaatgaaatatattaaaagctttctacattattgacttttttgttacattctgtcacttgtattaatttcttcatgagaaaaaagaataaaatagtccataagataattgaatggctctattaggttatgatgtaactagttctaggcccattgtagtcagctgaaaattctttatttctagagagtaatgtcatttgtaacaaatgttgataattttgactgacaccaacactttaactttgaatatcttaaaatacttaaattttgctattaatcttagtacatttttttccccagtaaatttcctgttaaagacaaacctgttttgttaatacagggattccaaattttatttgtgcatcttttgaggaaggatccttgtgtttcatttttttttcttttacagtaactgtggtaaaatcaccctgacagtagaatttttatttatcttaatgttaaattagattataatcagattgcagaaagtactttatgtagaagtaattatgattttgaatgaatttggggcttctaatactagttttctgacttagagctcttcattcttatttccaaaatatatgacaaattctgtttagtgtgagaaaatgggcaaaagttcttttttaaagtgtttactctgtgctacacatagtatcacttctttttgtggttaaaacctctcttccaggcatgatttcttattattcttattttattgataaatggagacacggaagcacagagaagttaaataatattcccatgttatacagatagtaaacagtagacctaggatttgaatccaggcaattttatttgagttccagtttatcagtaggatgctgtatcaccttgttaatttaataacttagcagttgaaattgtaatatgtgtatatgtttcaaggtgttgaaagctgttgtaaaatgtaaggttgttcataggattatcgttacatggactctagatttaatttttctttcccctttatttgactaagttgaaacaattttacatttttagtcaattagaaacaccatttattcttatgtagtaagtaaagtataaatgatgtcagttcaacagaggctgccttttattaacaaatattattgtaagggctacatgacatcaatgatgttgatgtgagcaaataactgcatcagttaaaaagaaaagatgtcctcagatctatttaggatagatttctcagagaaaaatatgtatgctattcaaatcatgaattcttgttatagaaatttaaatcttttcatcttaaaggtggtgttagtattgactgatttggaatgaccttcacattttttagctacttatgtgagttcgtctgcattttccttttttttttcattgaagtatcacgtatcatatctttattagaataaatcacactaaagcatactttctcacccttaattacacatacaaatgagataattcaactgataggacataattcaaatataaataaaatcattctctcacatatttaacattgttgagtggattttaaattgtatatatttaaggtatacggcatgctgttttgatataaatatacatagtaaaatgattgctactattaagaaaattaacccacccatcacctgccattattaccttttttgtgtttgtggttaaagcacgtaaaatctattttcctagcaaaatttcagtttacgatacaatatcattaattatagtcctgatgctgtacatcagatctccagacttatttatcctacataactgcaagtttatatgctttaacctgcttctccccattttttccctttccttgtctctgataatctctgttctaataggcatttttaaaaaattccacatataagtgagatcatgcagtatttttctttctacgtctggcttatttcacttaccataatgtcctccagattcatccatgttgttgcaaatggcactatatcctttttcaaggctgactcatactactatgtgtgtgtgtgtgtgtgtgtgtgtatgtgtctgtctgtatatatgtctatgcgtatatatatgtacacatatggacacatacacataccacaatttatccattgatagatagttacgttgtttccatatcttggctgttatgaataatgctgcaacaaacatgggggtgcagatatctctttaacatactggattcatcttctttgaatatataccaagcaggagattcctggtagttctaatttgaatttttggaggaaccttcaaactgttgtccttaatggctataccaatttacatttccaccatcagtgtacggggttcccttttctccacattctcaccagcgtttgttgtctcttgtctttttgataatagtcattctaacagttgtgagataatatttcattttggttttgtttgcatttccctaatggttagtgatatggaacatcttttcatgtatctgttggccatttttatgtcttctttggagaaatttctatttaggttctttgccccttttaaaatcaattaatcttagtacattattattattttgctattgaattgtgtgagttccttatacatgttgtatattaaccccttatcagatatgtggtttgcaaatttttcttccagtctgtaggctgtgttttttgttgatggtttccttttctgtacaggagcttttagtttgatgtagttctacttgtttattttttgcttttgttcctcaagcttttggtgtgataattcaaaatatcagactaggatgaacatcaaggagctttttctctgtgctttcttctaggagttttatggtttcagatcttatgtttaggtcttttatctcttttgagtttgatttttgtgtatggtgtaaaggtccaatttcattgttttcacatggatattcagttttcccagcaccatttattaaagagacaattctttcgttattgcatcttctcggtagccttgagaaaaattaattgaacatgtatgcttgggttatttctgggctctctatagtattccttttgtctgtgtatctggctttatgccagtaccatactattttggttactataactttataatgtaatttaaaattaggaagtgtgatacatctaactttgttttactttctcaagattattttggttattccatgcgaattttagaattttttttctctatttctgtgaaaaaatgccattggaattttgatggaattgcattgaatccatatattgctatgggtagtatggacattttaacaatgttaattcttccaattcatgaacgtgggatatcttgctatttaattatgtcatcttcaatttctttaatcagtgtgttatagttttcagagctttcacttctttagctatatttatttataggcattttattctttttgctctcctagcaatggtatagtagcggggggctgggaagaggggtggtggctgggaaagtgggagcacataaataagattgttttcttgatttctttttaagctaggtcattatttttgtgaagaaatgcatctgatttttgtatggtgattttgtaaggtgtatgctactttactgaatttatttgttcatttaacttttttgtggcgttttaagggttctttttctttaaatgtaggataatgtcatctgcaaacaggaataattttattgtcctctctcaagtgaaatgattttttaatattgcctgcctttttttaaaaatcatgattcatttttctgttaccaaagctgtatgtgcttactgtagaaaacttagaaattatagaaacgtgaaaggaaaaactgttaaacttaccacaaagatgcaggtaatccatttgttttattttatttagtgtttattcaacataaactttttctccagtctgattataggacttgtttaattttatattctaccttttttcacttaatgctgtaacaaatcattttttatatcatttcaaactcatcattaatatattctaaatgactgcattatgttatggctatgacagacatattaggatttcttaataattcttaccctgtcaaatactgggtttgtttctagtattttcctgttacattgtaataaacatctttgtgaatatatacttagatgctcagtaaacctttatgcattatgaatgaattagagaagccttcttaggatttagggttattcctcaagaggatgattactaggtgaaagggtataaaccaaaataaaacaaaacatcttatttagtttgataaatggctttctgaaatcattttggggaatatacacagaaacgcaaacgttgcattcagaagatttcttagcttctagagaaagatataacactatttcaaaaataggttctttaataactaggtaattaattactttggattttaggaggccagtaaaaagcccagatatttttgtaatattatagcgccccctcttttaaacttttgtattactttagtgcacaaattaaacaagcttttgttatgtgtattttgttttattatagaacatgtagaaggaatctgatcaaatactcaagcagttagagaaaatagaaataactcttatgtgttagataattgccaagatactttgaaaacaaagcctgcttctttggaatcaaatttatttaaatatttttaaggctttgtgactctggtttcctgattctttgttttgtatcctttttcattgtgatcaatttctcaatgaaattatccttcaaggttttacgttttctaaataacagcaatacagaaatgttttccctcaatttaatgtgtgtttttggtttttttttttttttttggttttgtggtcaacatgactttttaaaagacaatattatgtagtcaggtatattgatacaaatcatatgtatataatttctgcataacgcaatgcaaacttcctccatatatgtgggtgtgtgtgtaagattttttcatatttcaggctgtcaagtggaaagtctacatttatccataataagattttataagctaacaaaaatactgtttcagatgctacttacctttgaagagtgaaaatacacaatattaatacaccattagaggttagtatttatgtggagaaaatgataatagagacttggaggagaaaatctctgttaaaaatactccaaacattttaggcaatttagaattaaaatattgttttactaaaattcttttaaaaattttgtgggattccatagtaaagaaacaaatactgtcttcacttgtcttttctagcttctgaatcgtgtagtctctgaaacccagaggcagttgataaatacagaatttttaaaacagaatatgtttagaagtacctttaaatttcattagataccttttcatgtattagaaatgacagtaatgtaaatgaataatataaatattttgacataaaagtattaacaatgaattagacatctggacaagtaaaatgctcaattcaataaagtaaatatgcactaactttttaaacatcttgaattcagttccagaaatagtttttaagcatttactacatgtgagttactaggcaaggtattcgtgatataggcaggttttattttctgtcatggagcttatgggctagcaggaaatacatatgttaagccagtaaatataagtttgatgactagtacaaaggaggaagtacatggaaaccaatagcaaggaattagaaactgtgacaggcagagaagttttcagatggaggaaaaagcacctgaaagacgacaggtttattttttgagcatttcaaatatggaggtacctgagatatccaggtggagattgtcaggtttgtagtctgagacatgggagcaaattgtaaactagaaattgaggtttggaaatcattgagtttataatttcagtcatgagaatggaagagatcacttagaggatatattagaactaacatttaaatgacaagtagaattgaaggagcttatgacagtgattgggaaggaacagccaaataccaaaggaagagagcatttcttaggggtgaatcatgtcacatgttgctactaagtaaagttagagggaagcagggtcagagagagaagataataattctcacagccatgaagtaggtgctagtattttcctattaactagatgaagaaacccagactcagtggttaagtatctttctctaaattggatactagaaagtgatggtgctataatttgaacccaggtctgtctgactccatagtctgagcttataatcactacatagtgttaaaaaatgaatttagtgacatggagatcattggtgatcagtttgtgggacaggagaaggaaatatttcaagatggagggcagtattggatgctatttgagaggtcagaaaagagaagaatggacatgtgactgttggattttgtaaaatggacttctctgataacctagacaattatgatttcaataacaattgagaggagaagaaagaaacctaattgggataaactgacgaaagaatatgaggtgagagtggaagtagtgatacaggtaactttcggaaataggacagtttatgtaggggaatgtggattcagtaaatggagatactagaggaggtttgtatgcagatgccacagatccattgggggagaaaatgatgcagaatggagagggatatattaatacatttcttgagaaagtgagatgtgagattcagagcacaaacggaaaggtaggattcaatcagagtgggaacatttcacttgtcttcatagagaagagtatgggtcaggtgagtggttttgatggtggaaagagaaagttgcaatgatctgattgcttctgttttctcaatgctgctgtcatgaggttgggagaatggggcggttctagtaggtttgagaacagaggacaaagtgtgaaatggttattttggatattggacaattgaacaaactgggtattttagggtatttttactattactacacagtgctgattgcccaattgtgatttgtgatcacgactttgagaggagaactgttggcaggttgtgtagttttcttcatctatttttaattgctcaggtgcacatgtggagtaggtggataattgggtttaatcatgcttttatctttgccgggtgttgtcagtggagggtgaaaaggacaaagggtttgtctgtgtctatgaaagagtaaattttagtaactgaccctggagtctaaattgggccaggtggaaagtgaggatattgtgtatgtgtgttcggggcagggtggtaagtgatgagagggagaaactatctagaaatatgctggaacctagccatactctctgatgtggttaggctttgtgtctgcacccagatctcatcttgaattgcaatcctcacaatccccacaatccccacgtgtcaagggagagaccaggtggaggtagttgaatcatgagggtggttcccccatgctgttctcctgatagtgagtgagttctcacgagatgtgattgttttataaggggctcttacccctttgctcagcacttctccttcctgccaacttaagaagaaggtgtcttgcttcctcttcgccttctgccatgattgtaagtttcttgaggccttcccagccatgctgaactaaactgtgagtcaattaaacctctttcttttataaattaccctttcttgggcagttcttaatagcagtatgaaaatgcagtaatacagctttcctagaggtttatagaggagcctcaaatagatgcattattttccaggatcactcagtgacttttaatttgagtcttgagatgtctgtggcttgacctggtgtacagtttatctgttaagacaaagaagtggatacatgtaaaacttgaaagctggtcttttgcgaacctttaccctgcatcaccttggaaacaagtggtctaattatatgaagatttattctgtatcctaggagttcccaatgtgtgtccagtggctactcgttgatctcttgcttccttggttgataatatacccagcatctgctggagatagtagagtattaatttcataatgagcccattaccccagtgatactatatccagaaatcaattaaaatgtgagaattttgtatgttgtttgaattatattagcttttgaacatcagtggtgatttttggaattgtttttctgaatctggtattcttattttgagggtattattgtaaattttacttcaagacagagtaaagatgtctagattaagttttcttatgagtaatttgcattattggatactgaatccagtcccaattattttggcaataaaaggagttgacaaacacttctttcctggcatagtttaaataagattttaagcatgtttacggtgttagttactatgtgaatacttaaatatgtctttaatggattgtggggattttagtcttttcagattttttctttcctttatatgagaattatttagaggaagttaaacttatatgaagaggaagaatacttgtaactatatatttctcagaagaaattattgggcacttttggctgttttgatggtattgggagaagggaagattattctattaagttttcatataaaatctctttatttttgtttttcaaagtttctcagctgtccttaatacttatgatccaaagctgcaacctttcagaaatgccatgtccatattttaaaaaactaaaatgctttaaggatttaatcagatcctcgagtcttatatcacaggacttatttggaaatgtggccatcccgagatagctaatgatgatgagtctggtttgggtgttttctttttgcatatttagcatcaacccagcaccatcggttctgtgtttttggtgtgtatctggatgatgtatttgagaatctgctgaagacagctgttcggttagtgcacaaggaacagtcaattttagttactttatcatatgctggagattgatattcataaagcagtgggaatataccgtaactagggtcattgatgaacaaagggatagaaatggggttgatgaagcagtattattctttatctcacgaattatcctaacctttgctaccagcacaaagaagagacagataggattaatataatcgaatttttacaaactcattttaacttgcttgtttcgtaaatgtttgattcctaagtataatcaatgaatagcaaattatacagtattttaaaaaatatatcatattttaagcttttaaaaattggttgactatctgaaattgacataaattttgcttatagtcagtaactgctattatgacatcagtgaaactgtatgttgtgattgttgcggctggttaaccaaaacatgtatttcacaaatgacatgtaatgggtgaagatgaaatgtaatggaaaatgaatgtgtagaaagaaattcttgtttatttcatgtttaaagaaccttgattttgtcttttaaaaaattattttatactttttaaaaattacacaagtaatttacattgaggaaaaataaaaaaatgtaagaaaataaaattcacctagaatcctacctagaggtaatcactttgagtgacgtatttaattggcatatatctttccaagtctgtccattgtaaactagttgtctttccccataaagcattatattgtaaacaacatcttttattgtcagtacatgagcttctactcagcaacatcattttaaatgactacataggattctgttgtttgtatgttccatttcttatttctttttttggtaaatataatttatttattcaaatagtccttcagcagtacatttgcctttaaagccatatttaaaatactatatactaacatgttgactaaagtgatcaagaagattttagaaattctattcatgtaaattctgttggaattctagtaattgctaaaatattagatttttattgctgagagacttcctttttcagggattaacatgtttagacatatagtttagaatgtcttttaaaactatatgtgtgtttgttaattcatgaggtttctaaaccatgagattttgctccttccctttcttcctctctttctctttccccctcttggcttcttctttatgatagagtagatacgaagtttctttcagacataaagaagttctaccctatccattataaaggggtaattttacccatatttaatgtgctgctacctccttggtgagagcagtaccataaatatcccaggataacacctttgttgttgtcaacagtaaaatgaccagaattgtctaggtacaacttcatttatggaatcagcaaaggctg

SEQ ID NO: 1263 - DNA, 76800 bp, Homo sapiens
aaaaaaaaaagtaatagccaaatctgttaactctgtgattcctgctttggttaatgtagattattatcacatgatattaaagagtcaggattatggagttaatgttttactggtgcttttttttttaaaaaaagaaaaatgtttattatttaaggctgtgtgcagtatgtgcttatattcaaacatcccttatgctgttagtcacagaaatactaactatgtgtatatgaatggcttttcacagtctatataatgattggaaaaataactaatatagtatattctaaatgatgaatctttatcttcctatataaaggacatcatattactaattttcaaatttatcagtaagacactgaacaaagcctaaaaattaatggatattgttttaatgtgatgtatgatttactaaattaagcttaggagcatttctgtcgatgtattcctatctttcagtatgtgcttacatacaaataacaactttgtaagtattttctttttacagattttcagtaatttatatcagaagtatataatcaagaaactttagtgtttctgtccgttaaatatttaaaatattttattctaaagtaaacccttttggcattttttaatgtggggttgcctcatcaaattttgcatagcctacattacaatcatagaatcttgagttttggaagagactgtaaagttcatttcattcattcagcatccatttggtggtagtgtgctttgaagacttactaagaaattaacacctaggataacattttttactttgcaaaatgtcattgtattaatattttacgcaaacaatacatgaaattacagtactttttttctgtttcttgccaaattgtaagtagagttgaaaacagaattattttttggagatatgatcttgccctgttgcccaggctggaatgcagtggtgtgatcttggctcactgcaacctctacctcctgggctcaagtgattcacccacctcagcttcctgagtagctgggacttgagtgccaccaagcctggctaatttttattttattttattttttgtagagacaggttctcactatgttgcccaggctggtctcaaactgagcacaagtgatccatccccctcggcctccctacgttctgggattacaggtgtgagccaccgtgcctggccccagatttttattgtctttgaaacagaaaattcatgaaaggattctgccattttattcacctttctgacactgcagtaaagtgcagattaaagtatagttccctgtgaaatagccagttaccctttgagtagactccagttcacataaagaagtacagggagattacatgacttgcctaggttatatattgagtcagtaggagaagtagaaatactaagtgcagattcacagttcagtttagcccagaactatggatgctttccttatggttattacctggaaggctttacaatcactgatgtaccctccctgctgtctcctctcacttacacatatgcagtcttgattattttgataatttttctacatttatacacacttcacacataatttttgtttttttaaacctcagtttatagccttaagttatactcaggaatgtacattgtactcttaagcagaaagaccttaatattagttacagctgaagagtgagcttaatttctaagtacattttggtttttccctttttgtatgccttttataggtgttcacctttagcagccagtctcttgactttgcctaatactataaagaatagcaaacattgtattgacataattggttgttatggaagtcatttttaatagaatgaccataccttatttattaaaaaataataaactttatttttcagagcagtgttaggttcacagtaaaactgataggaaggtatagagatcccccgtatattcccttcccctatgcatgcatagcctatccaattatcagtatcccctattagagtgatatgtttgtcacaatagatgaacctatatgattatcactcaagaccctagttaatattagggttcacttttggtgtcatacatttcatggatttggacaagtgtataatgacagtacatccaccactgtagtatcatataccataatttctactacacggaaaatcctctacagtcctgttttacattttcagaagtgtcatatacctggaatcatacagtatgaagtcttctcaggttttcttctttcacttattagtatgcatttaaattctccatgtcttttcatgcatcgatagctcatttatttttagtactaaataatctcttgtctgaaggtaccacagtttatttattcatttacctactgaaagacatcttgattgctttccagttttgctaagtataaataaagctgctgtaccatccatgtgcaaatttttgtatgcacgtaagtcttcaactcctttggataaataccaaggaacatgtttggtggattgtatggtaacagcatgtttagttttgtgagaaattgccaaactgtctttcatggtggttgtatctttttgcatttccactaacaatgaaatgagggttcttgttgctccttatcctcaccatcatttggtggtgtcagtgttctagattttggccattttagtaagtgtgtagtagtttctcatttttgttttaatttggatttctctactgacatacggtgtggagcatctttttatatatttatttggcatctgtgtaacttctttgatgaggtttctgtttaggtttttggctcacttttaagctgtgttttcttattgttgagttttaagagttcttcatatattttggataacattcctttatatcagacatgtgatttgcagatattctctcccagtcatctttagcttgtctttttattctcttaacagtgtcttccccagtatagattttttgtttttaatttaatgaagtccagcttgtcacttctttcttttatggactgtagctttgatattgtatctaaaaagtctgtttgttcaaaatagtaatgatttggatctgttagatcaattaagaatgaaacaaagttattttaccattatgtattctttccctaatgctccctctttatgtagatctgagtttctgacctgtctcctttaacatcttttaaagaactttaaaaaacatttcttgtgaggcaggtccactagcctaaaattttcttgatttttatttgcctgagaagatatttatttctccttcagttttaaaataaacagggtctcgctatgttgcccaggttggtcttcaactcctgggctcaagcaatcctccagagtatctgggattacaggtatgtagcaccatgcctggctttcttcttcacttttaaagggtgatttcaaagggcacagaattttaggttgttgggttttttcctcaacactaaatattttactctactctttttgtattttcaatttttgtggatacatactaggtgtatatattaatggggtacttgtgatgttttgatacaggcatacaatgtgtaataatcacatcatgaagaatggggtatccatcccctcaagcatttatcccttgtgttacaaataaattatattattttagttattttaaaatgcacaattaaattattattaactgtggtctccttgtgccatcaaacagtaggtcttattcgttttttctactatatatacttttttgtacccatcactccaccctttttgcttgtactgtttctgaggaaaaattggatgtaattatctttgctcctctgtaagtaaggtgtttttttcaccactttggcatctttcaggatttgtctttatcttcgattttctgtaatttgaagatggtatccttaagtgtagtttctttggcatttatctcttttggtgctctgtgagcttcctggatctatggtttcgtatctgacattaatctgaggacatttttagtcactattgctttacatttttttcctgttcttttctctttcttcttctacaatttttatcacacatacgttataccttttgtagttgtgccacatttcctcctgggttttttgttttgttttgttttgtttttgtctttgcttttcagttttgaagttttctgttgagatattttcaagctcagaggttctttcctgagttttgtccattcaacggcattcttgatttctgttacagtggtttttttggtctctagcatttcttttggttatttcttagatctctcttcttgtacttcccatctgttattgctgtcttcttatcccttagagcccttagcatattaatcacagttgttttaaattcctgatcttatgattccaacatccctgccatagctgtgtttggttctgatgcttgttctgtcctcttcaaactctgtgtttttatgttgggagaagagaagtgttctgttgtcctatgattaggtatcacttttttagtaagcctgtgcctcttgactgtgaatttcacaagtgcttctcagtttttttatccttctccagttggacagatggctagagtgagctggagttgggtattttctttctcccacctggaaggctagtgccaactggagttggatattttccttcctgtaagtcagttaggctctgatagaactccaacaggttaagctctgtttaaatagtttcctctatgggcagaccttggtaagaagcacagagtgatccggcatattttaaaaatggcgtgtcctttcctttgctggaagcatgagtggatttttctccagtattcactgtgagaaccagatcaagtttctggaggttaaactcaacagaagtgaggagcctccttatggctgggtgcccctgcatttttcagtttttacagttgtccacactgactccagcaattaattgctgtttaagttttcttacactggcactagctcccatggaggtttctacttctgggtttctactccaataagttacaattctctgtatttacatctgtctctccaatctggggggcaatggtttaccctatgacttgacttctcttatggatccgagaagaatcgttgatttttcagtttgttgagatttgtatttgttgttaggatgaaatggtgacttccaagcttcttacatgccagaccagaaaccagaaatcccagcttaatgtcacagactgacatggactgcactgcagcattaaagagaataagaagttgtcgttgggtttcaagtctgtgaaacaaagtaaggtttttaatttatccaaagttacacaccctgcaagtgacacaggtgggaatagaatctaaatatttggactcccaattaaattatctttctttttattttattttattattattatactttaagttttagggtacatgtgcacaatgtgcaggttagttacatatgtatacatgtgccatgctggtgtgctgcacccattaactcgtcatctagcattaggtatatctcctaatgctatctctccccctccccccaccccacaacagtccccagagtgtgatgttccccttcctgtgtccatgtgttctcattgttcaattcccacctatgaatgagaacatgcagtgtttgtttttttgtcctcgcgatagtttactgagaatgatgatttccaatttcatccatgtccctacaaaggacatgaactcatcatttttatggctgcatagtattccatggtgtatatgtgccacattttcttaatccagtctatcattgttggacatttgggttggttccaagtctttgctattgtgaatagtgccacaataaacatacgtgtgcatgtgtctttatagcagcatgatttatagtcctttgggtatatacccagtaatggaatggctgggtcaaatggtatttctagttctagatccctgaggaatcgccacacagacttccacaatggttgaactagtttacagtcccaccaacagtgtaaaagtgttcctatttctccacatcctctccagcacctgttgtttcctgactttttaatgattgccattctaagtggtgtgagatggtatctcattgtggttttgatttgcatttgtctgatggccagtgatgatgagcattttttcatgtgtcttttggctgcatcagtgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattctgtaggtttcctgttcactccgatggtagtttcttttgctgtgcagaagctctttggtttaattaaatcccatttgtcaattttggcttttgttgccattgcttttggtgttttagacatgaaggccttgcccatgcctatgtcctgaatggtattgcctaggttttcttctagggtttttatggttttaggtctaacatttaagtcttgaatccatcttgaattgatttttgtataaggtgtaaggaagggatccagtttcagctttctacatatggctagccagttttcccagcaccatttattaaatagggaatcctttccctatgaatgaaatgaagcgagaaggaaagtttagagaaaaaagaataaaaagaaacgcagaaaacctccaagaaatatgggactatgtgaaaagaccaaatctacgtctgattagtgtacctgaaagtgacagggagaatggaaccaagttggaaaacactctgcaggatattgtccaggagaacttccccaatctagcaaggcaggccaacattcagattcaggaaatacagagaacgccacaaagatactccttgagaagagcaactccgagacacataattgtcacattcaccaaagttgcaatgaaggaaaaaatgttaagggcagccagagagaaaggtcgggttacccacaaagggaagcccatcagactaacagcggatctctcggcagaaactctacaagccagaagagagtgggggccaatattcaacattcttaaagaaaagaattttcaacccagaatttcatatccaaccaaactaagcttcatgagtgaaggagaaataaaatactttacagacaagcaaatgctgagagattttgtcaccaccaggcctgccctaaaagagctcctgaaggaagcactaaacatggaaaggcacaactggtaccagccacagcaaaatcatgccaaaatgtaaagaccatcgagactaggaagaaactgcatcaactaaggagcacaataaccagctaacatcataatgacaggatcaaattcacacataacaatattaactttaaatgtaaatggactaaatgctccaattaaaagacacaggctggcaaattggataaagagtcaagacccatcagtgtgctgtattcaggaaacccatctcacgtgcagagacacacataggctcaaaataaaaggatggaggaagatctcccaagcaaatggaaaacaaaaaaaggcaggggttgcatcctagtctctgataaaacagactttaaaccaacaaagatcaaaagagacaaagaaggccattacatcatggtaaagggatcaattcaacaagaagagctatctatcctaaatatatatgcacccaatacaggagcacccggattcataaagcaagtcctaagtgacctacaaggagacttagactcccacacaataataatggaagactttaaattatctttctatttcactaaattccacttttctgaaaggtgatatgaatggttcatatagggaaatattacagtgaggcttgttattgtttgtaataccatattcatttagatgttttctccatcctcctttttttttctttttttaccttctttataattttccttttagttctggttcctgatggtactgaatattaagaagattatctgccatttttgaggaggaaatatctaatagtataatctttttcctctatgttacaggcagaagtataactgcagcagcaatctgcctttcccctttatttgaatttacagaatatgttaaaatcaataataagatgcaaataaaaaatcactcattgacacttaatatgctgaatacaaattcagcaccataattaaattgcaaagtttaacattatactccattttgatattaatatttgatcttgcaatgaatgtctgcttgtcaaccttttatttactgtggaggtcgtggtatacggtattaaagaagacattcaactagagctcaatttttctgatgagctcccaggttcccatcgcaattttagacaacacatgctgttttactggaagagtatctaaaggatatagtctgatcactctctacctcccatggtaaaccttctgtttgttttttgaatttggtagttaaaggtgcatgataaaacttgccatctctgttagatgctgctaaatgagactagtaaaatgactgccaagctccagccgctctttattttattgctttaaacatagatttcctagatggtcatgatctggtttgtccaaatccaccttaactcttaaagcaataataaatataaattttaaattctaaatgaaagagaggaaggggtctcttcataagtgaaaacattccttaaacaaatgaaagcaaacagaatttttttcatggacctgtattttcatttttctgaccattatacgattttcctagcaatataaaagaattctgcagtccctccctatttagttgttggaagagaaaaatacattaaatcttaattagtatactacctatagtagcatctggtgttactgaatttttaccatcttctgaaagcagtaatcattctttacctggaggaaaagattccagtaatctgttttattaggaaacttttctagccttcctttcagttacgggatttattgaaaactacctcatatacatatgcacatatacccatatatgcatatgtatatatacatgtgtgaatacatatatggctatagatctgtgtgtatgtacacatatagacacgtgtgtatgtttttgtgtgtatatgtttttatgtgtatctgtatgttcctttctaaatagcattctatttcataccttggaaaaatataaaattaaaaaatgaggtcaagatggcgccttttaagaaataagttgttataacagttcctttcagcttcacatcataagtgttaagaacacttgagtatttttaatgtaaacatattttagcatctatttgatttttactttattttcttgatactttcagatatatatttgctttacattattctcagggtttcttatttcccgaaaacactttgaatcatttccactgattctttttcctcccttgttagtttacatgtatcatttgtatgatagtgtctggaagtaaaagggcacttgagaaacaaagttgaataaaatttcatcatacttaattctgaaaattgttttctgaaattattagctcactgctgaaatatcttcagatcaaacgttcagaacatcagctcccaaggagcttcatatttagtttatggtggggtatgattgtgtatttcacaaaattcatgaaggaaatttgtacaaatttattatggattttaggccagcggaactgtttaaacttcctactctatttgttccattgagtagccttagagttgaaacagcagtttccatttttctcatgggtagatcaacccatatgcacatttatcattgatttctagcactggaaaagcatagacattggagacggtggtcgggcacggtggctcatgcttgtaatcccagcactttgggaggccaaggtgggcagatcacctgaggtcaggagttcaagaccagcctggctaacatggtgaaacccagtttccactaaaaatacaaaaaattaactgggtgtggtggtgcacgcctgtaatcccagctacttgggaggctgaggcaggagaattgcttgaatccgggaggcagagattgcagagagccaagatagtgccattgtactccagcttgggcaacaagagtgaaactccatctcaaaaaaagaaaaaaagaaaagaaaaaaattggagacagctgttcacgtatttaaaggagggagaatattcttggagaatataattggtgaaataaaaatacaattcatatgtactctatggaagataaactgcaataagcaaacctctttggcagattttaaaatcagaaatatattccagccagtgtgggatattcaatctaatttcctttgagaacctgattctgttggattggtaggcattaggaagcaacagctcttctctctccatctcctcaaaaaattgtaaacggaaatgttgtatgaaaaaaacttcaaagatacattctaatttttttcttttgctattttaataggcttttttattttttaagaactgaggttagtgaacatgtgagagaatctgaagtacttttcatatgtttttgtccttgaactgagttatttgaatctggcaaatttctctattaataattacaattattatatcactatgtcagtatgtgtgttatattcaatctagaatatttgctctttttactcccatggttttgaaataagcatataggcatttaatttttaggagttataaatgtccaatagctatgttttatatcaatatgaactgcattgtgttttattactaatagtttagataaatctgtatatccaaattgtgaaccactgaaatgaataattccctttcttagagaaggacatgaatatagtgagagatctgttactttctggattcttctttttggtccttcaagaagttgtacaaagataatatcgatgttctcttttattcatcagtttctctcaactggtttcagaacattgcagtatcagagaggggaaaaaaataagtatttcagatttttttttcttgagacaaagtctcactctgtcacccaagctggagtgcagtggcatgatctgggctcactgcagcctccgcctcctgggttcaagcgattcttatgcctcagcctcccaagtagctgggaccccaggcatgcatcaccacacccagctaatttctgtgtttttagtagagatgaggtttcaccacgttggccaggctagtctctaactcccagtgatccacctgcctcagccccacaaagtgctgggattacaggtgtgagccaccatgccctgccaaaaatcagtattttctctgtatcacactcccaacctttaacattgcctcccattctttcttttggctgttatttaatgagagactactatgggtaggacattgtgttaatctctgggaataagagaccttcatattcctgctattatggagttgcggtttagtagagatggtaggtaagaacatgggctcctgaattgcaatgcctgggttctgttcttggttgtggttgtactgcttactagaaaagttgaagaaatcacttcattatttgtttgagtttccttcttgctgaaataaatataactctatcttaaataagataatgtatgggttaaacaatgcatgtaaaacatttggcactgatgttagaaaagggaacatacaggttagtatctctaaccatgttgtaaaagtgatttgaccagctgtattcagttataaacattttattgcacttttggagccttttccaagtcctgtgtaacctttggaataccctctgttcacctccccccaccaaaaaggctcctgtaagtccatcacttcttggaagcttcctcatttaacatcccctgtctagccattcctatacatgaagcagacacgactccttggtatgcactgtgcagtaatgaacagttattccctccttgtacatgttgctaatgtggattatttatttgaattctgactctttgggatccctttgtttataattttaagttcttagaaggatagggaccacagtaatctaccttggtctatgtgacacttgcacctttagtattcaataattgaaacacataaaagtgatttcagtggaggtgagcacaagcttccttttttcactgtgtgaatagacatagaggtgaccacacgtttttttcttgtcttgctttttcactaagctttctctgtgattgagaacaaacagggaagtctgaacggttccctgttattttatcttttggatgtagaggcatacatacaaatttctgttgaatgctttgtaagggttacctcatttattcttaaacttttacacagttactgctgtgtatttatgggatgcaggtactgtttatccattgtaattatagttcgtttgttagaccaaacattgggaaaatcttttgttgtgaatggtgattttctaaatttttacttttgttttttatttgccagattctgtctctcttttctttgttcttggtgtactaatctgattcctcttccatggctattccactttttccaagtcttaccctaaagccttttaaagcgatacgtttagatcaactttttttttctttttgtttgtagtttgcacattatatgctgtactttgactaatttaataattttttcttataattccatgtggaaattttaattttagttttgttttcccctgacctttataaaaacaagagattaagtgtaatattttctacttactgcttcaggctttgtaaatttggcacttaatggtttcattgttttagaacagaaaagattatcttaactgaccactaacaacatagttgccagtttggcgcaccaaatctgtagttaatactgatttcaaaatagtgtttcttggcaaatcacaaccaaaagcttagaatattctgtatgacttttagttctaaagtaccttgcaagtattactgttaatctcattttgtagcagaaataatagaccaggagcattaaaaggacgtatttgtttattcatatggctagtatgtgtggtactactgaactgaacccatgcttctgcctagttaaatggtctcaaaacactaagaaaaaaagccaacgtataaaattcaatagcggttagtagcaaggaatgagtgttatctgaagtcatagcgtgcttgttaaagtattttcaattaactttctccacgcgtctcttaaatatatgtttttgtatatatttacagtttttttggacagatctatttggcagtcttctttaagatattgtcagctactcattcacaagaatggtgacatcttaattttaaaaaacattttatatagttactctctttattctggtgcaataataatactacacactgggtaaattgtaaagaatagagatttatttgacccatagttctgaaggctgagaaatctgagagcaggatgctggcatctggtaagggccttcttgctgcatcattatgtggcagaaggcatcacatgaagaggagttgtgcttagaagacagagaaaaaatcggggccaaacttattctttttataactacctacttccttgataactaactcactcctgcaataacagtcttaatccattcacaagggtggtatccacctgacctaatcacctcctaaaggtctgacctctcaatacatttgcaatggcaattaaatttcaatgtgagtttttgaggagacaaaccatagcagttatgtattttgttaaacttaagcattttattctgttaaattatgtatgtatttatatatatatatacatatatatacacgcaagcacacatatacaggcatacttatgtgtttatatgtgtgtttatagatctttttcttaggaagataattatattttaaaagtcattgatggtagggatgatagcagaggaagttgtgaaatacaatctaagtaatattatagagcatacgttcagtattttgaaaactgctcaataagggtatatttgttgacaagtaatagatcacattacaaacttactattagacattgtttatctagtcagcatttatgaatagtctgtggtgatctgtgtgtttatattccacatacagtctatcaacaaatcctgtcatttctactttcagaatatatgctaaatgcaaccacttcttactacctttatcactgccaccttatttcaaaaccaggttttacttatttactatacgatcttgtccaagtgtttatagtgttaggatttttcttttcacaatcattcgtcataggtaaagaacttatttttctctcacatggtacattaaaaatagaagcaagcaagtaattgtctttaaaaattttttgctttgcctattattattcctctagaaaagataataataatacatagttacaagaacatttacattgaagaaggtgacttaatatttgaaattattgtgtttaatattatttcggtttttattaatgcttggtatattttgttaataatttaaatattgctaaattttggaaaaaattataatggaatcattatattagagttcttcagagaaattcaaccaataagggatggttatatctctatataattatgtttatgtgtgtgtttatgtatatgtatgtatatttgtatgtatatgcagtcatgcatcacttaatgacagggatacattctaagaaatgtgttgttaggcaatctgatccctgtgcaaacatcatagagtatacttacacaaacctagatggtatagcctactacacagctatgctatatcatatagcctgttactctaagactgtaaacctatacagcatgttactgtgctgaatactataggcaattgtaaaacagtggtaagtatttgtatatttaaacatagaaaaggtaatgggttgcactaccacattatgatggctacagcatcactaggccataggaaattttggttctattttaatcttatggggccaccattgtatgtgcagttcatcattgaccaaaacatcattattcagtgcatgactatatatatatttgtcacttattagcacattaatatggatttgtataaataaatttctagtaacgctcaaataacatacatggatgcattttcaattgcttctcaaatatatggagtattttaaataagtagattccaaaaagcaaaacaagtttaataaatgtctatttgcagctacattacacactcatacacacacatgcacacgcacactctctcacagaggcagtcaactgttcatgaaatattaagattatattttacaatgatatttaaaacttgaaacatacatacaaaacaatgaagtgtgatagctaacagcacagacttggatcagatagaatgacatttgacttccagctctgactttctgagccttggttttcttatgtgtcaagtaatgataatacctgcttctttgtgttgattaaatgagaatatatgtaaactacttgccatggtgccctgtacacatcatacacagtaaactattaccatctgtattttaattcttaattccttcccctgaacacaacttgataaatattctttaggtttctgttcctcctttcaaaagttgatttaattcataatgtaacttagcgtaatataaataataccatagaaataaccatctgtagcagtggtttgatgggaaaatacagtcacagctacaatttgataagccaggaactgtatttttccctcctgaagttataaaagtagaagtagtaatcctctctccaggcatccttttatcttttgaagaatagaagtaaatatatctacatatccaagccagtggtagtccttctgtattggggctttttgcagaggattggggctttttgcagagcaggcctgcaaggggaatgaatatcagaaatgaggttccagtgacagaaggtactgaaatgctgtgtgtgtgtgtgtgtgtgtgtgtgtagaatgtgaggggggttggataggttcatgtgggtgtaaagtgaagagataggccagggtgatagatgtatagaacttctgattttaaaataagcatgtaagctgtatactatttaatgaaattactattgacattttattgaaattaaataatgaattcatcacattttatgagaccaactttaagaaaactagctggatttttaatggtttgcttcaacttaatagtggtatataacttagtacaaacatcgaaggctatcagaaaatgtatgttagaattttaatgattatagaaactgtggaatattctgtatatatctgacacttaaaattacttgttctggggtatccataataaaatttatgtcatgtggttttttgggtcagtattttcaggtataagcctggtgtgtaacagtgaatgctcttagaagattgggtctgtatcttttgtctctgtaaattacacaatgataggaagttaatatgttagggatttaataagtatgttaatgattatctataaagataatatgctttattttttgattggtttgtcatattttattggcctgctttctgctagaataccattatgatataacttgccaaggagccctagggtatgaaaaaacagtcttccctttttaattatgagaagttcagagaccttctgaatatattaatgattactactaaagcaattcttaataatttttccactaataggagttgtaaagatgccagactcaaacagatgtgaatactaggctcccttgctagttgagttcttgttacttcacatcagtcttacagctttctgttagtgtgagtcacatgtgggtctcagcaaaatgataaattagcatagaccctggacctctgggtcatggtaaaaataatcactgaatattaaggatctgtgtaaagattcttaacctgtatagggtctgtgttcagaagatctgtgaaactcctgaaattgtctgccacattttgtgtatacgtgcatacacattttttctgtgaaggatatatgagtattttcaagtctgtaacccatgaaaggttaaggaccaacggatttataacctgttcagaagtcttttacattgagttaccatttgccatctcatttcctcactaattgcatattagtgaggaaaaacttagataccatatatttttttattagtcttattttaattttccagaaaatttgtgaccttttcataatacagtgttatttcttctttatgtgattcgtattttagtacaaataccatgttaaggtgcttgataaaatgtgaatgatttatgaaattttacttatatacccaaatttgttgttaaaagggacaaaaaggaatttttttgtattttacattcagtccttttcatggaatagaatattttaaaacaactttggcttgaatttttaattatcatatttagaaatcctgcttttatgaaaatacagaaccctcactctgtggcttacagacaatagtagtatattatgtagggtagcctaaacaatggttgattattgtgtttgtgtatatttcattctctctgaattggacttgagaggcaaactttgtctttaaacctttagctgttgctttctggacctttgtattgcctaagggatgcaaacttcttggaaagtagaaccataaagttgtaaatgaacaagggaagaaatagaaaatataatttttgtcttcattaatgtttctaaagtagacagtaatttcacaattacagtatccactctcatgaaatttactaactacattaatgagcaaatgtgaagctgttttgctaatgtggaaattaaattttttaaaacaaaacttttttattctgtcaccaaagaaagaagcacattggttatgttaataaaaataatagaataaacagtcattcattggatgtttaattgttacaggcacttttacatattaccttactggatcttaaccactgtaagcattaaatggtattgccattttgatgaggaaactaaaacatgtagaagtttcttcaaggtgttctatgtgaccttcaaaaccaggcaattaatgggtgcttaatatttgttaaattgaattgcattgaaatctctttttactctgatcttttcattagtattatcattttttcatttatctgcggttaaattatggcctcaattttgggactccaggcctcagtatacattaacataggaaatatacccatttaaatgtctgctacattgtttcctgcagtgattcttctttttataatcaaagcagtgtgtagcaagcttttatcataatattttggaaaaatacgatctcttttataatcctaactgttagctaagtgaagcagattttctatactttcattcccacttattagtcacaaattatggggctggagatgagttgagatattggaggtcttttctccccagccttctatgcaaatagaggattttcattttttcttaatagtttgtggtgtttttcctaaaaagtaatccttaatatagtttttacccatattggtttagtttcttttgagagaaaatatattttattgatatataataattatacttttggtatctctcattttaaggtattagcctcatttttaaatagtgtttgaatcggcaaatgggtaaaaaatttgggtgttatggaatataagaaaaagaaatgaatagttgtatagtcaacattttatacagatgtaagtatataaagtttatatcaaagaaaatacttcaaaatattttaagtattatagctagtattgatgcagtatggtcaaattcatttagtgagggagtcattactgctacatctagcttttataaaatttgaaaaattcatgaatattatattaaatattttaccactttgggaggccaaggctggtggatcatgaggccaggagatcaagaccatcctcgccaacaaggtgaaaccctgtctctactaaaaatacaaaaatgagccaggcgtggtggcgtgtgcctgtagttccagctactcaggaggctgaggcaagagaatcgcttgatcccgggaggcggaggttgcagtgagctgagatcaggccactgcactccagcctgggcgacagagtgggagtccagctaaaaaaagaaatatatatatatatatatatatatatatatatatatgtatatataattcatataaatatagtactttatttaaaaataaatagcattttctcctcttctcatttgtttatacttttaatatgttctgtttacttgtaatcaatgtggagtcttcttttaaaaaaaaattaacattgctgttgtgaagaaaatttgcagatgaatattggaaaatatactgaatacctagaaggaaaataatgttttttgtccttcttaatatagaggtcaaaatagaaaagctatttctaaagttgccattcgtgggaaaggaaaggccttatcatttatagaatttgatatcagggaacagttgttctgaagtaaaacaatccagaccattaccacattgataattttctccaattagacagattagaggtttaatcctaaaagaaccccagtatccaatatttttgcctacatctttaacattaaggaaatcctgtttttaaatttatatttttaaccattacacaagatctttattattggaaaaaggacagacgcaaattaatcagaaaatttctcattgaggaagattgagtttttaaatgtatgttaacaaaaggtagaaaaactcatcacacttagcatgtatacagtacttatatggactagaaagtttgttcttgtgctttcagtagaagcataaaacaaatctgatgttgtcatagagatagtttcataataggttatgtttttgtacaagtcccatattttcactagaactattacaaacattacagtcatcagcagatgttacacatgtctagcatagaaatttctttttttgtttttgttgtttgtttgtttgagacggagtcttgctctgtcaccaggctggagttcagtggcgcgatctcggctcactgcaacctgtgcctcccggaggttcaagcagttcccctgcctcagcctcccgagtagctgggactacaggtgtgcgccaccacgcccagcttatttttgcatttttagtagagatggggaatttcaccatgttggccaggatggtctcgatctcttgacctcatgatctgcctgccttaggctcccaaagtgctgggattacaggcgtgagccactgcaccgggccctagcatagaaatttctaaagtggatataaattaatcatatcaattctaaattacagtttagttaacattttttaacctgttcttcagttattacactgtatttttagtccaaaaaaagatgaaaggatttatcaggatgttttgaggggatagatttttaaataggtcattttgaagatacttttgagtagacatagtcattacatagtcattaaaaaaccagagctttacatatttttataaaataatttttaaattctaaaagtaataaatgaccttagggaagatttggaaaatacaaacaagtatgaagaagaaaaaaaaaagtccccgcaatcccactgtgcaaatcaaccactcttttttttttttccaagccaaactgtatccagctttattaaagatactttccataaacagtcgtggtatttcaggcagaacatgggcagacagtcattaacagtacacaacaactttcaaacttaactaccttcttcaatggactaccgaaaatcagaaagccactataaaacccaatgaagtcttcatctgatgctctgaacaggcaaagtttagagtgagggttgacatgtcacatttagcatgttgtttaacaacttttcacaagctgaccctgactatcaggaagtgaaatgaaaacggcagaatttatctgaagatccacaatctagaaacggaaccactgctcttttgacaggtgccatctcagtggcatcccggaaaagtccagattgcctgacacactggtaaccaatgactggaggtcaggtcccaacagatgtctgggcttaagggagttaagtctgtgctgatagatgggaagggagaagagagataaaaatgattttgtttttccataccacaaggcttttgtgccaaggtggccatatgtgtcaaagtcgcggaatccctcctgggagccaagagtaagtctctcaaaactagaagggaaaagtgttttccccacatcaatccagcttcgaagacaccctattagtgacatatgccccttccccacaaaacaacaatgaagtgttctgtgtgctaacagcatagctcaaaaaaaaaaagtaaaacaaaattttgcatttttataaaacttggtaaaaatagtatttcaaactgttcagtcaccagaagtacacagttatcaaaaatgcacacacttctcttggcacctccagcaccttcagctttctgtgcctgatctgttttgacatctccattttctgcagggttattcccctccttgccagcatcagcttttccctttctccctttgggtaccttctctcccttctttgcaggggcctttttaggcctgggctctggctttggagaagcaggtttagcggacaaccttgcagatcttctctgtggttcgtcctttaccttggctttatctcctttagcatccccttcagcctttctcttgggcatggtggtggcagtgatggtggtgggacataggcactgggcgtaggatgcagaggcatgtgggctttggtgagtccaggggtcgttcttgcctcttgttcatactgctccaaatcaaccactcttaatagtaaattctttataaatattgactattgtgtacatttaagttgtttattacttttcactgttaaaaatagtttttcctcacacaatttctaaggatgcttcttaatgacagcaaaatgcaattttctaaagaaatttatccaacttgataaaaccaagagtcctttacttaggacaggtatatggggtagtggtaagagcttccctattccctgtttgacacaaattttcttggaagcaaggaaagtagaaccatattcccaagaagcattctcttggtgaggcagaatagaagaaagaataaatactatgagaacattttagggacagtcctgaatagtagtcgagtagtaagggctccaaaagaacttacattccttcctttgtcactggaaaatcccagttagctttgaatagggcgttgactctacccccatattaatatttttagacagtgttatagattgaattgtgcttcctcaaaatttgtatgttgaagctgtcactcccaatgtgtctgtatttggagatagggcctttaatgatgtaattaaggttaaatgagatcataaggatagggctattatccagtatgactggtgtctttgtaagaaaaagactagctaccaggtgtctgctttaatagagaaaacctatgagacaagaccatctaaaagccaaggagggaagccacaggagaaaccagccctgcggacaacttgatcttggactttcagcttccagaactgaaagtctggaggctgttgttgaaaatctggaggctattgttggtggctgttgtttaagccacccagtctgtggcatttcgttaatggcagccctagcaaaccgatacatacagttttctccctttcccttccccttccccttcccattttagtagtagtgcagtaggcggaataacagctcctcacagatagaaactgctactctgtggactgtgtaagcattaccttaaaaggaaaaaagattgggagactatcccgggttatctaggtaggccataagcacaataataaatgtccttataagagagaggcagagggagatttgacacagacatacataagagaaggtggtacgatcactaaggtagagactgggataatggccacaagtcaagaaatgctggcagctagaaggaggaagaggcaaaaagcagatttccaagagggaatatagccctgctgactccttgttttctgcccagtgaaactattttggactttgtgagggaatatatttctttttgtttaagctattgagtttgtagtaatttgttttcagcagccataggtaactaatgcaaatagctgctgaaaataccaaatacttttctgtgtctaatgatgtaatcttatggttttgaatcatatgatgtttgctttctaatttgtgaaaaaatcatatcgattactttgctatttttttgtaaactgcctctttctggtatttttttcaaacactgatggatttgataatattttgatagagttttttattaaggaattaaatagtctctactttttcttttttatactgtctttgtcaggtttgggtcataaggttatatgttaaattgttttggatacatagtcggagcccaggttattctaaccttgaaagtcagttatcaaagctgaagctttctatgatagacaattgggagataattttggttcttaagtagaagaaaccatattaaagtgtgttttttaagataataagacataacagtacatccaaaaattgtttgtaggtacctagggagcaaaatcaggcataaagtctcagataacaatctaggtactgagtttctcaaacacattctgtctcattcatgttcttcaggagtgaagactacgtgaattgagttttgggggatttaatcaggaagtaaaggaattctaagcccctagagaatgtcacagtagatgactgagaggtgatcatgtttatcttttccctgtaattctttcattccattttttttttctttggaagaggtgaacatcgtagataataaactttgggagtgttaggggatggaagggaacatgtctgtataggtcagagtttctgaggttggtagccttggactttttgtgagagaaagaagagtagagttataaggatccagggatacatatgcaacccaagcattgtataaacactggaaaaataatataactcacacgtctgttattccacattttcaaatgtacttaattactttgtaaatctaaatcatcaactgaaaaattatgtttctaaatttgtggcacctgtagttaatgctttcaaacaacaaataataacagcttatacctattaccctatgggaatctgtagagtgggtttaaaaaattattttaaagggaccatcttttaaatgaaaccctccctataaacttataaaattaatcagggaagaagggatggggagaaacaaaaaccaagcttgcagcacattcagcgttaatcactaggtgaggcttgctctctggtctgcttcttcatagttgtttggtgcctattgtcctacaatcacaaagaccttagattataattctccttaactgctccatagaaaacaacttgaacattatgaaacattaagttttccctttgagatactctttttttttttttttttaactgttccaaaggcacattggcacctttgagatacactttcaggtcctgcataccagtgaaactacaggcaccagctggtctgacggtgagctgtctcagcaaatgcactcggtatcttcatgatttcatctcccttattccaaccaatcaatgaccccaaatttccagccccttgccctctactatctccttaaaatccccagcccagaactcctctgggagatggatttgagggtctcctcccatctcctttctcagccaccctgtggttattaaattctttctgtgttacaaaccctgctatctcagtatattggtccgttactgtagatcaggcgtacaaatttgttggtcttgaatctaaacaccagtcccttaatcttattactgaggatactcttggctatgtagttactcatggttacattgctagttagttacagaaccctggtgagagcctgtgttttcaagatctcttagaaatgctgtgaagaaaaggtcttaggtttaggtcttagtagtaattatttggtttgactttggaaaagtgtagatacctgcatctcctcactgtgggctatgcacagatgaaatgtagcattattacgttttgaaaggtgcaggatagcttctgtttttcaacattatgctttagttgttctagccaccattctttatttaaatgagtaggaagccaagagcaaagtaaagatggatttttggagtcctttgcttattttcccacattttttcttaccagagaacacataacatagacaggtagataggaagggagggaggtagataggcaggcagttcaaccagaaaaaaatcaagcctgttttagcaggttgtgaaaagatgaactgaatctgtcaatgtccgcatcttctttagttaccaggagtggatgtgggtaagccttggtgcagcagataatactgataagtgtatatgttccaaatagagatgtggtcataggaggaaaaagaatgttaatgccatctgggatgttaagaagttagggaaggacacagagcataattgagatgaaattgtaacttcttactctcttcagtgatagtcaaatctaatttaagtctgttactctattctcatgaaaacattctcaagagttgaagaaaataaatagtaaggcagtctgtatggaccttaacaaaacttagttttgactattggaattaaattttaatattttaatttggaaatctcatcctgaaatctcttttggtaaaaacatggaatctttttagtatgaattagaattattctggtcaacaattatagtttctgtacccattagggtatcaaagtcttatattcaaattatattaaattgactcattgactcatctagttcagtgggaatatgattttagaagtagaataaagtctacttgtatttgtaaagttgacactatgttttatgagggaatttaatgttcttttcaggaacatgaggctggacagaaagataatcttacaagaaattatctcagtttttcattttggccttttgttcacaaaagagctagaattcaaaagaaaacaacatttagcctatttatttatttgtttattattttttgagagggagtcttgctctgttgcccaggctggaatgcagtggtgccatctcggctcactgcaacctctgcctcccaggtttaagcgattctcctgcctcagcctcccaagtagctgggactacagttacatgccaccacgcctggctaattttttgtatttttggtagggacagggtttcaccatgttgatcaggcttgtcttgaacacctgaccttgtgatccacccacctcagcctccaaagtgctgggattacaagtgtgagccactgcgctcagccgccctttttaatactatggttattttagttgatatcttcagattgctcttgattggagtatataaaatatgtcatagattgtgttattttaattttacttgtctatgttcttatttctttgaagttgctatttttcactatattttgctgtcacctataaattataaatattagtcttaacagaagtcagatattttctatattggatttttttttgaaaaaaaggagataggataaaatgtaaggaaatcaaatctaggaactaatttagaaaagtcagaggatttttatttagtattgagaagtataagataagttaaatgtatacaccagagaaaaaaagttcttattacaatgtaatatgtggaacaaaaaaaaatagtaaggatatggctatctatattttattttaatgtttatttaacaaatatttactcagctccaaattaggtactagaaactgtctcagactctgggaatatatttccacacatcctggtcaatgaaacattaaatttctaattagaaattttagaagttctaagaaagcaaaaagctcatggtgcttttggaacatagtccagggagatttaacctaatccagagaagctcgggaaaaatttgtgccagactataaggtgagaccgtaaggttgagtcagagagggacagaaggggtttggagagaatgttattggagtgtaggaatagtatgttcaaaaactctgaagcgactataatgtattgtaagataccctgaaagaagttcatgatcgtaggagtggaggcagtgagaagaggtgaagccagactggaatggttcaaaggcaacacttgaaattacctgattaaaataaggcactcaacatagccttaagaatgaaggttattccatttggtattctttgctgaactgcttaacagtatttttatgtttccatgtgctgaattcattttataaatttttttaaaagtaatgcatgtgtttggagcagcattataagaccatggaaatggttttactgtttgtctcttttacgttttttaagaacaaagcttccattttccacttccatctcttggactattcatttaacggtgatctttctgtttcttaatccaggttctaaggattctggggttggtagtttaactcttaatccttttaaaaaattgaaccaatgtatcttttcaatgagaaatagttcataaatcttgctactcaaataaatcatgagtctatatgaggacttcagttgggaattcgtttattcctgttcactagaattaggaaactctatgtagataggagccatctctgtgtttacttactgtctctacagttcccagccattgcctagtatattaatccatttttgttggtataaaggaatatctgagactgggtaatttacaaaggaatgatatttattttggctcatgtttctgcagactgtacaggaagtgtagtgctctcatctgcttctggtaaggcctcaggaagcttacaatcatggtggaaggcaaaaggggagttggcatatcacatggtgagaggagggaacaagggtccggggccgcggtgccgcactcttttaaacaaccagatctcatatgaactcagagcgagaactcatttattgtgaggacagcaccaagccattcatgagggatcttcccccaagccccaaacacctccctctaggcccacctccagcattagacatcctatttcaacatgaggtttggaggggacaaaacattcaaaccgtatcacccgggatattgttgatgaagtatttgttgattgaattaatactaaattttgttggcattacattttattttgactttaaatgctgatgagtatttgatagttcatggttctgtgataacatttaggcttgtagtgaataaaacattacaatattgtttaaatcttttcttttacatttaaataaaagatggataagaatgttactttaacattttatataatatcctttaacaatctgtaggctaatctttagtttatggggcttctaacccataatgcagttgtactgattcttttgccatttccaatttgttgctgtgaccatttggtgaatattttatttcacttattatactttttagatctagagttttctgtttttgttgtttctttttttctcttgagatttattctgtgttcactcactgatagcatatttttcttcagttctttgaatatatttataatagcttttttgaattactttacttgctaaattcaatgtctgagcccagttagagtcatttgtattgagtgtattttttcttaagtaatttcctgaagactttcctgtttgtttttttggggatttttttttttttttttgcatatgtagaaatttctggttgaaaactagacattgggaaacatatggtgaaatgactctgggttctgtcatattcttttgaggaccttggttttttgttctagtaggcaattaacttccttgggttgaaaccacaaactgtctcctgtgaggtattcagcttacacctttcctctgctgctttgttagcctgaacacctataggtcccccttgtatatgcacagtgtggtagcccaaagattttggcagatgctcatcttctttgttgtttctttgtgtctcagaatttcctcctaattgacagtagccatgccagctttgggccctatactctgacacatcaagcctgtctagattcatctttctaccactcaagctgtaaatgattgaaaaatgttctcagttaataaaagaatcacagattctaaaatcttgtttttttttttttctcttcctgctttttcactaggcttcataggcctcccttgctcatgtgtaaattttgttgtcagctaggaatttgtgtagcttgtgctctgaatttgagtctcgtgccttctgtgattagcttggtgctaacatttttcctttaaattttcagctctttttccagctctccactccaagttctagcatctttagccagtgcgatgccatttttttcttctccttttttgtagctgtagctatggagtttggtcagtgccttgcagccagtatgaactctcaattcttaccccttctagttttcaaaataaaactctcttcagccttatgtctgcatttgaaagtttgaagtatcttcaagtagtttgtttgctttaatctagtatcttattattggtatctctggggttttgtatgaccacgtcagtttttcagcatgatcagaagttaaactacttcatccctattgatttcaaatagtacatttaaaacaagggcttctaaacattcaatgaaattcaaatgatgttttagacattaacttacacctcaactcttccaaatttgtaagttcatgtttgcactttgtacttcccttttttttttttttttgagaacagcaaattatatttcagctgatggactttcctcagtttctgttaattacatgtgtgtctctatttagtagtgcatttagagtcactatttttcactgctgcagatatctagacatttgattggaaaatagttcggcattgaacttagtagcaatattgggggacttgggactaaaaagcaccaatcaacttagaaaaccaagccctgtagtaacacaagggaaaaaaaaaattcctgaagccaataccttgggaaataaagataatagaaatgaaatcatctaagtagatggccttaatatttctggacatgttccataaccctcacaggtaacagtggactggcatctgggagacaggacaaaacataaatgtggaatttcaaggatattcctattttctgttaaagttgcaggaagtatgaattactaaagactttacatatggtcagattgctgagtttcagtttcaaatattaaacactctttttcagacgttctcccatttcactctcatttcatatgagttcatattattttatgccccaggcccgaagtgtagataagtttactgctccattgtatactgtttatctgattcactctccccctcttttgccttctggtgttacagagtggtaagcaggaaagcagggtctgtatctatctgtgctataggttcactatccttgccataaattaagttgatcgcttaaaaagtatcactactttagcactagatttagctcgcttttaacagaaatttcatggtgatcttttctcatttcaaggcccttgaaataagggccttgttttctcgttaatggagcatctcattctccttcaacagggcttgatttcctttgaacaaacattattcttaccaataattctgataactttctggtaatttaattgtggttatccagcctctttattctccatcagttcattttagatattcttctgatttccttttgtctttcacaagatctttgaaatcccattttctctacatctttaatatgacctgaaaaaaatgtttgttcaatttatacatcctgccacaaaatagtactctgcttcaaattccacatttatgttttgtctcctctgccacaggtaataacccgtccactattacctgtgggggttatggaacatgtccagaaatactaaggctgcccacttaggtgattttattcttattatcttcattttccaaggcattggcttcaggatgttttttctccttgtgttttctgacttgattggtgatgccgagcattcacacagcttttcagtttctcagcttagaagcaaggaatgttaaaaagttactatcagtgcctttaatcatgaaaaagacaagtagaaggaattagttctctcacccagggacatcagtgtgtatgtataccagtgggaaccagacatcgtgtctaggtaaaatcacttatcacactgcagctaattttttcacctggtaattttagccaaactaggtcatgttataaatgtcagcaaggcaaaagagagaataaaatgtcatcagaataatgcacatacatttcaatggaggttaaaatcttttataggaaacaggattatgaggtaggagatttttttcattgcagcagtgaatgtgaatacagttactatgattcttaaggtattcactttggcctcattcctgctttctttaaattagaaaaaatatctcaagtttgcttacaggtaagagttttaagccaaataaataacagttattgtagtgatttggttgaaaaataaacttctaattcccctttaaaaactgagaagaaatgaaatatagtgcaacgtcagccacaaaatcattattttgatagctaacatcatttgtattctaggctagaattttaaaatttaaagttcaaaaaataaaattttattcacattgttgattttgcccaatgacacaagctatatgttaatattaaattaatatagacaaattaaagaaagtaccacatttatcactttcatatgtagtaatttttatttcaataaccagaattgtaggtttcaaaaaatgtttgaaaatttgctttaattaatagttttgacaaagaacctttaatagaccgctgcttttcttttcaaagtttcagttaaacctgaagaaataatatggtcctgctgtgatttttgaatgaatgcttttgtggttgcataaattgtgttttttcatgaatattaggattgtaaatgaaaattaagtctggattctgatccttttcctttcaagcttattaaaataagatcttttaggatcactgtgactctctccttgttagttttatgtcataacttagccctgattataaacaaactttaactgtttcttaattcagttttttcttttgtcatgagcaaagaaaaattactgaaataaataagcattgagacatattcttgtagttgaaaacttagtgtgggaatcatatttttgactcccagctcaggatagtattaggtagggtagattattttatcttcttgtaaaatagtgtaaaataaatatttgcctatagacattacagtttagagtagagaagtttcacattagaaagatgctgattcgtctttacatttaggcataaaagagggagtacatagagagcatttataatttatctactttaaacataattattttttattatttccctttgcactatttttaatcctactcatagaatgaaagatgaggcattgaacttgtatctaagattgatgatttgttttgagtctggggcagacagacacagtaatggcttagtctgatacaggcattttgggttcagtctctagggacaggtattcatatgtaataaaaccacttgaactggcattgattgccattgttgataatcctagcaggatcaacattgattgagtaaataaaaagatcgaatttaccttcttctggcaaggcaggcagagaagcaggacaaagcataaagacttgacagcactgtagcattacctctattcaactgtgcttcagagaaaagaagtggcaatgattaagggtactgttcaattcagcaagcaattattgagcagttctgtagcgcaacactgttagctgctaaaggactcaaaaggagaagacagtatgattttgcactaaagtagtttatcatctaaattggaagacaaacggttcatatgtgaaacagctagaaaacaaattatgacagtatataattgagtgtacagttgttcatgcaacagaatacaagcacaatttatttgtccagcaagtgaaaagatatatctttataatgtttataatgttaaattttgtgtggcaacataaagtaacatagcctgagttaattcaggtctttggttatttaagatgaaaaaacccccagcaatttaaatggtatttatttaaaatatcctttattttatttatcgtcctttatttagaccacctaaaaacactagatatatgattattcatacctgagcccccccaaaaaaaaatcaagactagcttactccctgttaatgattcaatcaattgagtataaactttattaggttttgttcactattgattctttgcctcatatatcataaaggttcattctgtctattttgcagtattttccaatgtctaggtattctgaattatgttcactaaaaagtaggtctcaaagagcatcgtaatctccttagctttgtataaggaagccatgtaacaaagcagccttactacgtttctgtttttgcttttgttttatttttatctccattacttgttaagtggtaatggtgtagtagcatcttaaaataccatactattaagattgagccggggaaccttctcctattctttgctcttcagatatttctctactgtaaccccatagctcttgaacatctcatgacatatatcattgtattttaatttaataaattcatttttctatgcactagactggcttctttgcattataaccaggacttcacatagatgctggtacctcatagatttctaataaatacctgctgaattaaggaaacacaaatttatgttctacatcacgatgttagtgaaaatttgttgctgtgtttatttctcacaataaataaacatggggtgcctcctgtagtagtgtcctatgggaatcaattattgatacccagtgatgtagacaagttgttttaaaaaagaaaagattgaaggaaagcagtctcctcttttaccagcccccacctcaactatataattttaagaaaattgatatcaaaagctgtgatatccgtttctctttaccatccaaagttcttgaagttgccttgacaagcagagattccttgaatcagtccaaatacatgatatatagataaataatacgtgtgtgtgtgtagacatctttagtagaaacagcttttcagatactgatttcatactgtcttcctcctggctttccattgacttactgatttcagatacagtttcaaattgcatcttaattgtggggagtggggatagtagctagcctctggctcctcttttttaaggttatttctgagactgccttggagtggttcaaaccagaataaatgcagtttactgcctatcactccatactcttaagatggttttgccagcttttagagcctctcagatgttctaaaataaggtcaagctgattctacatcctattggtggtaggtgttagtgatgtcaatttggcacaatgtttttgacttgagatagaatcattaatccagggatatcttgttaataaatttaccgactactcacttggaatttttgatgtagcagtttttaataatatagctttttcatgtcaacaagagtacattctgactgattctatttataaaagtatgcaatactaatgtttaatattagaacagttagcagtagttaactttggagaacaaaaatggtagaggtaaggggtcagtaagaggacttctgaggatgcaggtaatgtatttattcagcgagtcgtggttatatgggtgtgtttattttgtagtaactcattgagctgtatgattgctatacttcactaaaatctatggagatcaaaggctactttggcagctttagtctaatgacaaacttattattttcttaaacaatgggcaaaattttcttctgactttcagattcctacagtctaaagggaaagataaaactattttagtatgatagctaaaatgcttttgctcttttaaaattctcattataaagtgtattgtttattttaacttttatatgactgttattggctacttaaaagtctttaaagaaattaattgggaaataacagttgaacatgaatatgggagtacttacttcaagacaatccagaaaaaaaaacaacagaatataaaatgtaatgtttaacaaaaaacaaatgtcattttgtatttaaagaacagtttaaggtatgtttaaaacaactacttctgaactgaatgatactacttctcaccccctccatggcaaaggggtcatctaaattagttgtagtcagctgcaccaagctgaagagccactttacactgaactgaattttgtatggaagctggaaagaaccacagactttactaccacattctaattggcaggaaccctgcttctgatgctaaacagcatgtcaggattgcatactgtatcaatttcagaagtccaagttacatttgggtttattgtttatccagccacaagtaagctgccttctgtaacttacccattggcttactgggttatgattttctaattagaaatggaggactttgagatgttaaaagtgggggcccaataatgagtattgcactgcagatacacagactgaatatcactgtcctaaaaaaaaaaaggcttttaaattgaaatatcaaaatcatgattaaaatcgaaaggtaaacaagcaagataggataaattcaatccatggtgttggtaccagtactcttcacgtgaaaaggacctcggcataagtgttcagaaataacaaagatcaaccagcttggccaacatggagaaaccccatctctactaaaaatacaaaaattagctggacgtggtagcgggtgcctgtaatcccagctactctggaggctgagacaagagaattgcttaaaccccaggggggcagaggttgcagtgagccaggatcacaccactgcactccagcctgggcaacagagcaagactccgtctcaaaaaattagcaaaaataacaaaaatcaataagctgaaaaatgttataaaatttgacgttgaataattcattagacatgaaattacagagtgcttacatttgttgggtactcttttaattgctttacatatattaacttgttaaattctcaagcaacctatgagatacaggacaagacaaagagaagttaagtacatgtagaaggtcacacaaatgacatttaaatccaggcagtctgattgtaattctatgctcttacccttaaaaggattcgtcaattccggctaaatggtgtgcctgaataaaatgtggagcacggtagcatttataatatttattcattcaacaaatatttattgaacgcttacgattgggccaggcactatgctaggtatttatggttataatattcccccacttatttttggggttttacttttcatagttacctttggttaactgtggtctgaaaataggtgagtacagtacaataagataatgtatgtgtgagagagaaagactacattctcatgactcttattacagtatatagttataattattctattttattattagttattgttaatcttttacagtgcttaatatacaaattaaattttatcataggtatgcataataggaaaaaacatagtatatataagggtcagtgctatcagcagtttcaggcatcctttggaggacttgaaatatatctcccacagataagggggaactatacataacagtttatgaaagtccttgacccttgtgaagtctgtattctagtagaggtctacagacaataaacaaaaaagtaaaacaactaggttgtctaataaaatatttacatagaagctatgaaggggactgtaatttcataaggtggtcaaggaagacctcactgataaggtgacacttgagtaaagatttgaaagatgtgagaggataaaccacgaggaatgttctggaagcagaacattccaggtaaagaaatcagcaaggacaaagtccctgagaagaaagtgagcttggtatcttcatgaacaaggagagagttttaatgaagcacagtaagcaagagggagattggaagaggagaggtgagaggggtgtggtaggacagatgatgtaaagccattgttaggattttagctctcgttttcagatgggaagctatttgaggaatttgcatagaaaatcaaacctcaaaatgttgagagaagggttctagaagaatccttgataactggaaaggtgaagtttttacattaacagaagaggtaaagagtaataatcaaaaataggaagatcttcagtcagtgatgctaatgtgtctgaagagtcagggtccccagtaggggaaggaagaggaagaaagtgaaaggaggctaaaattttcactggcattgtaggtagaaagactagggtttgagtggacatctgctatggaagtcaggtgacagtggaggccaaagtaacaaaagcaggcagggaaattctcagcagcatcagagtaatacaatgaaattcctcatagaaatactatcaaggaaagacagagaaagccattggacacctatgtcaatcaactagggcagctttgctaacgaacacactcttaaatctggcaatcgaaagctgcctgtttaaaaacaaaaaagtaatgaatagcaatgaaaagaaaaaaatttcaattttagaataattattagcacaaggtcacatggacaggaacaattacccattgtttacataaattctcatggtagcaataatgtaatgcatatggctttgaagatgggtaaaattattactttaatacagtaaaacaggtaaatcatgaatgatgtagactgcttgtgccagtatatttgaagtaaagtaaaattcagtgttcaaatggagaaaccattgaagtgtccagtaatgatgcatttaaataaggtgatttggctgcaactgcattcatctgtaaataatttacacacagatcgagttaggaacttccgaaaaaatagtactcgttctaaaaacatccaattggataatttcacttataagggtaaagagtactgattttaaaaggttctcagagtctgttttgtgaagagatcccttaaagtataatggtggcggagcacagggaagagctcacatgcagccgcaggagagctagggaaaaagggtgacagctctgctaagccgccacttagaaaagagttggataagagcagtctcttcagagtctgacacctttcattttacggaaaaccttcacctagtctgtctatctcttaccagtgaacttcttcaaatgtaaaggtgtttgtaaaaggacataaaaatcaatcatttgtataatataatttcagatctgtgccttttatatatatacttttaccacttattttttccatctgtgaaatgtgctgacacctactttaacaaactgatacaattgagaagagagagtgtgggctgctaataagaagctctcagtcaaaacatagtcaaaaacagagaacagattgataatgaatacttaattctttttaggagtgtttttggtcctacaggattcagaattataaaagctgtaattccctttggctgcaaattgtaggcatgttgcttgcttgttacatttcgagttccaagttgaatcagttgctttcttgaacagttgaaaagctgtcatttaagcatttcaggtatttcattttcctgttacaatcctgggttagatttgctgttacttagctctcacctcttcatctattacagttttctccctcatttaattggagtatatcctcaaagatcttccacagaaaaggcatactggagatacaatttcagagttcttgaaggtctgaattatctgtttgctttcatatttaatagatagtttgggtatatagaattctgttttcaaaatcattctcctatagaaccttgaagacatttcctccattgtgtcctggaatttagggttgctgatgagaaatagaattccaatttgattcacattcttgtgttggtaacatctttttccctccttggaatctcttaagggttttcttctttatcttcgatggataaaacttcaagagaatatatttggattcaagtattttattcattcagttcgcttgatacttgctcagcccttccatcttaaaatcaatagttttcttcaagtctggtggtttttaaaaattacttgtctgattttctttctatagcatacatacattatttgtgcccacctgttatctttggttatctttgaacactcttttatatgttttatttgcggcattatgttacttagaaataagaacatcatatagtttgttagaaaaggatacatgttattgtaacagaagaagtagagcagaggaggaaatgtagataaccttgggtatggaagcatccaagatgtcttccagaggataagtaaacttggtacaaccagacaatggaatattattcagtgctaaaaagaaatgattcggctggacccagtggctcacacctgtaatcccagcactttgggaagctgaggtgggtggatcacctgagcacaggagttcaagaccaacctggccaacatggtgaaactctgtctctactaaaagtacaaaaattagctggtcatggtggcaggcacctgtaatcccagctactagggagactgaggcactagaatagcttgatcccaggaggcggaggttgcggtgtgccgagatcacactactgcactctagcctgggtgacaagagcaagactccgtctcaaaaaaaaaaaaaaaaaaaagaagtgatccgttgggccgtgaaaggacatggagaccccttaaatacacattactaactcaagccaatgtgaaaagactctatactgcatgattccaactatatgacattctagaagagacaaaactgtgaagagagtaaaaaagatcaggggttgggggtgggagatgagtagatggaacacagatgatttttagggctccagtaaataccatgtatgatactataatttattcaaactcacagaatttacaacaccaagagtgaaccctaatgtaaactatggacgttggttgattatgatctgtcagtataggttcattgactgtaacaaatgtactactctggtgggggatactgataatagtaggggttatatgggaaatttttatatcttcctctcaattttgctgcgaaactaaagccgatctaaaatagatttttttaaaaagtagagcagagtaaaggggttaatgtattggggtgggggtatgcaaattgcaattattgaatagaatgatcaaggtaggcctcattgagaagctgacgtgagcactgagcaaagactgtggctatctgaatgaagaatgttacgggcagaggatataactagtacaaggatcctaaagcagaatgtctctgatatgtttgatgaacagcaagcaggttaatgtggctcaagtgaattgagtgagggagagagaatggtgggaaataagatcagagaggtaaattgaaatgggctgcgtcactagtctagactttgtaggctagtgtaaagatttcttagtgtgacagagatgggaagtgtttacagagtagaatagtaatggttatatttgagtatttttctctttggtagttttattaaaacagatgtaacattgcagttttacaaatcacatgattttcaatttagttctatcataagttcataaacttgaaaaaaaatactacatcaagcttttattttaaaatgtagataaacgttacagaaaaaaaattgccaagcgcaatggcacatgctatatagtccagctacttgggaggctgaggtgggaggatcactggagcgcaaaagtttgaggctagcctgggcaacgtattgagaccctgcttctagaaaaaaaagaggcaagatttttaagctgaagtactcttaggaaatatttcacatgagcaggtattatctttaatctgctttttattatcatggttaaattatgagcaaagctcataaaatgcaataaatgcattttgtatttcttgcaagttagcagtggtgttaaatcttaaatctctgatctgtactaatatcatcaactcctactgagaattagaataacagtagaaactttgggaaagattttaaatgacaacaaagctaaagggtcagaatgtcgtcgtttcaaagcaattttcttagttgtaataaaggtaaatttaataaaagtaaaagcaatctgctcccagaatgttacagtattttgttttgaataaatttatattatctggaaatcaatatggctcatgttgcacaaaaaacaaggtctgaaaatagtaatgccctagagttccagtaggaggccatcgccttgaactgtttagaccaatatgaaaggctacttcctggaagaaacaatgcttctcagcaagatatttcttaaaataccattttcagaattatttgtagccactataataaaactatcagtaaattgtcagattgttcttggcattggtgacagaaaaactgcacatatttactggactgcatgacaattaagaacagagtttttcatgattaatgggttaaaaggcaagagttttgaatgaacttaaattgggcaattctcaaatctttgatgattttattatatgtcatcctgaccacttttagctggtttaatgtaattttgaaatgtttccctaaatgttacatctgttaatagttagaaaccagcttaaattcccattaagttttattcaacaaacctaaagcttctgttctgagaacctcataagtaagtaccctctgtgccatagaaggactaacagtatacttcaacattttacaattggttttgaaaattaaaaaatatgtaggctccccaggagttcatattcaatttaacaacatcaattctacttaagacataaaaatctatttctactggcaacaagatgaaaatctccagctcatactccttatatggggtaaacacccagggaatgattccagcaaagcacagaaccaggtttgtgagggagagactgggctttgacatagtaccactggataatacatacatcagtaattgtttctgtcacttacaaatatgtatctgtttaatgtcttcagttgtttagacgaacgatttggatgatcctaaatttctttgaaacttttacatttagagttccaaaaatttgtttttctccaagattaaagcaattctagcatagtagcagcatgctgcatcaacaagttgatttttttttaaagtgtatgtcttctattgaagagctcgatgaagttcttaactgttgtctctttaattaaacagagaacagcaaagcttgtttttttgccaatcgcaaatttatactcaatttaaaccatggcttttaacaaaattcctatactaaaataactcttcacacaagaatcttagtggattttttataggttcttggttaaccagcaaaactcaacaaaatttgttggcattagtaacaaatactttttaaatatgcttctatttctcccatcagaactttgatttctcttcaaagaagcctcatcatagacttactcacacatttgtgagagttattagaattgccataatcaatggatactgaagaaaagggaagatttgagggttggtttttgtttttaatttttaaaaaactcgtatcatgattctggagctaaaagcagctcacatgggccttatatgagctttgcctctctttgagcagtacattttaaaagtcaggaagaaaataaaatctgactcttgtagcatttagctttgtattggagtggcctttgcaggtaatgccaacttccacgacatttagaagattcataaagtgctggtcaaaataatggaaaaaatagcagctgtcatttgatcagaatctgtgtgcaaaccaattaaaagccctgtcataactatttaagcatgtaaggtgatttatgattacctttcataaattaatgaattctaccaataagagcagggtgctacattgggtgctcctgttctcgcagagtttacagctacacattacatgaggactgctccaggtttgctgtgtttaaatgattgacaaggcagaaactttgtcttttcttcaactgattggcactatctacttataacttataacttagcttatttttcactcccccccaaggagagtagagtccagaatggccggtggtagtctcagagtagaagagttgaggtgtcataagataacgacacccttgaatttatttctcctatactttgctttataaaagtgagcacaaggacagacaggcagaaaatagtagatcactatgtgaggctagagagagtcctctttcaggttcaacaaaggaaagacagaagaaaagtgaataaggtacataaatataagaacataagtgtagacaggtagatgatgaaaaatgggagaaatggaagacgtaacaaaaaagaaaaaagatgaagaaaaatatgggaagagaaaggtaaggtgagatgaggagggcaaaagaaacagaatggagaagagagaaaagaatggaggcaaaggaaagaagggagaatacagcaatctcctcctgaaatctgcctgtcccaagcataaagattaattgtaatattttaattacaaattagcttttcctgagaaaacttcataagcacataattcttataaaattgtgttacctcaaatatttaaaatgctttctagtcaaatatttagggggtcatcattctccaaaactagctagccttatgcagctggtaggagttcttcacagctgttctttaagccatgttgcatgagaacttcatagagaacctgagaagttccattttaagagtttctcctgcttcggtatcctaggcaagaaatcaggagaaaggaatgagaaggaagaatcactagtgtcaagtgacacatgaaactccagtaaatctgggtattacttaggtcaactagagtaattcaacataaaggtagaatagttgttaagattttaaaagccaagtggtgatttcgaacttgtagctattgttctaatatgatgggtaatcacttcctgcaatggtgaactatttataaactgctggctcctcaaaatgtaaataaagaaaaattattccaggctacaagattaattttcctctatgtctttaatctgaggtagatccattttttgttaaaacacacttgttttatttatttagtcaaattcttcacattaagaaggaggaatctgagacccagtaagattaagtgactagtttatggtccttgggtagaacaggaatgaagcagaggtttccattcctaggtcacttcagaactactaattgaggttcatcagaaaaaagacataagccaaagaaattagaacatgaagttgagtatcatctttagtaaaaaggatctagtcattgcttccttataatattgaaaattagtttaaccgtaggtggacatttctttgaaatggtttctaccactaaaaataaaactgaaggtagaggattaggttagaccctggagcaaaatcaaaacagcttatttcagcctaagaacttttttaaagtaaatggcaagccccaaatacctacatatctgtaattttctgagccaccataaaatctgcatactctgtaccaaagtaaaaaacttcacttactgacacaacctttactaaaaagtgccacagactgtacgtaagaatacttttatttagagaagaataaaatacaagctgtctagttcttaatatggtaaaactctctatcctcttacactctgctttcttatttatttatttatttatttatttatttatttatttatttattttgagatggagtctcgctctgtcgcccaggctggagtgcagtggcgcaatctcagctcactgaatgctccgcctcccgggttctcgccattcttctgccttagccttctgagtagctgggactacaggcgcccgccaccacgcccagctaattttttgtattttctttttagtagagacgggatttcaccatgttagccaggatggtctctatctcctgacctcgtgatccacccacctcggcctcccaaagtgctgggattacaggcgtgagccaccacgcccagccaatttgtcttttagttagcctgaataaatttaacctctcagaggatccctcaactcatgtgaaaaaatccttaatagtttctgtcttacattaaacaaaaaggcagacctatgtcacctggagtcataggaccctgagttatctcctaaggtaactctaatgtacattccttaactctgaagctaacagctatgaaggtgaatgccgatagctgctgtaggtttcacagagagactcaatgattatgaagattctgaccgtatctaataacagacaacagataattgtacagtaagatttaggaaaaaaaagtcatttcagttttgaaagttttgttaaggtatataaatgcatatctgttgcctattagtatgatgatatggtagacaaattgcctttgtcaggttttagttttggctctgccattaattagctatgtggtttttgagaatttcagtcactttaacacatgtttatagatggttacataccaggcaccgtgcaagtcattttaacagttatcttaggaaatcctctcagcaaccctgagggtttgacattattattatcatcatcttacaggaaagagaactggggtttagattgagttttttctcaaggttcagtagctagtggcctgcttccaaagcttgtattattttgaaaagcagccagtttctggaactatgtccttaacaagtacttttgacccagtgggaatgaaaggggagtgcagaaagaggtatataggattccagccctcctacttctgcttcagccagagcaattgcctgttcattgttttaatatattgagcttttcaggtaagattttagaggggagagggttctgtagcattaaatgcctgatctcacagtattatgcttcactagaatgaaggggtaaaagtggtattaagctaatataagaaaagtaaataataatcgttggataggcttcaaaaaagaaatgcatttgagatggaccttgacaagcagataaaatcttgatttagttgaaggactccatctggggaaacattaatgaaagtgcttaaattttcaatgctaattaaaatgtttatttttaaaatgtttcctttgatcctgtttttctttattaaataataccctggacaggaattaagagcacagcctgaagtgattgtgatgtccaagaagtactactcatggaacaaatagacaacttgtcatatttcaaaattaaatgctgactgcactatgaatatagaaaagtacagttgtaaacactatattctgtaccatgtaacatcttatgtatgatttcagttctttttaagaccaccagactacagttacaagaaagccaagatcagactgactcaatttgcattacatacatgttcagggaaagcctaattagggaaaacagaaacttcaaatttcactcttttaaactgaataggagagtatcttacatccactgccagaaaatatcaccccagaagtgaaaatttacatgttttaatttctgaaataatgactttgaggaaaacagttagaaattataaaacatacaaattcctatttgtcacactatggagactttggagaatatgattctccaagtatcttggtgtttaaacaaataaaaatatagttcagccaaaaataaactagctcacatgaaaaagctgtagtattaaaaactgctacatcagaaagtcgaagtgagtattcagtaaatttattaacaagatatccctggattaatgattctatctcaagtcaaaaacattttgccaaagtgacagcactaacacctaccaccagtagtatgtagaatcagcttgaccttatttcagaacatctgagaggcactaaaagctggcaaaaccatcttaagagtatggagtgataggcagtaaactgcatttattctgggcttgaaccacatcaaggcagtttcagaaataaccttaaaaaagaggagccagagattaaatactatccccactccccataattaagatgcaatttgaaactttatctgaaatcattgagtcaatggaaagccgggaggaaaacaatgttaaatcaatatctgaaaagctgtttctactaaagatgtctatacacacacacatattatatatctatatatcatgtatttggactgattcaaggaatctgtgcttctcaaggcaacttcaagaactgttgatagtacagagaaatggatatcacagcttttttcttaaagaaaatataggttgaggtagggactggtaaaagaagagactgctttctttcattttttttcttttttaaaacaacttgtctacatcaccaggtatcagtaattgattcccactggacacaactacaggatacactccatgtttattccttgtgagaaataaacacagtaacaaattttcactagcatcattatgtagaacataaattcatgtttccttaattcagtaggtatttattagaaatctatgaggtaccaacatctatgtgaagtcctggttataatgcaaagaagccagtctagtgaatagacaaatgaatttattaaattaaaatacaatgatatatgtcatgagatgttcaagagctatgggggtacagtagagaaatatctgaggaggggtaaagaataggagaagtttccccggctgaatcttaaaagtaaggtattttaagatgctactataccattaccacttaacaagtaaggaaaaaaaaaattacaaaaaaaaaaaaaaaaaagaaaacagccatatgattacatgaaaattgaataccttctcctgaatgatttttaggtagacaatgaaattaaggcagaaatcaagaagttacttgaaactgctgagaacagagatacaaaataccggaatctatggaatccgactaaggcagtattaagagggaaatgtatagcactgaatgcccatatcacaagttagaaagatctcaagttaacttacaacttaacatcacaactaaaagaactaggaaaccaagagcaaacaaatcccaaagctagcagtagacaagaaataaccaaaatcagagctgaattgaaggagattgagataagaaaaatcattcaaaacataaatccaggagctggttttttgaaaaaaaaaattaataaaatacatagatcactagctagactaataaagaagaaaagagaatattcatataaacacaaaatattcaaataaacacaatcagaaatgataaggggcgattgcaactgaccccacagaaatataaccatcggaggatattatgaatacttccgtgcacataaactagaacatctagaagcaatggataaattcctcaacacagctaccctcccaagagtgaaccaggaagaaactggatctctaaacagacaatatcaagcttggaaattgagacagtaataaatagcttaccaaccaataatgtccaggaccagacgtattcacatctgaattctcccagatgtatgaagaagagctggtaccatttctactgaaactatttcaaaagttgatgagcaactcctccctaactcatcctgtgaggctagcatcaccctgataccaaaacctggcagagataaaacaaaaaaagaaaacctcaggtcactatgcttggtggacattgatacaaaagtcctcaacaaaatactggcaaaataaatccagcggcacatcaaaaagcttacccacccccatcaagtaggctttatccctgggctgcaaggtcggttcaacatatgcaaatcaataaatgtcattcatcacataagcagagctaaagacaaaaaccacatgattatctcaatagatgcagaaaaggcatttgatacaattcataccttcgtgtttaaaactcatagcaaactaggtattgaaggaacatacttcaaaatgagagtcttctatgacaaacccacagccaacatcatactgaatgagcaaaagctggaagcattccccttaaaaattggcacaaaacaaggatgccctctctcaccactcctattcaacatagtattggaagtactggccagggcaaataggccagagaaagaaataaagggcatccaaataggaagagaggaagtcagactatccctgtttgcagatgaaatgatccaatttctagaaaaccacatagtctcagccaaaagcttcttaagctgataaacaacttcagcagagtctcagaatacaacatgagtgtgcaaaaatcgctaggattcctatacatcaacagcagtcaatccaagagccaaatgaggaacatactcccattcacaatggccacaaaaagaataaaatacctaagaatacagctaactagggaagcaaaatatctctacaagaaaaactacaaaacactgcttaaagaaatcagaagtgacacaaatggaaaaacatttcatgctcatgaacaagaagaatcaatgtcattaaaaatggccatacttcccaaagcaatttatagattcagtgctattcctattaaacctccattgagattctttgtagaactaggaaaaaaaaaaaactatcttaaagttcatctggaaccaaaaaagagactgaatagccaaagcaattttaagcaaaaagagcaaagctggaggtatcccattacttgacttcaaactatattacagggctacaataatcaaaacagcatggtattagtacaaaaaaagacacatagcctaatggaacagaatagagaacccagatataaggccatatacctacaactatctgatgttcaacaaacctgacaaaagcaagcaatggggaaaggattcctattaaataaatagtgttgggataattggctagccgtatgcagaaggttgaaactggaccgtttccttacaccataaacaaaaatggattaaagactgtaatgtaaagcacaaaagtataaaacccctggaagacaacctaggcaataccatgcaggacaatggcacgggcaaagatttcatgatgaagacaccgaaagcgattgcaacaaaagcaaaaattgataaatgcgatctgattaaagagcttcagtacagcaaaagaagctatcaacagagtaaacagagaacctaaagaatgggagaaaatctttgcaaactttgcatccaacaaaggtctaatatctagtatctatacggaacttaaatttccaaagaaaaaaacaaaacaacctcattaaaaactgggcaaaggatataaacagatacttttcaaaagaagatatacatatggtcaacagtcatatgaaaaaaagctcaacatcactgattattagagaaatgcaaatcagaaccacaatgagatacccatctcagtcagaaaggttattattaaaaagtcaaaaaataacagatgttggtgaggttgtggagaaaagagaacacttatacactgttggtggcagtgtaaattgcttgaaccattgtggaagacagcgtggtgattccttgaagacctaacagcagaaataccattcaagccagcaatctcattgctgggtatatacccaaaggaatatattaataaaccattttattataaagacacatacgtatgttcattgcagcactattcacaacagcaaagacagggaatcaagctaaacgcctgtcactggataaagaaaatgtggtacatacacaccatggaatactatgcagccataaaaaagaacgagatcatatcctttgcagggacatggatggagctggaggccattatccttagcaaattaatgcaggaacagaaagcaacaaccacatgttctcccttataagtgggagctaaatgatgagaacacatggatacatacaggggaacaacacaaactctggggtctattggagggtgaaggtgggaggaaggaaaggatcaggaaaaataactaatggatactaggcttaatatctggttgatgaaataatctgtacaacagatccccatgacacaagtttacctatgtagcaaatatgcacatgtacccctgaacttaaaagttaaaaagataacacaatatcaaaattttatgcaatacctacaaatttaataaaagttgtacaaagaattactgacagaaatttcaagacctaagcaaacaaaagaatcatattcactgaccaagaataccacttttactgctgtgagtagaaaatattgtgctaagccaaaaaaaaaaaaataactgagcatttttctttaagctctataccagcatgtgctcacatcagaatatttattaaacagtcatccttctatgaccttgaatttctcttaattacaatttaggagtgcataaattgacttaagtgtagcttttggacagcattgaaagtttcagatacagatggatacagatggaactacaaggcagccctgtgagggataattagaaaaagtataatattaagagttaggcatttgtaaagcaggtaacctgtttgacagaaaaagaattaaggttatttacaacaaagactccggaaaggtaaaggaagataggagagagtaaagcccttagtgctgatctatgccaggtgtgcgagaccctagttaggtatcaaaatagcctgtacagttctgtttttgttgtaatttggttttgttttgttttaatacatttgtcctggtctaaagacttgcacaatttctgggagtggccttctgtatagcagttattcatacaggtctctgttggttctgttagagacaaagttgagttactgtggcctggctgtgcaaatactcttgttttccttttctaccaactttaaaaacaacactaaaataaaaacaaaatgtgtcatgtgaagcaactcatgtatgttgctatctcttggatccggaaatatactgacaaaattgaaatggaagaccagagacagaaaaaaacaaaaaagcaatttctcaccatgcatattatttgaaacaaaagaaatttaagttactgacatcttgtttgaacatcttgtttggagatttctaaaatcaagtaataataagtaacagtaaatggtactgtgcccattattatacttttaagctgtgttaaatgttaatgatattgtctttagcaatttttattgtttttagtgaaagaaaaatatattcacatcagagcatggttaccattcatattcttcctttaaagtcatatttttcatcataaattcttattaccttggtatatttgggactgctatggttggggctatttcagataacaaataattgcaaagaagtatttacttttcattgaaatattctttaattttgttttatgacaggattgaggtatgccctcaaacattatttcagtgattattgtagataagtattcgaatctttcatctgttggatatctggataaatcaaatggcctggccatggcaaaccacaaaatccagtttcgtagagctcatttgtttcaatgaaagattttaattaatcatattggttgcatcacaatgattttgaagttactttgatattaaataaaaaagaattcttatataagcaatggtaataaagtactaaagtattaataaagtattgagaatttgaaattgactagagaattcaaaaatgagaagagacaagtcaaggtaaattccctcatattcacatctacaccttatgggttacaaacatttgaattctgaaagataatgctggcacgactgtgatggtcaatgggtttatatcaaataaactatattgtagtttataaaatggttttctcttactatagccaattaaaatcttaaaaatagagtgtgtaatgtagtacagattttaagttgcctttatatggcttatgcttcttgttatatttgtgttttggggggaattcttggcaagagattaggtccacatctgattttatgaaatgaatcaacaatgacagtaaagtaataaagtcaacataatgatttaattgtctatgattcacataagtcacttaacaattatatttgtttagtggtatgtttatcataaagttaatatgtttccagattgttcaagttttatattgttatatttttcaaatttcattttatgaataatgataatttatattccctcaaacttccatgtattaccatagttgatcttttctgttcattctctgttttgaaagaaatctgactttttactttcaaacatctagttttcattatcttggagctaattcaatcgctgtgatacctggaaaaaattacattttttatcttttagtttgtaaggagacttttgaacctgaaacagaaactgaatatttttgagattcactagatggattggttttcttaatatgcatttggtatagtaataataacgtgttatctttcaggtataattttcaattcatatgaatatgaacaatttatattgaaatgctgtggcgtttttatttgtttagttcttagaaagggtagctgttctatgggtttacagagacaagatttttatacataattggagatactagatggaagtagtttggctaaaaaggaaaaaaaattctatttgattgaagatggagggctgagcatacatgatgacttcttatccttcctgacacctcacctcatagaggcatatacataaaggaatagatccatgcagcaaagaaaatcagagagacttactagcacttggtatgttttcaagaaattactaggagaaggaaaaatgggaatgagctaactgatggaacaagcagtgcagaggaggagatgggagggaactgatcagcctgcctgaaccttggagagtctctcttctgagaatctgcaaggatgaagatacagagctcaaaacaggagactcaattaaaggaccatatctgcaactgggacaattggctcacctacttcacttttacaacccagattagaaaccagtctgatttcagttcttctgagcaatgaaccatatgggaaagggtgacgtttctgttgtgcctcttggcatgccactactaagcctacattattctggcttgggttggggggtgcagttttcctaccagttcctgccttaagtgaaattcctgcctaaagtgaagcttgcccgtatccaaagctacccatgtgcacagagctcctagttaatgctaccaagtaggcaagaagataggtgcaacctgtttttattattatgcttgttcattgttttctgaagctgtcatttcaaatgcttgatttttccattatgttcttaccttcagtttattgttcattaagtatttgttccccattacacagatttttcaaaaattaaagcagactcttttctttttatttatttatttatttatttatttatttatttattattatactttaagttttagggtacatgtgcacattgtgcaggttagttacatacgtatacatgtgccatgctggtgtgctgcacccactaactcgtcatctagcattaggtatatctcccaatgctatccctcccccttccccccaccacacaacagtccccagagtgtgatgttccccttcttgtgtccatgtgatctcattgttcaattcccacctatgagtgagaatatgcggtgtttggtttttttgttcttgcgatagtttactgagaatgatgatttccaatttcatccatgtccctacaaaggacatgaactcatcattttttatggctgcatagtattccatggtgtatatgtgccacattttcttaatccagtctatcattgatggacatttgggttggttccaagtctttgctattgtgaataatgccacaataaacatacgtgtgcatgtgtctttatagcagcatgatttatagtcccttgggtatatacccagtaatgggatggctggatcacatggtatttctagttctagatccctgaggattcgccacactgacttccacaagggttgaactagttgacagtcccaccaacaatgtaaaagtgttcctatttctccacatcctctccagcacctgttgtttcctgactttttaatgattgccattctaagtggtgtgagaaggtggcaaatctcattgtggttttgatttgcatttgtctgatggccagtgatggtgagcattttttcatgtgtgttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggctgcctgttcactctgatggtagtttcttttgctgtgcagaagctctttagtttaattagatcccatttgtcaattttggcttttgttgccattgcttttggtgttttagacatgaagtccttgcctgtgcctatgtcctgaatggtattgcctaggttttcttctagggtttttatggttttaggtctaacatttaagtcctgaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagctatgtggcattatttctgagggctctgttctgttccattgatctatatctctgttttggtaccagtaccatgctgttttggttactgtagccttgtagtatagtttgaagtcaggtagtgtgatgcctccagctttgtccttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcatgatattgattcttcctacccatgagcatggaatgttcttccatttgtttgtatcctcttttatttcgttgagcagtggtttgtagttctccttgaagaggtccttcacatcccttgtaagttggattcctaggtattttattctctttgaagcaattgtgaatgggagttcactcatgatttggctctctgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgctagtgttcaaagtgaaagcttccagtttttgcccattcagtatgatattggctgtggatttgtcatagatagctcttattattttgaaatatgtcccatcaatacctaatttattgagagtttttagcatgaagcgttgttgaattttgtcaaaggccttttctgcatctgttgagataatcatgtggtttttgtctttggctctgtttatatgctggattacatttattgatttgtgtatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtgtctttgcccggctttggtatcagaatgatgctggcctcataaaatgagttagggaggattccctctttttctattgattggaatagtttcagaaggaatggtactagttcctccttgtacctctggtagaattcggctgtgaatccatctggtcctggactcttcttggttggtaagctattgattattgccacaatttcagatcctgttattggtcttttcagagattgaacttcttcctggtttattcttgggagagtatatgtgtcaaggactttatccatttcttctagattttctagtttatttgcatagaggtgtttgtagtattctctgatggtagtttgtatttctgtgggatcggtggtgatatcccctttatcattttttattgcgtctatttgattcttctctctttttttctttatcattcttgctagcggtctatcaattttgttgatcctttcaaaaaaccagttcctggattcattaattttttgaaggtttttttgtgtctgtatttccttcagttctgctctgatcttagttatttcttgccttctgctagcttttgaatgtgtttgcccttgcttttctagttcttttaattgtgatgttagggtgttaattttggatctttcctgctttctcttgtgggcatttagtgctataaatttccctctacacactgctttgaatgcgtcccagagattctggtatgttgtgtctttgttcttgttggtttcaaagaacatctttatttctgccttcatttcgttatgtacccagtagtcattcaggagcaggtggttcagtttccatgtagttgagtggttttgagtgagattcttaatcctgagttctagtttgattgcactgtggtctgagagatagtttgttataatttctgatcttttacatttgctgaggagatctttacttccaagtatgtggtcagttttggaataggtgtggtgtggtgctgacaaaaatgtatattctgttgatttggggtggagagttctgtagatgtctattaggtccgcttggtgcagagctgagttcaattcctgggtatccttgttgactttctgtctcgttgatctgtctaatattgacagtggggtgttaaagtctcccattattaatgtgtgggagtctaagtctctttgtaggtcactcaggacttgctttatgaatcttggtgctcctgtattgggtgcatatatatttaggatagttagctcttcttgttgaattgatccctttagcaggatgtaatggccttctttgtctcttttgatctttgttggtttaaagtctgttttatccaagactaggattgcaacccctgcctttttttgttttccatttgcttggtagatcttcctccatccttttattttgagcctatgtgtgtctctgcccgtgagatgggtttcctgaacacagcacactgatgggtcttgactctttatccaatttgccagtctgtgtcttttagttggagcatttagtccatttacatttaaagttaatagtgttatgtgtgaatttgatcctgtcattatgatgttagctggttattttgctcgttagttgatgcagtttcttcctagtcttgatggtcgttacattttggcatgattttgcagcggctggtactggttgttcctttccgtgtttagtgcttccttcaggagctcttttagggcaggcctggtggtgacaaaatctctcagcatttgcttgagcagactctattttcaagagaagtagttgagtcttaggagtctgcagaaactacttttacctctgaagacatttgctaatatgttgatgggatataatttaggaacaattagtgtttacattttatcattttagtttgaatttaataatagcataagctaacactgttatttaatagtgtacgtaaatgctaactgaatatatatgtattcagttacttattctttatatcttacaggcaaaaaagatacaacccatgagtgcttactttttcgggttgtaccttttttgcctgtaagccataaagagtattttattaaaacattaagaaatgttagtctcattaagtagaagagaagaacataattcttatttttaagccatttagtagtgggaattgaatgtagtgttcagaaacgttgcagttagatccactcttaatttttctcatttccttaaatttcatggatatgcatattgagctattttcgtattcaatctcagctaaataaagtagcgcaaatatgcatgactgaaattaccttctataaaaagttccaaaagcatttgaaaaatatcccacgggtgataagtctgtaatattttactttattaaaatgctgtacctggcttctgagtggttatctaagaagaagaaaagaatctacagtataatgagagttaaccatgttttgtccaaaatgattttgaatcaccgttcggacagatcttgaagactagtggaaacttcaaatggcagtatcgaacttctgttccttttggggttgttgagtatatgaagaatattatttttctgtgtctgacagtcggtagctttgacatgattatagtgaagtataatttagatgttagttttaactataatagactgtaactccttgtattttgggtgctgtagaaattacctttccctttgcatgtacgtgacagttaagatctgaagaatcttgattaatggttcttggatttatgtttaaagaaatcaaggatgggcatttttctcatctccgtctttggcatttgaaacagtatacaggttgagtattccttatccaaaatggttggaaccagaaatgtttcagattttggattttttcatattttgtaatgttttcatacacgtaatgagatatgttgggatgggacccaagtcttaacgtgaattcatttattttttatgtatatcataaacatataggttgaaggtaatttaatgtaatattttgaataattttgtgcattaaacaaagtttgcatacattgaatcatcagaaagcaaaggtatccctgtctcagccagccacgtggatactctgtggtgtttggcatcactgtcattcctgactctgaatttgtatgctactgataaacaactcttttattagacttactcacacatatgtacttaacagtgaaaaaaatgagttcagagtaactaagcagcataatagcatcaaacaatggcaggctttcatactttacctacagtgctgtttttgttaaaaggttactctactctgtattttattttttttaggtaagaagaaatattggaaacatttgagagatcaagaaatgggtcctctagggatgaggagaccttctgaataaactatgtcctgtgttcctgcattttgacagcaacccatcacataaggccacttacggaattttctacttgtagtgtcatgtcagtgctcaaaaactttcagatgttggagcatttcagatttcagattttcagattagggatgcacaacctttacaaagggcctttatagagattttaaatatataacttgttgtctactgagtaaaagatgggctgcttctgtttttctcctaacagtattttcagcttctgtactaaccagttccagatgttccacgataaagaaatatttaattttcatatgaaatttatgaaaggaaaatgcataggagggcattttagcaaaacaataagacaaaacagcttttgacagttggtttgctattaataagtacataggagtacacagtaaatggaaggctcatttagacccttagaatttttcttagcagggggccctttacctgaaatcatggtactagttttaaacttcatgttcttttttgtaaagacatttaaggcgatcagctcttttcaaaattaggttaatttttcagaaagaaataatatatcaaataaaaggaatattatggtgggttcagatgaattttaattgaaacataagcaacagaaaattttaagattcttatatgtggaccactttgtataatgtgcctacaaggtaaagattttgtggtcatctgaattttgggagaagtaattttccaagaattaatacttaagctttttgaatcacagttttgtatacccaatttcattatttggttctgtgcgatatagaatgttcaaggctaactataatcatttttgtccaatttgttttaaagagggttcagcagctccaggaatggtataatggtgaatgatgtttccatatcaatacagatctacaaatatgagtatatttgaagaaaagcaaattcatattgaatttaaaggcatataaattggatttcttttccattcatggacatctacttgtataaagaataaaaattacagtttgaatacatccaaaaccttttctcttaccgaatttcaatactcttttctaacaatgtcttagaattttgtagtatatctattcctcccctagataagatctgtagcacacttactctcttcctccctgttactatcctagaatgcttttgtattttaattttagattatttccttttaaaattatgcataaataattatttaaatttagcttcctactttttggacactactattggacaccaccacatctttttttctctggattgatttttttttgttttactggagttgatcatttaataattcttagattgtatctgaaggtattaaactagcctgtttttgcatgactgaaaatgtatatttattctcacttgattgctgattagacttgacatagagtcctatgtttaagtcattttatcttagatctttgaaaatactattctattgacttttctgatattgctaaaaagatttctgatatcaatataatttttgtaccactgtagatgaccctttttcatcccttcgtcctctttctttctctttggaagattttggaatttttatccttggggtttgatactacgctaggatgccatattattaatgctttgcctcatctgcctctccctgcacctctgcttttgtctgaaacccgaatctacctttagctaagggaaattttcttctttcatttctgtgattgctttttctactcagttccgttttattctttttttcagtagctactagaacttctagatctatcctccttttctcttactttatatttcctcattttgcaggggattctgaataatcttttgtctttgtcttctatctcaataattttatctttagctacgtcctttaatttttttttttttttttttcctgagagtctcgctttctcacccaggctgggatgcagtgatgcaatcttggctcactgcaacctctgcttcctgggttcaagtgattctcccacctcagcctccagagtacctgggattacaggtgcacgccaccatgcctggccaatttttgtatttttagtacagacaggatctcaccatgttggccaggctggtcttaaaggtcctttaatttttcattttcttttttaaggctttgtattgtcattattttgttagtcatgtttttaattttgtagcagtcttttccataattgtttttttttgtctgtgtgctatcttttcaaatctcactgagaattacaattatatttaacgttttcctctgtttcttttactctgctgagtgttatttcttcaatatgttaagtttggtgactttcttgctaatttttcctcaagtgtttggtgatttttggttgtttgttgtttgttgaatagttgagagcctaggctgaacagtcttggtggctggagggtatttatttcatcagcccaaatgagaatccctttttacttcttgtactatgtagattctcattacagaagccttcatccaataactgcagggcaaaagaagtgggtgtggctgggcagggtattcccggttgtagaagtttttcacctgggtttcggactacatttccataaattggctgctaccttgttctgtttctctaatctgggactctccatagtcagaaattgcatttgggagaatgtactcctgcttttgttatttattgaccatgagctttgagtttctctgagcctctatagcagactcacactttcttgttttagctgcaggtttctccaatgtgattttgcctttaaactaatcacatctcctctgatttgtgtttgtttacagagcttcttcaaaatttttggtctgcagtggtattattttcctgcactatcattctttcttctttttagtaatatattttatatggaatttgaggggaaaggaaagaggtaaatgtgtcctcattggccatccattcttttttaaagtaaaatggaaaaatacagattttgaaattaagagaactaagagatgatgaaaccatttcaatggagacttatcaacatattatgaagggaggaaaatgtgctgaatattgctgatgtttaatgaatttagaaaggacatttatttagcattagcctctgtcaccaatttattatttttccctgtggaaactaatgactttggagaaatttcttgggtaatgtttattgttagtcatcctgtttaagaacaacttgcttaaggtgatatttttatttcatggtagcaaatggattgttttgacatattcagtgtggacccatttaaagtaggcatgttattttcaaaagtgccatggcatgtcagtatcttgtaaattctaacttaaccaatattaaagaagtaaaccttcatgtactttaatggagatcacaaaaggacttcactgtcttgttctatgcaagatttagtaaaaacagagtattaggtgttatagtaatggtcatgcaaagcagtagctcatctgtacaagaaaattaatggtcttctaaaatggccagagatttgtttataacttcattttaattaattacatttttggaaaatgagttgaatttaagattagaccccaggcttgaatttgtcatattttttataatggtattttgaaacaaagtttgctaatagatgtttaaaagagagtaagaaaatatttacatagggtttatttgtggagtaagtattgtgtctttgtcattattcaaaaatagaaaaaagttgtgaagcaacatgttctctttgtgaatgttgaaaattactaacagatctgtgcgattggttttgtatgccttgtgaagacttgccaaatttgattttatttttctcttttacttttttctagtaaagccaagtcctacttgagagacatcagtagcctatggaaatttgttgcttttctttgaaaagtgcacctgcatccaaaactgagtaaaaacatatttcaggaagaaaactataactaattaaatttctcagtactacctaatttgccaatataactagttttggttaaaaagaagttgattataatgttcataactgtatattgaacagaaaaactggatgcaatcagaaatcataggtgtagtcaaggagatgaaaattgtagatgtgaccgttgctatttgcttttaaggtttcctaatcttgcctagcgtaatgactgagttttatgggtatttggaggattttcttgttccaggtggtggtcgtcctccttattttattttttggtaaggctaggagtaatgtagatgtgtattcttctcataacttagtaaaactcttttatcaaattggtcagtgcagcctgcagctggggacttctaaaaacatgttaccatgactagaaatttttatttcagtgcacttacttgacatctttctggttattattgaccaaaacacttgactcctgcctcttctttctttttatccattttgttgtccttattttgcatatttttgcatatgtacagatttctggcttcctcattcctatcaacaaccagaataacttttagtggtctaacttgtatcttcacttatcaacttaaactgttctttttgaaatgttaccagtgggttcagtgctcctgtctctgttctctgtctctggatctctcttcaacctttggttccactggccagccattcttaactgtttcggtttcagaaatattttttccctttagttttataataataattagctaatttttcttgagcacttactttgtatctttgactattctaagcactttacatgtcatatgatctttaacacaatccttagagatctaagtttgtattattttttccactttcagataaagaaggtaaggcacagagaggttaattactttgtttgaggccacactaataagtggtagaatcaggattcagacacaggcagtctgactaaagagctggtacttttcctctttagatgctatactattctgatgagtgtctcctctcatctttttctgtttggatctagttgtgtatattttcatttgccctacacttacctggttaggttaaaatttctacatccctcaaaactgctgaagtatcagttaaaaatatagttttcaacagaatagaagtttaatacatgttgtgaaccaatttcttcgtgttgccttttgaaattaaatttaaagagagcagtcattaatggctcaaagttagacctaagaggatttataggtgatgtgtatatgtgtttttgttttatccatcattcttcagtttcttaattaccaatactataccaagacaaatgcctgcatttcatcattaaccattaaaatatgattttcttagagttgaagattgaatttagggccagttttttcaagtacattaattatgtttaaatgtgtaagtctactcattataaaagtgaattattttgtaagtgttggttattaagtctgtgtattcccaagattttcagtctgaagtgagctgcagatacaatgcctaagcattttgtcctttgtattttgtaccagcaaaatgaaaatcattttttatagcctcattactcattcccaaaatgacctgaggtaccagttaggtccatttgcacaatatctggcaatatttctatgtcaaatatgttacaatctggtatttaaaatggccactgtaagtattatcaggcactattgttcctttttaaaaaacagtataaaatttgaaaacagtgctttggaaattatgtctttagtggctgtaatataaatggttaaccttacaaagggaaaacatgaaattgtttgaaattggtttatattggttgtcatgctaaacatattttttaatagtttgcttatttggtttgatattggttgtcatgatttaaaatgctatggttgtgtagaagttcttcacgaatatataagccgtttttacttacacatatattttagaaaatgaatagtttatatttttgctgttggaggactttttaaaaacatctatgaaacactaagatacgtctgaattggagctgaggactaagctctcatttatcttgcccaaattcctacataagggatctagagagtcatgccctacaaaccataaattctcatcagatgggttttatttgaccctatgtatcatgacttacttttcaatctgactctggcataacattacgagacaaggaaaaaatatttaaccccaaaatatatttccttgccataccttgaaattgccctgcaaagtctcttgtgggaaaaatccacatcttatagagaatcccctttcctctttgttttccttcctttctttccagatccaggcgataatcaactaagagccaggcacccttttaggtccgataagaaacattttacagcctgctctctctctgaagtctgctctctgagagattcctctgcccaataaaacttggtctccacaatcgtttttcttaacttgaacattcctttccattgatcccaggtcttgagataaactcgaccaattgtcaactagaaaatatttaaatttacctatagcctggaagctccccgcgcccctactttttgttctcctgcctttctgaaccaaaccagtgtatttcttaaatctatttgattgatatctcatgcctccctaaaaatatataaaaccaaaatgtaccccgaccaccttgggcacatgttctcaggacctcctgagggctgtgtcacaagccatggtcgctcatatttggctcagaataaatctcttcaaatgttttacggagtttgactcttttcgtcgacagagcaaaccgtacttcctgaaaagattaagagttagacagctagactttattcagagtgtgaacctatgtacctactatgtaaaatgcaagagctttagagcctttaactaaaggagtggcccctaaatcaagtcaaactcttctgtttcccaactacctcttgctgtataggagccatctggctctgctttctcaggtgtacattcttagaggaattttagtgattaaagtacaggccttggtgctgggggaagaaagagggttttcttctgcaggtttgttaaactgtaattcaggtcaaatttcgaatatacgtatgaaggcacaaaagtgtttaatattttagtttattccctttagtagttacaaaaattactgcttagtgaaaacttagcatcaggatatcccttcactaaaatctaggtctgtaatttgacaattcatttcacagcacctgacattactgttacattcactgtagcacttagcatgcaaagattatattttctacaactctcagtctcctctgttattggatgatgcgagcgcattaactacaaagtcacgtaaaggtcaagtcaaggcttaatttgaaaacagaagcctgagacccatccgtttacataacagacacagcactgtggtctcctgtgtgactgttaggtctgagcactgccccatattgctaatttctcacattgcttttcttaacattttttttctttaggagcttgatggagagatataccatttctgtcaggttttgcaaaatgtcttgagctccttgaaaaatagatgtcatgtaaatgcaaagtacggtcagttcttttagcctaagacattatttgatttttatagcaagtctattccatgtaaatgacatgcagtcatatagcttaccatgaatacgttcatgtcctaaaaatctcagatactgcctatattcagagtagctaacatttaattttgttttcatgtgttctttgaaaagagtagggaaaatgttttttatattattatggcttaatctctggatttggtcaccagtgaaatgaatttcatagcctcattctattacagacattttgtctgcttcgcaaaataacacaattttgcattattggtggtctgtgttcaagagacattacatctaaagagagctagaaattgcaatttaatactaagcaatgtgatgtgggaaaggaggccaactctccacatgctctttctgctagagcataatattctgcatattgacttttttttcactatccccaaaagtcaggatttttcattaagttctgataatactgttgaaattgaccttgattattcatgtaaagggcctctcagacaacctataggtatgagaatagctttcagaattgtaatcatatttaggttatatttaagcagtgatgttacacacttcccaaaaagtaatttattgggacatttacataactctgtgtacttaaatttatctacttattgcttatttaaaacattacatatgagagtttgtgttttccttactcaccattttccatacggctttattttcctcttagtttgaaaacttaaaaaaaattcaagttaacaagcatttattaaacatctgttgtattcaaggccctgggctacgtacatgtggaacataaaaaatgatgatgatgacagtgattgcaaacacttgcaataagtcctcatattgctgtcaagtaggtgctgttgttatgccatattacaaatgaagcagatgagccatagaatatttcataatttgctcaaggtcacacagccagtgatttgagaagactggcttaaaacacatgcagttcgacaccagagatgacactcttaaccactgtgctatactaaaatgaagacaagatcctacccttaagaacctttcatcctactagaaaagtggtaatacatattcagagaaaaaaacaaaaagaaaacagtaagtcagtatgtgttaggtgctgcattactggctcaaatatggaagacattggtgctcagaaagagatgtatttcttttgggaggtggggaaggcctcctggaagaagtgttttagctgacccttaaaaaagcggcaggattttgtcaagtgaagttaattagaggaagaccttctccttaagggggcaatgagaacaaaggcattgttttcaggaaaatgcagtgcccaaagttaatttgactatatgaaaaagaaaaatatttatacctatgcagacctttgaatgtaatgcatgttttcatttaaaattagaaatttatataatttttgaggtattatggatccaaattgtagattttttaaaggttaagctgttatatttttctttttaactaaaggggtatatttcaatggaaaggagttgcccaaactgaaatccgcagcgatgctaaggaataacatttatttcatatgaaaatattgtaaaatattttatggatattgttttttacatctaatcttaacattatctgtaagctgaactttgatgcagtagtagtaaacctactttctacaggaactacttctattacactctttaatttaaatctctttccataacctgtcaatatttaaagtacaacaaaagatagttgcactcagaataaaaatttgttttcacagagaattttagcccattatccctgatgaacatcgatgcaaaaatcctcaataaaacactggcaaactgaatccagcagcacatcaaaaagcttaaccaccatgatcaagtgggcttcatccctgggatgcaaggctggttcaacatacgcaaatcaatgaatgtaatccatcatataaacagaaccaaagacaaaaacgacaagattatctcaatagatgcagaaaaggcctttgacaaaattcaacagccgttcatgctaaacactctcaataaattaggtattgatgggatatatctcaaaataataagagctatttatgacagacccacagccaatatcatactgaatggacaaaaactggaagcattccctttgaaaagtggcacaagacaaggatgccctctctcaccactcctattcaacatagtattggaaattctggccagggcaatcagacaggagaaagaaataaagggtagtcaattaggaaaagaggaagtcaaatggtccctgtttgcagatgacatgattgtgtatttagaaaacctcattgtctccagcccaaaatctccttaagctgataagcaacttcagcaaagtctcaggacacaaaatcaatgtgcaaaaatcacaagcattcctatacaccaataacagacaaacagagagtgaaatcatgagtgaactcccattcacaatggcttcaaagagaataaaatacctaggaatccaatttacaagggatgtgaaggacctcttcaaggagaactacaaaccactgctcaacgaaataaaagaggacacaaacaaatggaagaacattctatgttcatggataggaagaatcaatatcatgaaaatggccatactgcccaaggtaatttacagattcaatgccatccccatcaagctaccactgactttcttcacagaattggaaaaaactactttaaagttcatatggaaccaaaaaagagcctgcattgccaagacaatcataagccaaaagaacaaagctggaggcatcacattacctgacttcagactatactacaaggctacagtaaccaaaacagcatggtactggtaccaaaacagagatatagctcaatggaacagaacagagtcctcagacataataccacacatctacaaccatctgatctttgacaaacctgagaaaaacaagcaatggggaaaggattccctatttaataaatggtgctgggaaaactggctagccatatgtagaaagctgaaactggatcccttccttacaccttatacaaaaattaattcgagatggattaaagacttacatgttagacctaaaaccataaaaaccctagaagaaaacctaggcaataccattcaggacataggcatgggcaaggacttcatgtctaaaacaccaaaagcaatggtaacaaaagccaaaattgacaaatgggatctaattaaactaaagagcttctgcacagcaaaagaaactaccattagaatgaacaggcaacctacagaatggaagaaaatgtttgcaatctacccatctgacaaagggctaatatccagaatctacaaagaacttaaacaaatttacaagaaaaaaatcaaacaactccatcaaaaagtgggtgaaggatatgaacagacacttctcaaaagaagacatttatgcagccaaaaaacacatgaaaaaatgctcatcatcactggccatcagacaaatgcaaatcaaaaccacaatgagataccatctcataccagttagaatggcaatcattaaaaagtcaggaaacaacaggtgctggagaggatgtggagaaataggaacacttttacactattggtgagactgtaaactagttcaaccattgtggaagacagtgtggcgattcctcaaggatctagaactagaaataccatttgacccagccatcccattactgggtatatacccaaaggaatataaatcatgctgctataaagacacacacatatgtttattgcggcactattcacaatagcaaagacttggaaccaacccaaatgcccatcagtgatagactggattaagaaaatgtgacacacatgcaccatggaatactgtgcagccataaaaaaggatgagtttatgtcctttgtacggacatggatgaagctggaaaccatcattctcaggaaactattgcaaggacagaaaaccaaacaccgcatattctcactcataggtgggaattgaacaatgagaacacttggacacagagagaggaacatcacaaaccggagcctgttgtggggtggggggaagggaaagggatagcattaggagatatacctaatgtaaatgacgagttaatgggtgcagcacaccaacatggcacgtgtatacatatgtaacaaacctgcatgttgtgcacatgtaccctagagcttaaagtataataataataatttaaaaagataaaaatgcttaaacagaaaaaaaattggtttttactgtcatgaatttttcccacgtttatgtttattaacaactgacacaaacaaaacctgtacagaaagtactctttattatacactttatttcaaagtactgaaatagtgttttatgatcatagtatttctagaggaaagattttctcccaagcctttaaggggaaagctaatccacttggagaaattttgggccacccaccaaacctgtgatttcctgccccaatttatgaaccaagttatactgagatcgttaaatggtgtgatttctccttatgactttcacattttactttataggttatattgacttttagatttcaggtagtaaaataaaaaatcttatgcagttcaagttagaaaaattggattagtccaagtgatattttcacctggtattttttttcaggcatttcaatgttactttttattacatttataaaattatatgttttaaattgtatggttttcccttatctttttgaaaaataccatactgattcatctcaaatattttagcctcttcttaagtttccctttcccctcaacttttccgtaagcgcacaaaagaaagtattgatttttgccaattattttggttgctgaggttgtaagccatcttggtttgcttacatgtaggttattaaagtacccttcctagtctgacttgccagtcttacttctctaccttttgttagaggaataagggatgaggatgagagaattaatatatattttttaccccatttctgcatattttaatcccatctccagaaaccaggttaatttcacctctgtcacaaatttgaaaggaagggaaaagatgtattaattgccatttttattgttattttctgactttcaagccttctaatctaaggttagtaaatggacagcatttaaaaaaatattcttgttatcttgacataatgaagaattatgtttttgagtattttgtccattgtttcttatttcctactttacatttttatttacagcaaggttttatccttttactaaagggaaggagatgggatgaatggcagactttaactggatgctttatttaggcttttcgaaagcaaaaaaagtttatacattgttacagctgggtgttgggttacaggctgtttgttatattcatgtattagttcctgttattttaacattttaaatatttcataattgaaaaaggaaaaattagactgggaccagtttatagaaagctttaacttctaggcaaaaaaggtagaactttacagttggttgtggagaagatattgactgtcttttgtagagagtagcatttcgaaaaactgaatttggcgtctgtatttagaacggtctagagaatggagatactgatgaaaaggaatgttagcaaattcagcattctgatttctgaaaaatgagtgcttagattaggtagtggcatggggactagaaagaacagggatgctgctgctttgtataatcattcccattatataaaggttatatataaattaggacggacacggtggctcacacctgtaatcccagcactttgggaggccgaggtggatggatcagctgaggtcaggagctcacgaccagcctgacgaacatggtgaaaccccatctctactgaatacagaagaattagttgggcttgatggtgcatacctgtaatccgaacactacttgggaggctgagacaggaaaataacttgtacctgggaggtggaggttgcagtcagccgagatcacaccattacactccagcatgggcaacgagcaaaactctgtctcaaaaaataataataaagattatatataaataaataaaatcacaccatttaacaatctcagtataacttggttcataaattggggcaggaaatcacaggtttggtgggtggcccaaaatttctccaagtggattagctttccccttaaaggcttgggagaaaatctttcctctagaaatatatgatcataaaacactatttcagtactttgaaataaagtgtatattaaagagtactctctgtacaggttttgtttatgtcagtttttaataaacataaacatggggaaaattcacatgatagtaaaaacaattttttttcctgtttaagcatttttatctttttaaatttttatatatttaatatataaaatatatataaaatataaatatatatttatatttatgattatataaaattcctatatctttatattatcatttccataaccattttagtaagcatccccaaatagaagttagggtgtattactaattctgcttaatatactttgtatacttttgtttcctatctcaaatctagtttctattatgtaagtataagtaccctccatgaattgggttaacattctaaaccatgaccagactgagagcatgacgactaatgtggtttttactcctaagctaccagtatggaagatcaacatttaagaaggcattagtcatctgtgctgctgaaaataatggtttcacattagtctggaccaattagaaggagcctatgtctacttggaagagtttgatttgcagcatagtccttggctgcttctacaagacttggcaaacttttgtttaagtcagaccctgcttaaatgtctaaaaggaaactcttaggccattatttccccctactttacataatattgctccatacaaacattccacttttacaaaatcatttactttttcccaactctgtgatacaaatgagttatcttttcgtaaccaccaacctctcagttttatatttgttagctcagatctgacatgaaagtaaaaattacttataaccactttgggattacacaaatttaacctgttcccatgttgtattcagtcctctgtgaaatacgagggtacttcaaaaaggtcaaggaaaaattgaattaaaatataaaaataaaagatgcaaattttatttctcaacataggctccattaaggtcgagacacttttctaagcgataataccagccatttagtccatccctcatttcttttggaattgaggaatttagccatgtcagtgcagtctttttgtaccttactaactgaaaaaaatgggtattctttatagatatttttaagatcaggaaataaaaagtcagaggaggcaaatcaggtttgtaagggggatgcttaatggcttcctattgaaactcttgtaaaattgctctgtgtgattagaggaatgagcaggagctttgtcgtagtggaggaggactctagtgaagctttcttaggtgtttttctgccaaagttttggctaatgctctcaaaacactttcataataagcagatgttatcattctttggcctcccagaaagtcagtaggcaaaatgacttgaacatcccagaacactgttgccatagcctttgctcgtgactggaccactttcatctcttggtagccattgttctgactgtgctttgtcttcaggatcatactggtaatgccatattacatatcctgttaccattcttggaagaaatgcttcggaatctttatcccactcatttaaattttcattgaaagctctgttcttgtctgcagttgatctgggtgttgtaagagttttggcatccatctagtggacagtttgctgaacttatttctcaatcacaatcgtgtaagctgaaccaattgagatgtctgtggtgttggctctggtttctgctcttaatttcggttctcttagggcatgaacaagattatttttttcctctcaaatggatgtggatggtctgtcactgtgggcttcatcttcaatgttgtctcgtcccttcttaaaacaagttatccatttggaaactgctcatttcttttgggcattgtctccatcaagtctttataaaacatcaatgatttcaccacatttcacccacaattcatcttaaatgtgatgcttgttcttgcttcacttttagaagaattcagtttgctctgataggggctatttttaaatgaatgtcctatccttcttagtgcctcaaactagatcctgttcagacatactgtaaaaagttagtatattttggtgcaaaagaattttgaaatccatgcatagttttttcataatatgcatttttcatgagctttttgaagaaccctccttgtaatgtatcttaattc

SEQ ID NO: 1264 - DNA, 4956 bp, Homo sapiens
agaaagaaaaccttccttttatccttccagaaattcccagttggaagactatataggaagttcatggtgctggatttcttcctgccttccatgctgttcccatcccccagttggttttagctcttcctgctgcctcaatatgtggctgtaatccagattctccagcctccattcacatgaattttcctatacctcatccgtgccccaccttcaactagagttttcctgtgcagggatatgtcctgatccgcaccactggtctttatctctcctgagtttgtcctgaacttccagctgttgaaccatagacaatggtttgactcaatagctctaaagccagccggtccatctgttcttaatcttacctctgttccactcaagatacctggagttcacttcaattccttggtctcctgtttcttccacacgctgtcagccaggcaagtcatcctttgtggtatctcttgcatccttcgagatgtctcttgcgtctatttcatctttttatatccagtactttcacccaagggcagatcttcatctgagcatttattcatgtcttcaaaaataattactgcatagctcttgagttccaagagctgtcagagatgccgatcagagtttgggtcactctagctgctgtaggggaataggctgtagaatggcaggagaggaggtgggggcactggctgggaggctggtatagttgcagctgtgagaggcaatgatgcctcttggtcaggtggttgccgtggagatggggagatgtgggcagacttgggctgtgagcgtaggctcctgaaagagtctcctgccattccatatccctcatgaagcctcccctgccactctggtgcctaagatcatcactctcctttgagtctgcagtgcctccattggccctttgcctgtgtaaccaaatatatcctttctctaagcagtgatttttgagctttttataaaagggacctcttgaaaacatgaagaaagtccacacaccttttccccagagaatgttccttcccatgaaagtttacaaacaactgcagggtgtttaaccatggggtccctgttccctaggctaaggactctattatctctgtcacccacaagccaacctctcacttctttccatcttcttctcttattgtatttcagtgggcacagaagatgctccagacatacatttccttgatggcaccctcattcctgataacttcctttggaaatgcatgacattcacttgtccatttttgtaaagtcatgcaaaatttggtttgaaatgttctaaaataacctaagaatgtggttggcttaatggttcaatttggagcacctctttgggccaagggattggagaggaggagctgtggtcagagttaggtctgctggcactgcagataaacaaatgttttcaatgtgaattgtgctgtataaaggtccaagggtctttccagaagaagttagcactaagttaaagcattttgaggctggagtgcatttagagaagactcattaatgttcatgtgatcatgttatgacaggtcaataccactttaaatcattccaaatggtctaacatgtggcttgaaaaataacagaggaaacagttgtaaggatgattgcatagtgctctattactgcgacttttgtttctaaagccaatgtgagggccacacaactgtgagacaaaggcgattactttggtattgaaagcacctttgcaggactgctatcagttagcagaaaatgtcctcctggcactagcattgtcttctgttaaagtgctttccacagagcattccttaactgcagtccacaacaattctggatttaaaactgagaactcaaaagaaagactattttttttgagagttctgtatatattctaggtgctaatccttttcagatagatagtttgcaaatattttctcccatccatagcttttttttcatcctcttcactgggtctttcagagagcaacagtttctgattttgatgaggcccaatttatacattttcccttttatggatcctgcttctggtgtccagtctaagacctctttgcctagctctagattctgaggatgtttttcctatgttttaatctcaaagcttcatagttttatgtttaagtccatgaccgattttgagtttaatacttgtgtaaggtgtgaagtttacctagagattcattttgttgcctatgaatgagagactaatttttagaacctcttatttgaatgtatttattgcgcttctttttttgtttttagtacagatggggtctcgctgtgttgcccaggctgggtgccaactcctggcctcaagtgatcctcctgaccaagcctcccaaagtgctgggattacaggtgtgagccactgggcaggactactgtgcttttgtgttttctcttccactagccctgagctgaagacgaacatcccagaatgttctgttttcttctgtctttcagtatctcagtatggaggggctccagatggatccaaataaggaactgcgaacgttcatattttaaacattaaactgtttcaccaagtttcttgatgaaaagatcaaatgcaggcaagattattaatcacaagatattttattctaaaatggtcttgtgtacaattacagagatccaccatgacaatcctgctctttctcactccactagccctgcaataaattggaaattcacacagaaacactgattcattgtgaaattcaaccgaaacattcagcagttctcatgactttttttgcacttataatagattttttcatatttatgttaatttgtaacgatctcatggacatgtaaagcttttagctctctacctgtgtgacattcagaaaataacctattttccatttaaagaggttagttgaaatattcagataggattatcctatctaatcctatctgaatatttcaactaacatattaatatttcaattaaaacatgaggtcttttcaagttttccaattatgcatatagaactggcaattgatatgtggtcttgtcaaaatagtgaaagaacaatcatgcagctgggccctgtgagggctgggataagccagcgtccagacaagttagacacaactattttcctctctcttctcccttgccctctaaccatgaggaattatagtgccttttgctataagtcaaaatgtcagttctcacaaaaggatttgaataactggtctcaggaatggtttgaggtactctagggttgataccagagtaagacttttaaaagtctctggaaagggtagcagcataacttaaatatatcaatttttattagagatgaccatttcttcttttaataatcacattgtcactatgcagatctgcatttttcatgaaaaacttcatttctgattctgaaggcgtttccccttcatttgcaagcatttcataaatgctgatgttcttaaactttgctttttgttcaaaactgttcatcgttaagtgactctttaatagctagttaataaaatactttcacccaacaaagaccagattgtgtagctggtaatttcagatttacacggaacaagcttcactaacagcgaatttttaatttgcaagtataaaactcccttgtgcatatttagaggaagagattcttagaataaaattggaatgcttccaattctctttattcttaggcacttcttcaaaattgtctcgcagagtaagagtatgatttttaaaattaactgtattcagggggctttttttttccagaacaagctagaacttctggggtataggcagaacaatagggccctaggtggtctcccagatcgggttccctggaaacactcagatggagatggatgtaggtggtctactgggaacaccacccagaaggaagagagggagggaagcagccctgggcagagggagaagctaagttatgatgcaattgcaagagagctatcagctaatcccaaagggagcaacagaagctgggagaacccttggagttgtccaggcaaggtgagggggctgggctttggtactatcacgtgactgtccttggatgcagctgccccagaagtggtgtaacctcgcctgtagtggctcccttagactggagcaattcctggggtgggatttagctgtgagtgtcagcactgtcatgtggggagccaggtgcttgagtgccttggtcctgaaaggggtatccaaggggcccaactcagcatctactgccagtgaattgggttgtgccccaaatgagcagtaaggggtctcttcttttgttcattcagtgaacatcagtggaacgtggttaaagaaagggatgaagacaaatggaggcagacggaagaaccactgcgggtcacagtgcaggagccgagcatgtgaaaggaaccactgccttcagtcggccagccgcagtcatgcccggagctttgaacacaatgttggcttttatttatttatttacatatatatatatttatatatatatatatatatatatatatatatatatatatatatatataaataattttgcgacagagtcttactctgtcactcaggctggagtgcagtggcacattattggctcactgcaacctccgcctcctgggttcaagcaattctcctgcctcagcctcctgagttgctgggattacaggcacccaaaacaatgcctggctcatttttgtatttttgtagagatggggtttcaccatattggtcaagctggtcttgaactcctgacctcaggtgatctgcctgccttggcctcccaaagtgctgggattgcaggtatgtatttttagtagagatggggtttcaccatgttggccaggctggtctcgaactcctgacctcaggtgatctgcctgcctcggcctcccaaagtgctgggattacaggcgtgagccaccatgcccagccaaaatgttggcttttgt

SEQ ID NO: 1265 - DNA, 8323 bp, Homo sapiens
agaaagaaaaccttccttttatccttccagaaattcccagttggaagactatataggaagttcatggtgctggatttcttcctgccttccatgctgttcccatcccccagttggttttagctcttcctgctgcctcaatatgtggctgtaatccagattctccagcctccattcacatgaattttcctatacctcatccgtgccccaccttcaactagagttttcctgtgcagggatatgtcctgatccgcaccactggtctttatctctcctgagtttgtcctgaacttccagctgttgaaccatagacaatggtttgactcaatagctctaaagccagccggtccatctgttcttaatcttacctctgttccactcaagatacctggagttcacttcaattccttggtctcctgtttcttccacacgctgtcagccaggcaagtcatcctttgtggtatctcttgcatccttcgagatgtctcttgcgtctatttcatctttttatatccagtactttcacccaagggcagatcttcatctgagcatttattcatgtcttcaaaaataattactgcatagctcttgagttccaagagctgtcagagatgccgatcagagtttgggtcactctagctgctgtaggggaataggctgtagaatggcaggagaggaggtgggggcactggctgggaggctggtatagttgcagctgtgagaggcaatgatgcctcttggtcaggtggttgccgtggagatggggagatgtgggcagacttgggctgtgagcgtaggctcctgaaagagtctcctgccattccatatccctcatgaagcctcccctgccactctggtgcctaagatcatcactctcctttgagtctgcagtgcctccattggccctttgcctgtgtaaccaaatatatcctttctctaagcagtgatttttgagctttttataaaagggacctcttgaaaacatgaagaaagtccacacaccttttccccagagaatgttccttcccatgaaagtttacaaacaactgcagggtgtttaaccatggggtccctgttccctaggctaaggactctattatctctgtcacccacaagccaacctctcacttctttccatcttcttctcttattgtatttcagtgggcacagaagatgctccagacatacatttccttgatggcaccctcattcctgataacttcctttggaaatgcatgacattcacttgtccatttttgtaaagtcatgcaaaatttggtttgaaatgttctaaaataacctaagaatgtggttggcttaatggttcaatttggagcacctctttgggccaagggattggagaggaggagctgtggtcagagttaggtctgctggcactgcagataaacaaatgttttcaatgtgaattgtgctgtataaaggtccaagggtctttccagaagaagttagcactaagttaaagcattttgaggctggagtgcatttagagaagactcattaatgttcatgtgatcatgttatgacaggtcaataccactttaaatcattccaaatggtctaacatgtggcttgaaaaataacagaggaaacagttgtaaggatgattgcatagtgctctattactgcgacttttgtttctaaagccaatgtgagggccacacaactgtgagacaaaggcgattactttggtattgaaagcacctttgcaggactgctatcagttagcagaaaatgtcctcctggcactagcattgtcttctgttaaagtgctttccacagagcattccttaactgcagtccacaacaattctggatttaaaactgagaactcaaaagaaagactattttttttgagagttctgtatatattctaggtgctaatccttttcagatagatagtttgcaaatattttctcccatccatagcttttttttcatcctcttcactgggtctttcagagagcaacagtttctgattttgatgaggcccaatttatacattttcccttttatggatcctgcttctggtgtccagtctaagacctctttgcctagctctagattctgaggatgtttttcctatgttttaatctcaaagcttcatagttttatgtttaagtccatgaccgattttgagtttaatacttgtgtaaggtgtgaagtttacctagagattcattttgttgcctatgaatgagagactaatttttagaacctcttatttgaatgtatttattgcgcttctttttttgtttttagtacagatggggtctcgctgtgttgcccaggctgggtgccaactcctggcctcaagtgatcctcctgaccaagcctcccaaagtgctgggattacaggtgtgagccactgggcaggactactgtgcttttgtgttttctcttccactagccctgagctgaagacgaacatcccagaatgttctgttttcttctgtctttcagtatctcagtatggaggggctccagatggatccaaataaggaactgcgaacgttcatattttaaacattaaactgtttcaccaagtttcttgatgaaaagatcaaatgcaggcaagattattaatcacaagatattttattctaaaatggtcttgtgtacaattacagagatccaccatgacaatcctgctctttctcactccactagccctgcaataaattggaaattcacacagaaacactgattcattgtgaaattcaaccgaaacattcagcagttctcatgactttttttgcacttataatagattttttcatatttatgttaatttgtaacgatctcatggacatgtaaagcttttagctctctacctgtgtgacattcagaaaataacctattttccatttaaagaggttagttgaaatattcagataggattatcctatctaatcctatctgaatatttcaactaacatattaatatttcaattaaaacatgaggtcttttcaagttttccaattatgcatatagaactggcaattgatatgtggtcttgtcaaaatagtgaaagaacaatcatgcagctgggccctgtgagggctgggataagccagcgtccagacaagttagacacaactattttcctctctcttctcccttgccctctaaccatgaggaattatagtgccttttgctataagtcaaaatgtcagttctcacaaaaggatttgaataactggtctcaggaatggtttgaggtactctagggttgataccagagtaagacttttaaaagtctctggaaagggtagcagcataacttaaatatatcaatttttattagagatgaccatttcttcttttaataatcacattgtcactatgcagatctgcatttttcatgaaaaacttcatttctgattctgaaggcgtttccccttcatttgcaagcatttcataaatgctgatgttcttaaactttgctttttgttcaaaactgttcatcgttaagtgactctttaatagctagttaataaaatactttcacccaacaaagaccagattgtgtagctggtaatttcagatttacacggaacaagcttcactaacagcgaatttttaatttgcaagtataaaactcccttgtgcatatttagaggaagagattcttagaataaaattggaatgcttccaattctctttattcttaggcacttcttcaaaattgtctcgcagagtaagagtatgatttttaaaattaactgtattcagggggctttttttttccagaacaagctagaacttctggggtataggcagaacaatagggccctaggtggtctcccagatcgggttccctggaaacactcagatggagatggatgtaggtggtctactgggaacaccacccagaaggaagagagggagggaagcagccctgggcagagggagaagctaagttatgatgcaattgcaagagagctatcagctaatcccaaagggagcaacagaagctgggagaacccttggagttgtccaggcaaggtgagggggctgggctttggtactatcacgtgactgtccttggatgcagctgccccagaagtggtgtaacctcgcctgtagtggctcccttagactggagcaattcctggggtgggatttagctgtgagtgtcagcactgtcatgtggggagccaggtgcttgagtgccttggtcctgaaaggggtatccaaggggcccaactcagcatctactgccagtgaattgggttgtgccccaaatgagcagtaaggggtctcttcttttgttcattcagtgaacatcagtggaacgtggttaaagaaagggatgaagacaaatggaggcagacggaagaaccactgcgggtcacagtgcaggagccgagcatgtgaaaggaaccactgccttcagtcggccagccgcagtcatgcccggagctttgaacacaatgttggcttttatttatttatttacatatatatatatttatatatatatatatatatatatatatatatatatatatatatatataaataattttgcgacagagtcttactctgtcactcaggctggagtgcagtggcacattattggctcactgcaacctccgcctcctgggttcaagcaattctcctgcctcagcctcctgagttgctgggattacaggcacccaaaacaatgcctggctcatttttgtatttttgtagagatggggtttcaccatattggtcaagctggtcttgaactcctgacctcaggtgatctgcctgccttggcctcccaaagtgctgggattgcaggtatgtatttttagtagagatggggtttcaccatgttggccaggctggtctcgaactcctgacctcaggtgatctgcctgcctcggcctcccaaagtgctgggattacaggcgtgagccaccatgcccagccaaaatgttggcttttgttaccattgcctacatcgtgccagatttgggtgctgtgattttatgtttaccattaccctctctcccttgctcgtaacttctaactcaagtagctcgtcttgcttgactgcacaggctatcccttttctctctcactgtgacctggcaccagggttcccagacacagtctgccagaccctcggagctgctcctcccacacagaagtttgcgagtctgtgtgctggtcagaacatccttgtaacatgaggagcacgactgtggctgtctgagctggagctgggtcactgcctctcaacagtcactgtggatcataacctctatcaatccactctgaagagctgatgcagactggagtcacagcaggatcatgatcttttttttttttttatattactttaagttctgggatacatgtgcagaacgtacaggtttgttacataggtatacatgtgccatggtggtttactgcacctatcaacccgtcatctaggttttaagccccgaatgcattaggtatttgtcctaatgctctctctccccttgccccccatcccctaacaggcccctgtgtgtgatgttcccctccctgtgcccatgtgttctcattgttcaactcccacttatgagtgagaacatgtggtgtttggttttctgttcctgtgttagtttgctgaggatgatagttttcagcttcattcatgtatctgcaaaagacatgaactcattctttcttatggctgcatagtattccatggtgtatatgtgccacattttctttatccagtctatcattgatgggcatttgggttggttccaagtctttgctattgtaaatagtgctgcagtaaacacacgtgtgcatgtgtctttacagaatgatttataatcctttgggtatataccagtaatgggattgctgggtcaaatggtatttctggttctaggtccttgaggaatcgccacactgtcttccacaatggttgaactaatttacactctcaccaacagtgtaaaagtgttcctatttctccacagccttgccagcttctgttgtttccacactttttaataatcaccattctaattggcgtgagatagtatctcattgtggttttgatttgcatttctctaatgaccagtgataatgagcttcttttcatatgtttgttggctgctgcataaatgtctttaagaatccactcttcagagctgattccgactggattttggtcagccatgaagtggtatctgactgcaacacactctacttcaaacatagtcatgttttaggatgaggccatcttcaagcctgagatccgtttctcatagaaagtgtttatgctgaaagcatatgggccctaagagttcacttctcctgcaggcttcaccatgaagacccccccagttattggcaagttcattccacctccgcttccaacccccctacacgacggaaggacgggcccaatgtgacactgtgtgaactctgatttcctttggtaacaaatacttctgttaaaatatatccagatgtcagcgctagatgataaatttgaacaaacacattttggttaaattagtatgattattttgactttccagtgtttacttggtttgttaagcatttttacttctctctaccattgaggaaagacaagtgggataatttattttgaggaaggaaaactcaaagctatcacgtatgtgaaaaaacatgtgaggtatctgagttgttgaaatcacgattgatcctaattgatacttacaagttatagaaaatgtggcaatggattgccaatcaatatttaaaaactgaaaacctgttggtagataacatggtttctctaggaaacaaacggctgcactcccaacagatttgtaaatatctcattgactcaaagcaaagaagtcaataaaaagaaaatgaaatcaaatttctaaaatttcatacaaatattttaccttatttttctcctttgttcctttcttttgttttttggctttcttgggttgtttttcctttttcttcttcttctttttgtttttttcttcttcctcttggtttgctatgatatcctcaataacctagtgaaaaccaaaataatcataccattttcatagatccctatcaagagaaggactgttttccctgtctgaaaggaagtttttgtgctggtcagtgtcatctctctgcctggccctggaccctgcaggccgaccccttctggggcatggtggggctcctgcctaccatctacccttagctggattcatgaacagggggcagcagcctcagtgtagatggagagagagtctcgacgtttctgagcccagttccttccctaattccacccactccagctcctggaggttccacaaactctaggggaggtcatagcttcctcaacgtctcagcaacagctggatgtgccagccctgcccacagctcgtcaaaatccagggggaggatgccactgcttcctgctaggctccaatggcaacagccactcttgcaataactttcattttcatgagttggtttctttcaccagtgatttaatttatatcccctacagtgacaaaagaccttttatcctcctaaattataaaatatttgttaaaaagtatccagttcacataggattagcactactggagaattattatagatttgttaaaaaaacatataattcagttcaatacaacagtgttcactgagcactcactcactgccatagagagctgtgaattccaggagatataaaggtgacaatgacaggacacgcttcctgtttggcccccagggctctgctcatgacttgtcatgtggccaagacaagctgcataagctctctgagactcagtttcctcagctctaaaagggagccagcatctccgtacatagcacttaggatccgccaggcatgcttctgagagcctcacagagacagactcctttgctgctacaccagacgcatgggggttgctgttgttgccctgttttatggatgagggaactgggacacatacagtgcagtatcccagccagggacacacagctagtgagtagctgagctgggattcagcacgtgcttaaccaggatgaatttcataatgtagggagaaaagaggcataatgtataagaacacatgtcaacttactccatcgtacaaaatgcacagagtgaaaccaacaatccatactccagtctcaggtacatacacatgtagtccaagtacaaaggaatgtaagggaatgacaaactccaaattaagtacagcagttgcctttgaagatggagcaattaaaaaattgggggtggggagacaagggctaatatcgttttatcctagtgtggagaaaggc

SEQ ID NO: 1266 - DNA, 17220 bp, Homo sapiens
ccacaaaaataaagcagcacaatggttgcagtaaatgacttgctattactacaccacaaaagtggagaaagctgccatagaagcaaggtgcacccagggtttgtgggaggcccatggttctggggtccaaagacaggcccagtgctgatttttgtgggtgggcctggtgtcagggtttgtgggaggcccatggtactgggtttcactggcctggtgctgagctccatggtgaagtcagatgttcacttctctgtccctttcttccaagataaaactcatgggtctaggagatctctcttggcactaggctgtgtgggctttggggtgacatgggtaaagtgaaactttcattcttactctcttcagtgcatctttttttttatgattctgtgctccacccaggtgctgcagcctctcacctgaatcccagagctcttgtgaagttactttcatctatggatggttattaaattggtgttttcagcttacagtgaaagatcttcagaacaccaattcagttgccttcagggttaaaccataatatcaacacaaaatggatcaagagccagtcatcctaaaaagaccacatgcatggcccctgatctagcaaaagtagtcacaaatgcagctgaatgtgtggaaacctctaagagaaaatgtgtgaatcacagaaagagtggctccagtcatggaacgtggagaaagctgccacagaagcaaaggctgcctatgctcatgccagcactgacagggagaactctccgccctctaccttgggtattctggctccaatgacagggctgtctctggaatgaaggtagaagcaggggccaaactaaatgaacttcaaataccctgatctaactagctactctaaaccactgtgagatggattggtggcaacttacacttccaattcatccaattcctttccctatgattccctcactcacaaaaacctgctcattaccattggcctcccttatagatctatgtacaggaacagttgggggctgtttggggaatgtgctttggctcttttgatagttcccattctatcagtggggcttgggtaatatgaatctgcaactgaccggggctggggagatgttactctcagatggttgggtttatcctatttatgaatccacaggcccaaaggttaaatggtggaccaattaaatttaccaaaggcaggcatgtttccccgtgaggtgtcctggcaacaggcggccctcctggacatgccacagcatgtcaggggctgcttttcatgactgaatccgctccaccgcacccctctgcaggctccttccccactcaccttgtcctttttctttcctgctttcactgggcgctccctttctctgtccacagctagctttaagtttttaagttcctgtctcatcaactcatcaacctaggagaatacaaaacatactacttttaagtcactttgcatgtcttgtgttttgtttgtgaagtttaaaaatcccttaaattatggggtaggtcattagtaggaaattgtaaagaagcacaatggttgaagtaaatgatttgctgttactacaccataaacgtagctgtacctgtatcctgatctctgactgtaattcttttcgtttctcctctttgatcagttctggatcatagtcctgagagaaattccaagactcatcttttttcatccagatttctacactccagaagggtaaagaaaaagaaaaagaaaaaattttaaaaagatataggttaatgaaattttaaaaagacgtaggttaattgtaagttattgcaatataaacataagcctaactttatatgttattgcataggataaaagtttgaataaaataagctggacagatgagattcatatatgtgcttgtaaatgcactaaaaaaagaaaaaaaactgctgatgtaaaaatattgagttttagtttactcaatattttttaagtgtgatacaatagtattctactgtattattataatcatgtaaaaacaatatgttaatgctgggattatacaatcacagatgaccttttttgtaatgttttatcttactttttttcttcaaatgattcactaaaatacgaaagattttgttgcctgttgaactctccaggaattatcccttgcctcctattacaaaacagacaacactaaacacacaagtacccagtatttctccctaattcaacagctaaatttctgaattactttttggatgtttttgaaatcacacatatttaaaatttcccttttgcctcttcctggtggttaggagggtggacctggagaaacatgaccctagacaaagtaagaataatttcccatcactaaaataaatggaaatagagctcctttctcagaagggaggttccaaatgtatgctgaggtgtggaatagctggatcctcgacgtgggacttggaagaggtctcccatgggaagccaagacttgtcatttggggaaggagacatctttctggaatctatgtcgagaatgtaaaggaaatttgctggaatttgtgaagctgacaaccgccacccagtctggccacttcactgggagctgcctttagggttctgatgaccttcaacctaggaaggcagctgaggacccagggcacagacagaggctcccaacctctaagggacaagggctgccccttgtgaagacagcagaggctgcaggcctccaaggcagggggtggtgaatgaatgagggaggcttctcagcatggcttccctgacaagcatggcatgacccactgaccgagaagggagagggtggtgctctaactctacattgggaggaaagtcatagtcacagacagaagcacaaatctggctgctggagacccagagccatcaaacgtgaagacctagcatagagacgtttccccagagaattacatgggcaaactaatgggaaggaggggttgagtctctgaacaaaccacagaggaccaggaactggcaaaagggatggacaaggaaaggggcagggataaggtgctgtgagacccgggaaaagctagactctcaggagaggtggggaaagcctggggagactctgaggcaaactcagaactggtgaataggcaggacaattgtcccgagggttttggccacctgccacctgcctggggcagcacagcttggtgcaagagccactgtttgtggccaggtggaacccctgccctaccacctaccagctggtgaccttagcaggggatagcctttgcagagaccattcccctttctgagaaatgaaaataaccccttcctcacgctgatatggtgatggtaaatggaataaaatatataaagttgtatgaataaattaatttttaataaatatttatatataaataaatatatacagttccagtttagccccaaatagttgctgccatcccccaggaagcagagcatctcacagggtcttagcctacctcattgacactctgtacccctcgaggggagaggataatgcaggacagcagctacaccagaaacagctatgccccaaagccccaaagcaggtgcatgccagcaaagaggaataagggccctggggccagtgcctgcgtctttagtggtcagagtcaggaccctcaggacaggacacctgcaggaagacaggacatggaaatgcagctccagttttcaaaaagagtgggttgggccaggcgcagtggctcatgcctgtaatcccagcactctgggaggccgaggtgggcagatcccgagatcaggagtttgagaccagcctgacgaacatgatgaaaccctgtctctattaaaagtacaaaaattagccaggtgtggtggcgtgcacctgaaatcccagctactcaggaggctgaggcaggagaattgcttgaatccaggaggtggaggttgcagtgagctgagactccagcctaggcgacagagcgagactgtctcaaaaagaaaaaaaaaaaaagtgggttgggttcacaagctgcagctgctgataccagaggtgagcacagaaggggcagaaggggttgtctgccacacacggcagaggcaggtccacctgccttcctggacagactacggcacggatggctcagcaggtgtctgagcggggtgggtggtgggggttccagcaggacccagcaagagctcttggctggcctacctcctaccagcaaaccgaagggcagggctgtgtgtgtattgctggctgagcaccatctctgccacagagatatggaggaccagcccgtggtggcgcaagggcagttgggcaggtttttgaaaatgatgcagaaaatgatgcaaatttctttcagaatggctaatgtgggcttacaaacagacagaaaataaatcacaaaggtggtaaatttttcataggaccaatgcacttaggcgtccttccccagacagggcagtctcataagaggtggcccagggattgggggcacagcgctgggggtgggaagggggctcagatgggactctgaaggtgactgcagaggtgaggccaaagttcaaggggtgtcttcattcacacggggcaggtggccagcccaaaacaggtgtgacgacaagaggggagaagaggcgaaaaaggctgatgggctggagtgggcctacaggaggcagctgggaagcctgggctgaacaactctctttacacataatcctttccagtgagagccagcccgagagccaaggtatagaaaacaagcattgcatacattgtctaaagcatcccattggtggaagagatacttcatgtcactaatatgtggaagttcgttctttgctctgcactcccttagattttgtggttagcttgtaggaggtatgtactccaaaggcccggagagtttacgactcctgcatttgaagtgaattgctcttttctagtaaattttctgaaatgtacataagcttaaactgtgaaaaacttcaaaatgtaggaataacacgtagtgataaaacataggaaaaggaatcaatgcttccttttatgtgtttaaaattgtaagcattctccttcgaaaattctagaaaaggtttaaatgtgtcataatgtgctgtttactaataataatcccccttgtaggatttctaaatcttctgcaatagcagcacctacctgttacatcagggcattttaaacaaaacagctttgttagtaacgggaagctacttttctttttcactagattcactaaaatcaggaaataatgtatttaataataaaaggaaggcagaatctttaacagaagggaaaccatgacacgattacttatgtagaaacagttgtacggtagaacacattctcattctggagttgcaattatatttaaaataaaacactgcagagccgttttgcccatttcccctctagatcgtttaaatggattgagttttccactgaaactttgcttttctcatgacacttttgcgcagggcacttttcaatcccttcaagaatttcatggacatttataaatgcaggaagctattcatggccctcaaagggcaacaactgccccactctctcctagagcggagaaagagcttttatcctaagaatgtgaaaagcgaggccaaggcagtttcacacgtgggggggcaatgaaagaggggcgggggggggttaatcttagtgattaaaatgctaatgttttatttgaagaggaaaacctttgatttttaagaaaagaattctaagaggaagacatttaattccttgaagttaccaaagacctggcagataacaagtccaatgccacaacatccaaccaggaaaatgacactacaggcttgcttctaggagggacgctgcttgctttttcagtcttaatggaaacagatattacacaaaaggcgtggacagttttcagagcttttgggccggtcagcaggttgcaagagttggcttcccatgggagcattagatttctctaatgcttaacgtttgcttgtatagaaataatacacattgttttaaacaaagtcagagtattaaacagattataataaaaaacctgtcccactctatctacctgctaattacattatccaatggcattctttcctatattcatttattcattaaaaatacataggtcaaattcagttattacattttgactttattgagccgattataggccaggcactgctctcagagcaggtggataatggaaggccctgccctcaaggacttggcattgcactgtgagaagcatccgtgaacacacactcacacccaagtggtaagtacagcgagcaaagggtgggcgcgggcagagggggactgtcactccacaagggccctcaaggaaggggcctcactggcactgaggcccaaagggacaagcattctgagccagaggaacagaaagcatgagtgccggaggtggagcgtgcccagcctgctggaggaagcgcagtggccacaggggcgtgtgtagcgatctggtttcgtggaagctctttcgggtggtttctgtgttcttttcctagtgtctatataacatgctcatatgctacttcttgatttatccatgtcagacatgagcccctgacttcctgccatgggacagcaggcttctgctctctggctcctttcttcctgtgccctcattgtctttacatagtcgtatcagaagagaagggagccctgctttccacatcctggggcacctactgtctgagtgtaagtgaaggacagctttcagatgcccagggcagccacaactcccctctgtgagtcccttcttgggacatcctagagaatgagctctaccaaaatgagggagaggcaagaagtcagcaaaggccaaggaaggctcaaggatcgcagctgagacggagggctccacaaaggtgctcttcggaagaaaacaaattagtaagttacctggcatgtttgaaggtgtgggagttatcttataggtacatgcagtaccaaaccagtgagggtggctgtaaaggccaaatgatgatatgcaaagcagagtcttagatgggatgttgttgcagacacatacctgatgccagtggaccctagccaggcccacggccccactgtgtggatgacagtaactcccagcaggacccactggatgttgttactgtcatccgaacttacagaaactactcagtttatgccactatctccaccccatcccaccactgtaatccccaacatataagctcattgttggcaggtgttacctttatatctctgggctagcactgcacctgacaccctggaaatgctgaatgtttgttgaaggaatatgcaagtgaaaaggtgtttttgatagtgactgctctgcaccattaaggagttgatggattcttaagcttggatgacagcggggcttctaccagtacctgcccatacgaggagagcaacatttacctcccccagttgttgtgaatattaaatgagatgggcatggaaaaactccaagccttgcacgtcttaggtacttaataaatgttagtttccccttttgacctcctttcttcccagtgaaaatggattgagttgccaaatcctgccagtgtcatcgtgtcccccagggttcccctttagttcagcatctcatgcagtggggtgcccttgccactagtggtatgtaagagaattttcagtggcacacagacatttttatcttatatcactagcatatcaaacctatgaccacattcatattgttgcttaggataaggtgcaattattaaggtgaaagccctgagtcaatttaaaaatacatctattaagttaataatatccagagaagaccaaggttgggaaggaggccacgaatgactgccatttggaaagattccacttcacatccggattgcaactttcagaaacttccacactagcactaatgactgaggtcaccttggcaggtcactgtgtttggatttatcttgagggcacagtagaaccacaggagttcggtaatagttctaggaaattaaaatgcaaatatctgaaagaccagttcctacacttgcggatccagccagatgacagctatgctcatcaggctgaacaactgacagaaaaatcgtgtgtcagaattgaggcacacatcttagtttaataggaataagacatttgactacacatacagtatcaattttcttaatttaagcaatctaaaaatatgtttcttccctgccactagcatgaaaacattcagctgaagtcttaggggttcaaaaacaggatggaggtcttgactatcttctcatcctatatgcatcttgccttttaaccaattgtatgcttaaggccaccaaaaggaatttttttttttttttgaggcagagtctcgctctgtcatccaggctggagtgcaatggcgtgatatcggctcactgcaagctccgcctcctgggttcaagtgattctcctgcttcagcctcccgagtagctgggattacaggctcccgctgttacgcccagctaattttttttatttttgaagagatggggtttcaccatgttggccaggctggtcttgaactcctgacctcatgtgatctgcccacctcggcctcccaaagtgctgggattacaggcgcaagccacctcgcctggccaggaaatttaaaatagagacaggcagaatgtctcggttgtgagtggcatacagcagcctcccgtgatggggttcccagcacgtgctgctgtcttggtgaccatgcacgttctcctaaactgacctttgtatgcgttacatccttccttcattgcaggaagaaaaagacttggtgacattttccatttttcgtcttcttcctgttcaaagcagaatattttcgttaatctcaggcaagaccgggcagcaaaagacgcagacgctgtgataaccgtgacgagggtccatgccgcgcaggcccagtcctggtccccctgggcagtgcccctctggcccgtctaagtatggagtgctgtgtccactgaccaggcatgggtggtccaggctcaccgaagcatcccctgctgataccggctttctcttctcagtggcctcccctggggtaccccatgccccgagtttgatcctgtcttcttttttgattaaaaaactttctttctttctttctttttttgagacggggcttaaacaatcctcctgcctcagcctccccagtagctgggactgcaggtgtgcaccaccacacctggctaatttttaaatttttctgtagaggtggggttttgccatgttgcccaggctggtcttgaactcctaagctcaggcaatctgtccccctcagcctcccacagtgttgggattataggcctgagccaccacacccggcctggtcctgtcttctcatgctctcactccttccttgctctaaaggctgagttcctagcctgagtccatctgcctccctcctccacgttgctgtaaccagcccttggagctactccgagtcctttgctgagctgtgctgcttgccagttctagcaccagggctgttccttcctctcgctacctgccccatccttgagcctggagctgcagcctgactctggggccctgcttccttcccggagccagagtctagctagcctccctaccctgggccccccacagcagagagagcctggccaccatccttggctcctgctgctgactctgtgcaccaagatgggagattgcggtgctacccgccgccagcccaggccatagctctgctctgagccccagcacaacaccccctctgcccctctgccgccagggttcacctgcgcctaatagtgagagctaggccctgcaaaccctcatgtgatgtttctctgcaataatgttgacactgcctcaatagtctggtttccgatgaccactatcatggctattgctacccttagagagggcgaaaggaacaacgctggcctccatttggtcctcgggttcccgaagcaggctcagtactctctatgcagtgacaggaggggcagcagttgggtggcgcgggcgtgcctcccctgggctgcttccagagcacgccctgactctggcacctgatgggctcttccgtttctgggctccagggttgggctccgggatgcggtggcctgaacacggtgcccccacagtccctcgtggttgtgtagtatccatgcatcagatccagaggtatttctcctctctctccccatggccaagcaatcaccaaaccccactgttctgccgtggaggctttcctggggtctccctgcttctgcctccagtcccactgccctggccccttgctccaaggttggctaacgcagggtcactctcttctctcctgctggaaggggtctgcagcagacctggccttacgacttccttccttggaagccccacagaggcatttgtcttggagctcctgggaggcaccgttccccacaggacacagtccaagcccctcagcagaccacacacaacccccacaggtgtggtccctcaggagtgcccccgcccacctctggggcctttgcccttgccgcctcctgcctctgccgtcactgcagagatgctgacaaggccaccctccctgcacctgccatgctctttgccctgctgtcctgtccgcttggaaggccacccttgtcctacactttctgatgaattcagagtctgaacagacctcccgtcctcctgaaatcctctctgatggccttcctgcccttttgacaggattgtcacttcctaagaacagcccgcttttcccaccagacacagcaggcaggaaggaccccgccagccctggggcctggccacttggcctgtgtgcgacatttgctggatgaaacaagaagagggaaagtataggctcaatccatggataaatgtgtaaatacaatgtggtatttccatacaatgaaatgttgaactcacccacagaaaggagcgaacacagacacgggctacggagcggaggaagcgtgaagacctaggctgagagcgtgaagtcagaaccaaaaggcctcacagtgtatgatcccgtttatatgaaaacagataaactcagggacagaaagcagatcagtggtgccagggggttggtgcggggaagagaggggggaaggggagggactgtttaatgggtacggggtctccttggggttgatgaaaatgtctccactgtcacgctacttcactgcatccctcgtgatttttgccagatctgagaatccctgaccagcagaaccatcatttctttaaagactcacttaaacttatgttctttaaagaggcactctctattgctgaggtgaaaccatagtggatacactggtttcccgatacacatgagaatacaacacaaccatcggaataaaagaggctgggtgtggagccattggactctccccagtgcgtgccccaggtggctgggaaagccagggcttcctggaatcctccccagctcagggctggcagcggctcttgctcccaagacagtgctgggttacaccctgagcaaaggcacacttggttgcctcagttactttctgaggcaactgtagctctgatcaagtcacctcctggctcaagtgtccccaggggcttcccacagccccctgagaccacgggttaccagctcactcagaggacacacctcctgcccctgctgactctcatctgtggtctattcccctgtgaatccaccacgtcttttttcagctttgcatttcagctttgcatttttcagctttgcattttgctttgagtccactgtgtctttcagctttgcatttgctcaggtcaccaggaagcaaggaagacgcaggaaatgggatcacaagagcttcaggggaggcccggggtgctcgggagaggactctcacttcatggggtgggggggcatggcaggcttgcctggaaccgcagcccataaaccatgcagggggagctgcagccagcggggaaccagggagagaacctggacccagaaacaccagggggcccaaagcctatgacacagctcacccaccttccagagcgcacactaaatcaaagctctctggtaagaaagtcccacctacgacacaaggcttgggttagctacgccccattcctggctcccaagagacccaggcattagagaaaagcctgcaagagcagcaagaaaaagactagtagtggataaagcaaggcctgggaggaaagagggagaattcatgaacgaaagagaaatttaaaatcactttaattagtatatttatcctcagatatattatttatcatctgtctgtctgtctgtctctctctttccaggtatcactaaggagtcatacatctttattactttttcgtcaatgttattgtctattattgccatttttgttttggatactcagattgttctatgtttggtctctgggagcccctacactggtgaggctgtgctcttagggatggatgaaggcaaggaagaggaggagggggagggggagggctccagggaaggagactgaggtgtgacaaagggtttccagcagaaggaacagcatgtgtgaagtccagatggggaggctgtgtctcacagggatggctgaaggaggttcggcagccgtgaggactgcgtggggctgggcagacagacatgaggctggagtggcgggagagagagagaggcagagagaagagggaggaaaagagagacagggggacagagatggagacacagagaaagaggatggctcttgaaaggaccaagagctgcagggagcttggagttggcttatgagcagggcagctacccaggagcctggtgtgaagggaatggccccttgggacatcactctggctggaactgggggttgaggggtggggaggaggctagtttgcatgcatatgtgatatccatctgttatagcagaatcatagtttatggcttaaaagttttgctggatgaataggtgtaacatggtatttaaaaaaaattatatttctttagttggtgtggctgaacttcattttatttgcttttcatttcctaactttgtggccttatcttgatttttacaaatgaaagtgcatgagcctacctatttacctgtgaacctttcctgagcagctactaagggtgggactcactagatactagaactgcacagggcctgcctctgagatccttgagtcctcctgcctccccgatcctcgctcgctgtgcctcggggccccgactgcaacacaccacagcccctcttcccccgatgccttttactaggtggttcccaggtccagggcttccctgtaactgtcacacacacgtttccccgaatagaaaccaggggtcgccttcccagatcccatcccaccactgtggctggccttgcacactctggcccacttcctgaggtgaggaaggctagccatgacccgagttctgatgctctcttcctctacacagggtgggtggcccactccactgtcagacaacttttttgacttaacccaatggagagttaaaaaaaaaaaaaaaaaagaaaaagaaaaagaaaagaaaagaaagaaaaaagaaaaaaaatccaatgccccagctctgccctagaccaattatgctcaattaagtgagaatttcttccaaggtgtgtggatattgggagtcgttttttcctaaaaccaccccaggcagctagactgaaggccatagattcattgaagttgtccttccatcagctgaggcccagttcctggagcctcagggagtctgcaccctcttcatgccctaagtctgctccagatgaagccttcctgactcctatccccatcgctcaaaagagatttccagattattcgccctcctggccatcttctgtggactgttctagctacccaggctcccagtcaagcaacggtgctggtttaatggtcatggtggagccacggccggtaacctccttggcctttgcggcatgtgaaggtggcctgcagttatgccactgtctggacattcccagcacaccatgggcctggagttaacaaagtcctcctatctttttaatgcatataccatgtagacagatatctcctgctttgaaattatatgaatggtttttaggtgtttattcgtaatgacttgaccggctcaggctgctataagaaaatagtatacactaagtgccttataaacaaaagaaatgcatttttcacagttccggaaactggcaagtcctagatcaaggtgcagattctgtgtctggtgggggctgctctctgcttcagagactgcaccttctagccatgtcttcactccgcggaaggggcaaagcagctctctggggtctctttcacaaaggcactaatctcaatcacaggggctctgccctcaggacctaatcaccctcagaggccccacctcctaacaccaccacattggtgattagctttcaatgtatgaattttttgtaggtgggtgaacacaaaaattcagaccatggcacccaacaaatgtaaatttcttacatttggcccacctaagtgacttcatgcttctggaggggagtgtttattcatgcctccgccattttccatctccattgctttccacacttgctggctgaacaaataatgaacaggtgggaggagaagtgcgttctcacctgcagaccgacctcagagttgagtcactgtagtatctgccttctctgcttggccacaccagcatgccatgatctgtggtttgttgcatccaactttcttgcctttttttgcaaactgagccatttccatggctccagttttctgggccttgctttctctggggctcctcaaatatcacagttagtagtactgagacttgacctgcccggtctctgggtaccgctaagatgctcaaccgcacagaaagcttcctttagagcagacagttgctttctcatcggcctctcactttctcttcatggcccaatcagttataaatcactcaggacaaagcagttgttaagtgaaaataaacttatggaggcctctcgatttgatttagacgatagtagtcctcctttctccaaggaggatacattccaagaccccagtgcacacctgaagcctcggatcgtaccaaccactacatacactatactttttcctatacagaaacaggcaggtagtgtatacagcatgaacatgctggacaaagggatgattcacgtccatggtgggatgggacaggatggtgtaagacttcattcacactgcgaagaatggtgcacaattcaaaactcaggaattttccatttaatacttatgggtcacacttgaccgtgggtaactggaactgcgaaaagtgaaactgagaataaggggggactagtgcatatttaaaaagctggtttatggaaactgaccatttttcgtaagtttccggctactgtgtgaactttgtcccttacacaacacagataaatgctacatggagaacgtttctaaagtttcttactgagagtcaatgggacatactgagagatgcagagatgcaaatgcaaatgtttccagaagaggctttgttatcaaaatatctttgtgaaattaggagggcagtcagagataaaccgtgcgccttcttcttgccctccccaaatgttaactactgctattatttcctgcctggcttaaagagcgattcaaatgcatggaggttttgttgaaaattttctattggtaaatatgtgcatctgaagtaggctgttgagggatggctaacatctcacactggtagggctgtggaaaaattcaaatagggctgcaactgttagattttttgaaatgaggttatatattttgaaatacatctgttctcagcggctttcagattacctgctcctcccctctgggtccgtatcctggggtgggggagaggtcgaccagcgattttgaagaggctgacgatttcccactgatctgagagtgaaataataatccccttctctagattcagaagtgaaaaccaacccagaaactataatggctgaacactatatttaaaaattaatatgcaccaaacaacgtgatagcttatgcaactaaacttgaaaaacagatcaaggatctccactattttttttttttttgagatggagtttcactctgttgcccaggctggagtgcagtagcacaatctcggctcactgcaagctctgcctcccgggttcatgccattctcctgcctcagcctcccaagtagctgggactacaggcgcccaccaccacgcctggctaattttttgtatatttagtagagatggggtttcaccatgttggccaggatggtctcaatctcttgacctcgtgatccgcctgcctcggcctcccaaagtgctgggattacaggcatgagccaccgcgcccagccacatctccactatttttgagcttgcatttagctcgtcattttactttctgctcatgcatttgcgacagcactagggaatcaacattcctcatggctttgagggctgcagagtgctactctttcccccacaaaagaaatacaagagataggagagaatctacagtgggaagtctaaaaatgtacagctgtgtcctaaatacatttgtcacaagtttctttgatggtatctgggttaatttttgtcggaaagagcttcttggttatgagtacggtagtaagaaataaaccacatttctcacatgggccatgcaagctgccagctggttactggctctccagtcctcagacttgggctggagtctacaccatgggccctcagctctctggcttttgaactctaccaccagctctcctggggccccctcttgtagacggcagatggtgggacttctcaggctccataaccaaaggaaccaataccttataatgaatgaatctttctctatataaatataaaagggcacagaagatatctatatatacacacacacacgggccacatgtactttttatatatcgctctcctattgattttgtttctctggagtgccctgactacactttcttctcaagccttctcctcacctctgctgcatcatttcccccctgtgatcctctctctctttaaagaacctcctcactgcctccatcatagccttagttttcactcctcattttttttttttcagtggaaaataacttttagtgagacctcagcagctgcaaaatctattcctggcattaagctccgtcttctactgcaattt

SEQ ID NO: 1267 - DNA, 1863 bp, Homo sapiens
aaatacagaatctcacaaatcccgattttaatgtaaagaagcaacaaatatagtctaccttcatttggcataggaaggagagaaaacgctcttctaaaaatggaagaaaagacacagaacagcttgtccctttccatccaattaaaaacctcgtgagactgaactagattaaaaacaaaactctccagcgaagccgcaggcgcctccaagatagggagtccaccaccaataaagtacggcagatgccagcagtctcgtccccgaacgcaccgtccgtcccagggaagtcgcagcggcggggaggccggtcctaggttggggctggggtggggtgtgcggggcctggggacgcggaagctgcggcgcgccgaggtgacacggcttccaggggcgacgggcgcgcagggtccccaggcgagcgaggctggggagcagggcacctcccaggcgccgcgcggacgagagccgcgactggcacggcctggcagccgcgtaggcccgggccgttaggggcaccgagggcggtgcccgacttccagtgcggcgagcgcggcccccggcctccctactggcgagaacccctcccccgccccggcactgacctgtccagggcccggctgggcctggccgggcggggcctacgcagcccctcggccgggcgccgactcgcgcggggtcccgggcccgggcgggccgcctcctctccgccgggagcctccgagccggggcccggggctgccgcggcgcatccgaccgcaccggcctggccggcgtcaacaaagggcggccggggcgcgaggccgggacgggggcgcgaggccggggcgggagcgcgggcggcggccggggttgcgcgcgcgcgcgcggcgggcgctcgagggctgcagccgccgcggagacaatgcggcgagtctgggacggctcccgcggccgcctccgccgggggcggggcgagggagcggggcggggaggggcggggccgcgggaggggcggggcggacacgggccgcgcgcttcctttgtgcggcgagccccgcctcgcgccctccggaaggcgggttagggacgcccggggctcagcttagggaggcgggcgccacgccacgaggaggctgccctgatagccggtgcaagtgctccttggcggggcggcccgcgactcccgccttggaccgttcactccctgaggggcctgggggtcagtcagaagactaacgaccaccagtcaccgagagctcagttcgtgccaaaccctgctcgcgctgtccccgacttattgttcacaacgaccctacaagtcattctccttcccactgggaaccgaggatcagagggaagtcatggcccgagtgccccggtcacacctccgtgagcggcctcgggctcgcggttgaggctgattgaggaagtgggttcaggcggcccgccgtgcctggcacacggtcagagtcccgtaagtgttggttatcttccccaagcgcaccgggtgaacctgcgctgtcgtggcgaagcatactcattcagcacgcgcgcgaggggctgcgggggtacagagacgtgcagcgtgacacagtccccaccctcaggagcgcgaggcgcaggaaggtgctggacacacgccaggcacttctctccattcttgacttccctctgttcccaacatggtcccattttcttgccttccttagtattcatattcgttgcctgcctttcttctccccccacccctttccactctcaggcctcatcccatcttctttgtttacatttattttacattccccgaatatttacttagctccctttctcctctatttttcaaattttcaaccccccttttcattaatattcatatttccttct

SEQ ID NO: 1268 - DNA, 1868 bp, Homo sapiens
cattcatttctgatacacgtatctggagaattctgttctgtgcaattccttttgttcctaactggccgaagttttgccattcagaggttttggcattcaaaactcaatgaaatctaatttcccaaaacccatcatctctcaccaaatatcccacagtgaactcccttttaaccaagggttcacacatcaacaggcagggacacacctgagtttgtgtgggaaacttctaaccaagggtcttgtcaattattcctgatcactgacccccctcttctggaccttggaaagataatcctagaaagaaatggctctatattctttgggggaggaagttagcaaggaaagagcaaattgttcacattttcagaaattttacatggaaatgtaaaaatattctaagacacatccaaaatatacttaaaaaaaaaaggggaaaagaagtagtccgtaccgggaaaggctccgccccctcctggatcacaaacccttcgataacatgcgtcaggatttggggtttcacaatggcctgtggtggtttattctcaccattctggggggcagtgccggcgatgctggaggcagagtttccgttccctgaggtcatgccggggctgctgaggtcggtcagtgcatgaacaatgccctgccctgtctctgcacgagagagagtaggaaaacaaagcaggggagatcagaaccagagtccacgcccagggagggacagcaaggactcaaactgcgcccggcttttaccgtggggccaagcgacaatgcaaaccaagcagtcccctcccctcagtgacccatttaaaagtggcacagtttcaatggacacatcaccaagtatgagtatagtcagttccacaacaacgcatgcagctaatcagctagcagtgtttcttcatttcccaaccgtgctatgaacagttaacccggataaacagacgggaattctatctttgaggagttaagaccttggtcgatactgatttgaacaaataaggttaatactcagtttgagggagaaaagtattcaaggtgacatctaaaaccaggacaagaagctgagctaggtatagggctttgagtgtgataaagagaagcttctacgaggttccttagaggagggattttaagagccctgtgaaatgtcaaaacactgaaccccagaaattgatgccaagggaatgtgggtgctgaaccccaagtaaaggctatcatgtatatttgactattcagagactggtcatctggggtcagtgcattgaaatatgcagaaattccatttctctgctaagaaggctgctaggcagaggctgagattttctctgctgtttctgctgagctgagtgctctcaaaatcagtcctcatgcccagatgtcagcttcttatctaatctgatcctcaccaaatcatagatcctctgtctctctgtggacaacctttcctaattctccttccccatgggcctgctagccttcctctaaaagacctaacagagtgctccagaaagtgagattacatgcctatacacaaccacacgacagtgaacttcctctcttccacttcaaacagcatctctcatgagctgtctcattgtcttagacgtgcaagacttcatctcctcacttctgtaactctctcccgcccccttcccagggctgttctctaccaccatcaactgccccgtgagctgaggctgcctttaacctggaacttcctaaaaaagaaaagaaaaagccatttctttattgcaacaagtccattaatataaagcataccccagtgaggtatgagtgatatatactttaaaagtgatttcagcacacttgttaagtaatctttgcataaaactttatatgaagat

SEQ ID NO: 1269 - DNA, 2063 bp, Homo sapiens
gcaaatgtcagttcatttaggggtttctggattacaaacacttgagcaaaaaatgttgattaccactgttgcggagacagggcatgagtactcagtggggtcccatatggtacttctattagcaaattggtaaaaggcaaataaaacatgctatataatttacaggtggcaaagttaagcagaggtgttagtataatgaatagcagaattcagatagaaaagattcctgccccaccacttgtttttttctatgcctcagtggtcttacctttaaaatgaggatgataaaagttgctacctcagagggttattgtcaggattaaatgaggaaatatgtgtagtctagcagagagggctcagtaaatattaactattaatcattactgttttcttgctaggctggaactatgggctgaatttacaaggtaacacttaacagatgtaagcaattatattttggttcaaactataaattatacaagtttgagactagggagagctggcatgacagcagttccaggtaagacgaaacctcagaaacaaaaatgaaacccagctctctggaattcaggtgacagtgctctgtgaacaacagtgtcattcctatagggtgggagagttcacgggggccattcgtgcaccatcctgatgaaggaaggtgagcgagtgactaccgtaggagtcagagtcatggcgctgccctttcagagccgcgggacctggagcccctcagcctttgtttctgcctctgaataatggggcgattctacttatgtcctagggctgtcgtgagtgagtaaaggacttggaacagtactcagcatatactaagtgttcaacaaattttggttcctccctaccgtaaaacatggatctagggaacagccctgcccctgaaacaggcctctaaagactagtagctgtttatatttggaattaatgtgctcaattttggggaccaaacgttaggaaaattaatgaaaaggtagaatgtagatagacaagcctgaccagaatggtgagaatggaggtcttgatctgtcataggtaaaaaatgaaaaaaagtctcagatgtttagcctggagattttctcttttttaatggggggagaggcaagagacagtccgacaactgtctacaaacactgtataagatggactcttataattcacaagacagaatcatgaccaatgctggcaaattccaagagagcaggttttgacttcatttgaaaagcaactttctgataattagagcaaatctacagtggaatggactgctgttcaaaaccccttctcatctgcaagtgtgcaaagagagaagagatgacctccttcccatcctttaattttcctgctgtcctttctccatattctcttccttgatcctgcttctgttccctatagaaccttcgtactctttttgccctgccttgtgctaaggtatttttttcttatttctccatcaatttctaaactctttttctctttcctgttccccgcccctaccccctcagcaaacacagcacaatgactggaactgcctccctgagttgcaggtggtccatggctcagaatgtcactgagatctgggccaacagtgctgtgcaaactggcagagaggggaagggaagcaaatagatctttgcagaaggcggaggtactgctgtgcctctcccatccgggtgaagggacccagcagagtctcctgaaccccaggcagggagaagtccacttgtaactgagcccgcacagatggacagatggggatcccagagctgagcagttttcctcagagatgcttcctgtgagctgaactcatctgagtccccttctgcctccccctggcatttcccttatttttgagatgtggtagccgttttgccatatttccaatatcaagaaccccctttcataccaaaggaagcagagaactgtgacaactggccacctgcctccactctccacttggcatatgtctatgtggatgcatctgacaccagtgacatgcaggtaggccccagtgtctggctctagaactttcacctcttctgtctccaccc

SEQ ID NO: 1270 - DNA, 4584 bp, Homo sapiens
tgctcatatttcatgttaaagatccataataccaccacagaataggaattctttgtgcttaattatatagtatggaaaagtcaaaacagacacgtttgagaaaaggtggtttagggccaggcatggcggctcacacctgtaatctcagcactttggaagaccgaggcgggtggatcaccaggtcaagagttgaagaccagcctggccaacatggtgaaaccctgtctctactaagaatacaaaaattatccaggcatggtggtgcgtgcctgtaatcccagctactcaggaggctgaggcaggagaactgcttgaacccagggggtggaggctgcagtgagctgagatctcgccacccccctccagcctgggcgacagagcaagactctatcttggggggggagggggggaaagaaaagatggtttatgactagttcataatgggtcttggtccactcaagctcatgtttttgttgttgttgttgttgttgtttttttttttagatggagtctcactctgtcacccaggctggaacgcagtggtgcgacctatgctcactgcaacctctgcctctcaggttcaagcgattctcctgccttggcctcctgagtagctgggattacaggcacgtaccaccatacccggctaatttttgtatttttagtagggactgggtttcaccatgttggccaggctggtctcgaactcctgatctcaggtggtccacctgcctcagcctcgcaaagtgctgggattacaggcatgagccaccgcgcccagcctcaagctcatgttcttactggtggttctaatgctaactaaaccaggataaacctttaatgaacaagagttgactatgactcatgtctttagtactcagtcctccataattcagctacataataaacttctgagctgagcaggggccatctaagagaaaggaccaatgaagttttttttgtttgtttgagacacagttataccagtaagttagaaagtttccattaagtgcctatattcacttgaaaaaaaatttttaaacagctttggcttttctgtagagatggaaacatttcctttcttttagaattagtctttccaattgcaaaggtgtctgagaacttgagagcttgtctggaggttctagcaggggagggcagctactcgtatgcccttgactgagggacggccctcctctacgggatggtcgtcctctttgacccagctgctggttcaggagggacgcacatggagcagtgaaggaggaaggggacacctgcgtagccagccagatcagcggaatcaactctgccgatcaatggggtgacaggtgttgcagccagatggccctcacatccatgtttgagaacgtagaaaaaacccctttccctcacaatctatgaataactaggaggactgagttgatgattcaatcaaattaagtttctgtgcttttaaattttaaatatttaactctgcctttacacaattacattttctctgcttttatgttttgcatatgctaagaaacatctattttatttaaaatgaattactaacatagattactatgaaagctaaaattttgttttttagatgatggctatttcctcccaattagagcctggtaaaaaatattccctgatgagtctaatgaactgcagattatacaattataggattggaaagtctggttcgatctcttgccaatgcttgaaaattttctataatatgcccacccaatgattttctggcatttgtttgaatacctccagcgacaaagaaactcactactctggaagcagtttgttcccaccttggacggctcattagtgattccttatataacgagcccaaaatctgtctttctattaatttctgcccagttatcctcgttctgttccttaaactcacagagaacaaggccaatcagatttgtctaacaggcagagacacgggcttagacctggcttagagactggtctctatcattgagtcaactgcgggcaagtcattgtccctctctaagcctcagcttcactggctgtgaaataaggatcctacgcctaccttagagtgctgctgtgaggactaatgagccagtgaaaggcagtgcgtgctagcttacgagaaaatgcttgagaatgctcctggtgtcatgaaggatgtcactcatgaccacagtcttctctcctccaggacaaagcccttctgttctttcaggtatttcttacataaaaaggctacaaattcgtaatcatcctaggccctctctgcccacatcttttaacatcaggtacctagttaatactaagcatcatctgtcaggtgtagtcatgtaagagatctggttggtaagatttttggttttctgtgtttgctttaaagacagtcacatctctgactgagagcataggtagaaagtattaattcccttgtttcagtttaatgaattcttccatggaattaatccattctcctcttaattctgggatcactcccacctcctgcctctttcgctgatagtcatcagaaaacagcccccctctgaccttgtcttttgtgggatccctctatccttgcttgacttccctgcctccatcccccactcctgtctcagatctatgcctattaatgttcactgcaagacagaagatcactcttgaggtcagagtctgtcttcatgccagatacattcgtgagcagatatggtcaccagctcaaaggctacagagccaatgcttaactctgggaagcaaaactttttggaatttgaggttgttttttaaaaaagatcttgttaagagagagaacacactaaaaaactcttgcaccacattagaaactaccactccccattgtaacccagggcagatcaaaggagagacagaatccaagggacagatgggagagtgttttatgaatatacaaaggttcacagctacttcgctttgcagtcatcttgtagaccaatagctcctcatctgctttagtaacaaaggagtttgggctattcctggaatgaccgaacacaatctcgccccctgccaagctcagcacactgagattaatttaatctgcttcccgctctcccagactgctttgcggcctttggggaaaagcagcttaacagtgaaacttgcagaaacctgccctgctggccctgaggccagataaaagagacaaagaaatactctgaatttggttccttactcaattcccttgaccagttcagaggctataagtgctgccgggcattcccacaggtctcaaatgcctgtatacagtcaggcacctgaaaccgaaaggtggaggcaggataaggccgatgggagaggctgggggaggggagtaaagctaggcttcggtgggggaagggggaggtaaaatcttggcctttagttgacgctgaccacaaagggccaagtattccggtcagaatgaacagagcagcatgttccacggagtcttgcctaacatatgtctcaacttctaggctgtttctcatttctggtctcattcacaggctctggtacaaacagcccttacaggggtgggagaaaacaggaaggactactcagctcctgtttgtgaaattatctgctttgggactggtcacgtctcctaagcagagcagacttctctaggcagggggctaccactcactcagtcacctcgagatcttcaggggctaaccccatgtccaaaatatgacaggtgcttaatgaccactaaactggaatgtgtggcatccatgatctcagtcttcactgtctacatatagaatacagggctgcctagtgccaagataagcaatttggcactagctgagatttacaagttgctttctgaagctatgatgttttgagagcagctaggctggtggtacctgcctaccggagcggcatttctagatacctgattatgaagaataagagctattttttggcccatgtcttcctgttacagtggggatttcctcaacagaaaagaggtacaggtggacctctgaattccctgtcccctttgaaacatttttgccagacccaggcacttggcaaggcaggatgacctctagaggcagaggcagggaggctcctaggaccagtgggttgatgtccagagctgacgggctctccagcctgctgaggacagacgtcaggctggtgccagttatgcacaattgggccacttcagagccagtgctgatgttttgttttgttatactggaatacagcttagtacaggttaagtatcccttatccaaaatgcctgggaccagaagtgtttttaattttggattttttcaggttttagaatatttgcattatacttactggttgagcatcccaaatccaaaaatctgaaacgctccaatgagcatttcctttgagtatcacgtaggtgctcaaaaagtttgggattttggagcattttggatctgggatgctcaatctgtactaacatctgcaacaggtatttcagatggcctagcactcattctatctgaccctaagatagcctgaagacatggcttcaaaggcaatggagaccaaacggagcttttccttctaccccctcac

SEQ ID NO: 1271 - DNA, 6985 bp, Homo sapiens
caaatttatgaactagtcttaagataaatgggaaaattgtatttcaaaagtgagacagtgataaagctaaggacaagaaaaaaatgttaactttgtatcctgtaaccttgctgtaattgcttattatagttccaggagtttttcggtcaattctttttggattgtctacatagatgatcatgtcatctgcaaacaaagacagttttatttcctcctttccaacctgtatacttttttttcccaatcttattgtgttagctaggatttccagtacaatgttgaaaagcagtggtaggaggggacatccttgccttgttcctgatcttagtgggaaagctttattgttttttaccattaagtatgatgttagttgtagattttttaaaaatcaaggtgagaaatttcctgtctattcctagtttgcagagagtttttgtatttaaaatcattaatgggtgttagattttgtcaaatgccttttccacattcattgatatgtggaaaaatcatatgatttttcttctttagcctgttaatgtgatggattacattaactgattttcaaatgttgaatcagctttacatagctgggacaaatcccacttggttgtgatgtgtaattctttttatatattcttgaattcaatttgctaatactttcgttgagaattttcacatctatgttcatgagagatattggtctgtagttttcttgtaatgtctttgtctggttttggtattagagtaatgctggtctcataaaatgagttagtaagtctttcacttgcttctatcttctgaaagacattatagataattgtgtaatattttccttaaatttttggtagaattcagtgaacctatctgtgcctggtgctatatgttttggaatgttgttaattgttgattgaatttctttgatagatataggcccattaagactgcctatttatcttatgtaagctttggaagattgtgtctttcaaggagttcgtccattttatctaggttgtcaaataggtgagcatagattgttcatcatgctccttgattatccttttaatgtctgtgagatccgtagtgatgatgtcccctctttcatttctgatattagtaattcgtgtccttctgttttttcttagttaacctggcttgaggcttattgattttattgatctaaagaaaacctatcagctttcggtttaatgattttctccattgtttttctatttttaattttattgatttctgcactggtttttattatttcatttttttctgcttactttgaatttaatttgctgtgctttttctagtttcctagagtgaaagcctagatgattgactgaaggtcttctttttttctttttttttttttttttgagatggagtttcgctctttttgcccaggctggagtgcaatggcgtgatctcggctcactgcaacctctgcctcctgggttcaagtgattctcctgcctcagcctccagagtagctgggattacaggcatgcaccaccacactcggctaattttgtatttttagtagagacagggtttctccatgttggtcaggctggtctcgaactcccgacctccggtgatccacccgcctcggcctccgaaagtgctgggattacaggcgtgagccaccgcgcctgggcctaggtctttctttttttctaatgtatgcattttatatatatttccatctaattattgcttttgctgcatcccccaaattttgaaacattgtattttcattgagttcaaaatagttttaaatttctcttgcaagttattctttgacctatgtattatttagaacttcgttgtttaatttccaagtattttggaattttccagctatctttcttttttcttttttaaaaaattgagatgaggtttcaccatgtttcccaggctggtctcggactcctgaacgcaggccatccacctgatttcagccttacaaagtgctgggattacaggtgtgagccaccacgcctggcaggaattttccagctatctttctgtttctgatttctagttgtaactccactgtggtctgaaagcagacactgtatgatttctattcatttacatctgtgaaggtatgttttagggtccagaatatggccaatttggtaagtgtttcctgttagcttgagaagaatgtatggtgttgaatgaagtaatttataaatgtcaattatatccagttgattgatggtgctattgagttcagctatttccttactgattttctgcaggctgtatctgcccattctgattgaggagtgttaatgttttcaattttaatactggattaatcttttgccttgaagttctatctgtttttgcttcacatattttgatactctgttgttaggcacacacacattaagcattggtatgttttcttggagtattgatcccttaaccatttggtaatgcttctctttattcttgacaactgtctttgctctgaaattaatgtagctactcttctttctttcgattattattagcatggtatatctttctttatctctttcaatctgtatgtgcctttatatttaaagtgggtttcttttaaacaacatatagccaggttttgtttttttagatcattctggcaatctgtcttttcattgatgtatttagatcattgatttattttttatttatttatttttttgagacggagttttgctcttgttgcctaggctggagtgcaatggcgcgatctcggctcaccgcaacctctgcctcctaggttcaagcgattctctagcctcagcctcctgagtagctgggattacaggcatgtgccaccatgcctggctaattttttgtatttttagtagagacggggtttcttcatggtggtcaggcgtgtctctaactcccaacctcaggtgatctgccctccttggcctcccaaagtgctgggattacaggtgtgagccattgcgcccagccagatcattgatgtttaaagaaattattggtatttggattaatatctaccttatttaatactgttttttatttgttgctcttattctttgtttctatttttgccttccacactttttcaaccttttatattttttattgagcaatctgtatgattgtatttttctgtcctttcttagcacatcagttctacttctttttaaacatttttcagtgattgtcttagagtttgtaatattcatttataactaatctaagtacactttcaaataacactatacggcttcaggtagtacaagtactatataataacaaaatatttctactctctcatcttttgtatcattgctgtgatttattttacttacatgcttatatatatgtgtgtgtgtgtgtgtgtgtgtctgtgtgtaattaaatgcattgttgctaatatccttttaaacagtcatctgttagatcaattacgaataaaaaaataaaagtttttattttaccctttacgtattcattctcaaatgctcttcctttctttatataaatccaagtttctgagctatatcattttcattctctttgaagaacttttaaaaatattacttgcaggtcaggcttactgacaacaaattctctcaatttttgcctgtctgaggaagtatttctctttcacttctgaacgttaatttcacagggtgtggaattctaggttgatgagtttttttctatcaacactttaaattttttcttccactctcttcttgcttgcattgtttttgagaaatcatgtgtaatttttatctttacttctgtgttcataaggtgtttaatgatttatttttaatttaatttaatttaattttttaagagatagtgtctccctatattgcccaggcttgtctggaactcctggcctcaagcaattctaccacctcagcctcccaaagtgttcagattacaggcatgagccatgagccaccacacctggctgcgattttttctttatgtttaattttttgaaatttgaatatctatgcctaagcatagttttttttgttttctttttgttttgcatttatcttgcttggtgttctctgagcttcctagatctgtggattggtgtctaacattaatttgggggaaattttcactcattattgcttcaaatattgcttctgctcttttctctttttcctctcctgggatttccattacatatgtttacaccctttgtagttgtcccccagcttttggatattctgttatgagtttttattttcagtctgttttctttttgcttttggtattggactttcttttctttttttttttttttgagatggagtctcactctgtcgccaggctggagtgcagtggcagtggtgcaatcttggctcactgcaacctccgcctcccgggttcaagtgattctcctgcctcagtctcccaagtagctgggattacaggcatgtgccaccatgcccggctaattttttgtatttttagtagagatggggtttcaccatgttggccaggatggtctcaatctcatgacctcgtgatccacctgccttggcctcccaaagtgctgggattacatggacatttttattgttatgtccccaagcttggagattctttcttcatcatgtccagtctactaatgggttcatcaaaggcattctttgtttctcttacactatatttttttgtaatctctgtgatttcttttttgcttttagaattttcatgtttctgtttacattatatacctgttcttgcatgctatctactttttccattaaagtccttagcatagtccatagtccatagaagcattaaatttctggtctggtaattctagcgtttctaccatatgcgattctgtccagatatgcttgttcagtctcttcagatctttaaactgtgttttttgtcttttagtttgccttataatttttggttaaaaggtacacatgatgtactgggtaaaaagaactgcagtaaataggcctttagtaatgtagtggtaaggtgtaggaagaaggggaagtgtattagttcattttcatactgctatgaagaaatacctgagactgcgtaatttataaataaaaagaggtttaatgcactcacaattccacatggctggggaggcctcacaatcatggcagaaggtgaaggagaaacaaaggcacatcttacatggcagcaggcaagagagaagtggcgagaaaaagggggaaaaaccccttataaaatcatcagatctcatgagaactcactcactgtcatgagaacagcagcatgggggtaaccacccctatgattcaagtacctctcaccgggtccctcttatgacgtagggattatgggagctacaattcaaggtgagatttgggtggggacacagccaaaccatatcagggagcattctgtggtcttatgagtaggtctcagtcttttggtgagcttatgcccctgaattgtgaacttcatcactgtttctctgtccctatctctctccatctccccactcccactcccacactttacatgggaaggaatgacttagaaggggttggaattgggtatttcttttcttccatgtggaaagctagagggagctgggttggctatttccctttccccagcttgatcaggctctgatcaaaccccagtaggctctggtaaaatagtttcttctgaggccaggctttcttaagaacagaatgctctggcacatttcaaaattggttttattttgtgtccccctgctggaatcataagggaatttttctctgatatttgctgtcaggtagagctcctggatgtaaaacgcataaaagtgtggaagcccccatatgactgggtctctctggagttttaaacttacagttgtcttcactgagcctctagcaatccattaattacagttcaggttttcctatcctagcacttgttcctgtggaggtttttgcctgggagtttatgttctgataagttgtgattctcagtatctgcctgtctctctgatatttggggcagtggtttgtcctataactctacttttctgatggttctaagaagagttgttgatttttcagtctgttccagtttttacgtgatgttaggatggagtagcaacttccaagctccttacatgctgaaccagtttattcctttttaatgctgaataatattccatcgtatggatatactacaatttgtttattcatctgttggtggacatttgaattgtttctagtgttgggctatcgtattagtccattttcatacttctgtaagaactgcccaagactggtaatttataaaggaaagaggtttaattgactctcagttctgcatggctggggagacttcaggaaatttatgattatggcagaagaggaaggggaagcaaggtaccttcttcacaaggtggctggaaggagaagtgctgagtgaaggaggaagagccccttataaaaccatcagatcttgtgagaattcacccactatcatgagaacagcatgggcaaaactgcccccatgattcagttacctccacctggtctctcccttgacatgtagaaattatggggattacaattcaagatgagatttgggtggagacacaaagcctaaccatattatgaaaaaagccactctgaacattcatgtttaagtctttgtgtgaacatatgttccacttttcttgcatgtatacccaatagtggaattgctaagttttatgataaataaatttcaactttctaagaactgccaaactgttttccacagtgatttaccattgtacattcccactagcaatttatgagcattccagttgctccacatccttgccaacacttggtattgtcagtgaaaggaagcatttactatatcaatttagaaagactagtttcttctaagcttgccatttgacagaaagggaatgaagagtggatgggactctgtagtttcttcatttggatagctaatg

SEQ ID NO: 1272 - DNA, 485173 bp, Homo sapiens
aaggttacaggctctttccttttatctcacttctaaaagacttctttggaatagcgtgtatacttttgttttgcattttaatagtttttacctttaagatctcaactttaacatcttaaaactttttttctttttaattgtagatttttggaataatcacagctatcttaaaacttttatgctcctaagcccttagaagtgagggcttgatacttgtagaagcataaataaggccagatgatgcctttgcagaggcaaatctgaacctagtagttgggaggtccattactgcgtctgcttctgaaaccccaatagagcactagcaacaggtagctattgcatgcctgttgggtgccaggcactaaagagttgggtgccagctctaaagagtagtgagcaaaaagaaaacatcctggtatgctggagtttattttctaatggacaattaacacaacaacaaaatgaactacacagtatatcagaaggtattaaaagccatagagaaaaataaaggagggaaggggctgatgttacagttggtttgtattttaaatagggcagtctgggaaggcctcactgataaagtgatacctgagcaaagacctgaggagctgagagagtgagcccttggcacaggtgtgggaggaggcagcagcaggcacagattcagaggcaggaggatgcccagtgtgtgggtggagcagggaggaggctggtgaggctggaaagggagtaagggctgaggaattgtaggaggcgtgggaggaggtctctgcagatcattcagggccttgtgagacacgtaagactttcgccttttctcagagtgagatgggagtcatgggagggtttctccctttttcttttttcttcttcttcttcttcctttttttgttttttgttttttgtttttgagagacagcgtcttgctatgtgttgcccaggctaggcttgaactcctgggctcaggagatcctcttgctgcagcctcttgagtagctgggattgcagacatgtgccaccatgcttggctttttatgggagggttttgagtggagcagtgacatgatctgatctacctaaagcagaattgctctggctactgggcagaagctggggaccatttaggtggctgttgtattgatttaggttacacttgatttacactatccaagatagtgtagttggagccagggtggaagcaatggaagtgatgagaagtgtttggattcaggatatattagaagggcagagcaaaaaggatttcctgatgggttgggtggagaagagttagtatgtctgcaagatttgagcctcagcaactggatcgtgtgctctgccacacactcctttttatccatggcccttattggtgtccaagttattatcaagcagtcactctgatcccaattgagaaactgtagacactctggtagccaggagaaatacttctgtggtcttctgagccattgctcagaagatgctaccaggttagttaatgagagagaacttggctcaccagtataagttacttagtctttcttgacaccttctcattacacatttggcatcacattctggggaggaactgtgatagatgttggtgccatccaaacctgcacctcagctctgagtctgaagaatgcaggaaaagagcagaagagtaggaggagctaaagcaaagataaagaatagagagatctggaaacttgtagtacaaaccactttgaaaaaaagactatcaggagcagtaaaatgtgtatctttccctggtgttttccctttttatatctacctttcatagcttccagttgaaagataaaaagatgtgatatttccacaataactggagtgggaattaatggactaacatggaatgtaacaaaaacaaagattaagtcccacatttagtaattgagagatggcaagagaagagtttatggatccttctagtcagatacatagaagatacactggctttccaagatcccactcttgcttgcacccaccgtaatctctcctacttaaataaaccaccaagcctgctgtgagagagtacgaggacatagtttgctacgatgttggccaagtatagagctgaaaaatctcaccctgtttatttattaggaatcttgttttccatccttgccttgctcatgtggggctgagtaaatcttaatctgagttcttatctcaggaagagcaaagggtagccctggaagccttctaaatagcaggtgcaggacagaatgaagaggaaaagagagggtggagaccagtggaaaatatctttgagaggccaagaaatccataaggctgatgagctagagaaaggagcaggtggatgggtgagctggtgcctaagggcgcaaactggaacctaccgggatgggatgatagggacaccagatggactggcgttgggtcaaaccagatggtgggcttttatttttaaaaggatttgtaagtcctaggaacaaggaaccataagggtactgggcctttaatcccattagtagaaaacaaaagtgtgctctttaaaaatgtaaactcatcaattatagaatttatcaaaactttgggacagactactcacttgtgaaaccccaaggaatctctggattctgtattgatggaaggagaaactgaagaaatagtctaggcattataagttaattaaagactcctccttaataatttaaagtgcgtttactaagtttacattccaaaccaaacaaaatatgatatatttgtatgaaataggctggctcacatgtggagttgggagaacagctagcagtgtaagtagggactgatgaattattgagtaaattttgagttggtaatgagaaaatttttaaaatttaagcatctattgctttcccaaaaatcagacccctgcaccccacctccccagttgctgtgtctagcgcaacctggcctcagtatagctacagctgctctcatggttgctaagacatgagagcttctactgtagtccttgtctctatcccagccttaattttagggtccagagctatttccataatccctctacaacggacttattttcaaggagaccagactcttaagtgtagcctggagccatcagtttgtgctcccatgtggcatgagtgtggatgctgtgcctgcagagccatgtgtcccttgcatagacatgcagaggggttggacgggagggtttggtgtgctacagagttcatgaggaatctgccttcttcgtattatgtaatagccgattctcctgctgataggaacactctaatctaaaaaagtcaataaatgttaagtgttaatattaagagaaagttttaagtagtgtgattagttgttaaatgacttttctgtttagaatatgcagatatatccattaagtaactatcaataatactgcatcattttcaatgctatttcatagatatatctttccttaattacttctgaaaagtataactgtcactttgtagttgaagttgaatagagttgctttccaacaccactgactgtttttgcttgcttgttcattattatctctacaggtatggaaacctgacaagcccaaactgtgaagaagatggaagccaaagttcatcagagtccaaaatggtgatcaggaagtgagtctcccttttctttgcattctaagctctcagtcaagacaatatcttaaagtagtttagtagagtattttattcctttgaatgttgccatgatttttttttccatagtgcatacagaggcttattttttgattacctaacaatattcatttatgtatccagtgaaagtatcttaagtaaccactgtctgccaggcattgtgctaaggtatacaaaacaaacaagtgaagaaaacaaacgaacaaaataaacagtcccagctcataaaaagtgtgtattttaccagaaagagacaaagaatacacacaaaaaagtgaagaagaatgaagcagggtctgagggctggagcgtttggctatgtgtagggtgcccggattgggctgtctggtctgttggcattggagcacgccgaaatgaggtgtgccctgagccttgcaaatagccaggccgacagaccacgggaaagcctctgaggcaggagcggtgtttgagaatcagcagggaattgcatgtggccggagcgcgtgctaggggatgagcactgtgaggtgagcaggaaggtggccactcacaaggggactcatagcaacttggggaaagatgttgaatttgattctgaggaagataagaagcgcttagaaggttttgagaagagtgctgtggcctgacacatcttaaaagacccgctctggctctgtgtccggaaagtagcctgtggcagtgtggctggggacaagggtgggagcagggagcctggtcaggaccctcccaagagtccagatgagggctgcttgtggtgcgggctgaagcaatagcagtgaaggtgaccagcctttgcagagatcttccaggtgttggtggcaggacaagctggagtgcatgggctgtgtgagagaacaagaggaggccagatgcttcccagggttgcggtttgagcagcggagagacagaaccttggctttataaaataaggaagatcgagggagcaggtttaatggggagtgtgtatcagaaattcagtcacagacataattagctcagtctagatttcagggagaggcatggaatggaggtataaatttggatgtctttagtttatacatggtatttaaagctatgagactgaatgtggcttcctgggaactaagggcagatagaggagagaagatccagagactgagcctggttccttgggtgtttagagttagggaagtagagcgtctggcagaggagactggaacagagcagctttggggaaggatgggggaggagaaaaaagaagttgttgtgtccccagaagacaagcaaagaaaggatttcagggagggagtgaccaactccctccagtgctgccctagatcgagtgtgagggtctgaaaagtgactcctcctttgcagtgctgcggtctttggtgacttgacaagtgcagtttggtggatggaaaggtgggcaagagagaatgaaggggatgaagtggggacagtgagtcttgttagaggaggagctttgctgcaaaggggaatagagaaatggatggaagatgggttttttttttggttgtatatgtgttttttaaaagatggaagatattttatgctgatgagaatgtcctatgagaaaacatccatgatgcgggggtgggggccattgtaggggtgatgttcctgagtagatggaatgtgcacctgggtgcctgaaaccactagtgttaaatattcattttggggccaaaagtctggggggaatcctgtggaatttttaactcctcagaagagttactgatagactcctttcttcaggagctagggatgtgaaagtagaaagctgagtatcttttttaactcctgagttaggttccatgtagttttacagttttgttcagtggatcataactttccagaaaaccagacataccagtgtaggtatttgaatgtcaagcacaaggtacagtgggaggaacaattcttttgtttttagaagggcttggggaaggcctcttggaggaggttacctttgatctgggccctgaagcatggtgaagattttgttggtagagccgtctgggtataggaaacagtgggaccaaattgggcaaatgcaattttcatggaattttggggaacaacacagaattggtgtggctgcttcatagagtacatgttaggtgagaggggagtcagtggagctgaagctagattggacttacttcatgaagggcattaatttcttgcaggagagtttggactttccctggtaagcagtgggcagtcagcagtaatgaatttttataggagggaaacaatataatctaaaaggtgatttttcagaatgggttagacatagagccttctcgctcaaagtgtgaccgtggacctatagcatcagcatctcctgggtgggagcttgtgagaaatgcagactctcaggccccactcagacctaatggattagaatctgcattttaacaagattctcaagtgattcctaagcactttagagttttgagaatcataggagtctatgaaaactcactaagataatgatttttttagaagaacctttttataatggacattttggagcatatacaaaaggagagatactgtaagaattgagtgtaatctagacttgtgagcagattcagaaatagacatgttattatacacatattttggaactcagtccaatctagagctgccattcaattagccacctgaacactctgaggagagtcacaatcaaaaatatccagagctggccgggcgtggtggctcatgcctgtaatcccaacactttgggaagcccaggagggaagatcacttaaggcaggagctcaaaaccagcctgggcaacgtagtgggactctgtctctacaaaaatttttttaaaaaattgctggatgtggtggcacatgcctgtagtcccagttacttgggaggctgaggcaggaggattgcttgagcctgggaggttgaggctgctgtgagccatgatcgtgccactgcactccagcctgggcaacagagtgagtgagaccttgtcttaaaagtaaataataataataaaaaaatccagagcttctctgtcccatgaggtgttttgagataaaatagattttttgggaagtagcagttaagaaaattgcaccctgggtatgaagagtcatgttcattcttttaaagtctcattcgaattcgttgtatactaggaacactaatgtgaatgaaactccaagctaagctgttttaaagagttttagagttttaagcatatgagggcttaacaaagagcttcacacagaactcccctgaggggtccatcctctggggacaatggtcctttcctaaagtctcacaataacttggtggaaagttcttgacccttttgctcagactgagttgccttttaaaaaattatgcctgatgaaaatatgccactttatcttataatgggtcgctctgtcctacagattctggaatgttaaaatcccttcttactggtgacctctttcttccttccatttccctttcttctgtctttctcactgttttttccccacatcttttattgtttttcatctcacttcactattattttttggctctctttttctgaaactatgcttctcctgatcatttctgtgcctagatagggtcactgctttgtctttgtctttgtgagaggaaatcagggaagcatcttctcccatctgtatgtaatgtattgcaaatttcctggtcatcccagacctctggcatctgacttgcagcaatgattgagggcttcctgatgatcaatagatgtgtaggaggtatggcagtggttctcaacagggcgattgttatcctccagaggacatttgccaatgccctacagacattttggttgtctcaacttggtggggggaggctattggcaactcatgggtagaggccagggatgctgctaaacgtcctagcatgtgaaagtttcttgtattggttcgaaccctaaaagcatgccaacagacaacacaaagcggtgtggagcaacacactgttttaatgagtgcctgggtgcaggcgggctgagacctaaaatgacatcagccccaagtgaggacgggacaggggctttgtagtcctctgtaaacaggaagtgtcccagtctgacgtgactgctacgtagtacctggacggcctctttctcggtcttcaggggtatgtgtcttccggccagggtaggtgtcttccggccagggtagttgtcttccggccagggtaggtgtcttccggccagggtagttgtcttccggccagggtaggtgtcttccggccagggtagttgtcttccggccagggtaggtgtcttccggccagggtagttgtcttccggccagggtaggtgtcttccggccagggtaggtgtcttccggccagggtaggtgtcttctggcccgctgtcttcctgcttctgctatcttgctgacgcgtgctgctggcgcaagtggccttgagctttgggactgggcctgagaagggaggagttactcatcccttcaagctttcgggcccgggggagaatctttcagcatgcacaaagtaactctcctctaccccaacaaggaatgatctgaccttaaatgtcaatagtgcctaagaagccctgctatgtagtattgaggctctagttctcaagtgaaactgtctttatgaatacctaacatacataaaaataggagcaggcctatttggaaatttctctatttgtgtctctttttataagtagctgaatcaaatgtggaagtgattcagaggcagccacatggagagggaaaggccctggtgaaggagcctggagaactcggatcctgctccttctctatcactctgtcacttaccagtcatctgaccttggcttagtcccttcacctccctttgtttcagtttcttcacctgaaaaatgagtgcttggagtaaatgctcgctgaggtccttttaagttcagtgatgtctaagataaaatttatttagctttttctttctctcaaaaaatgaataacagaaacagagatatggtccacacagcatagtggacttttgagagtacggtaccttcgaccacttttctctgttggaaagtgtgttaccagttttgaagagacaggaagaaacacatacacaagctttgtttgttattagtcatgacatcacagctgctcactggggtcatgaataaagagctgagctaaagcattgtcttgtgggagtaaggcaaggagtggcaaaatgcccattgttttcttttgctatgaatctgttctcttgtgatttcaggtggaaaaccgacagcaggaatccaatgacattcaggaagtaaacatcctgtttagggcagttgccttcagttttgcagacctgggtggaggaggggatggggacagggactcactattggatttaaccatgaacagaaaaatgcccaaatattgtttgttttcccgttttagctgtaaagcaaagagcaacccttacattttatacaggctcccaagtaccaagtaaaatctttcctgtatttccaaatatggatttaaacctttcagagggtaaaagaactttaaagaaggaaaatgtggaaatacagatgaagcattcaagatgaaaaattggtttctgatgtcttggaccacaaccgactagtgttcttcatgcatttaaaaaagtatcagattgtgcagggactcccacatgcggagtacttgtaattccagtccagagttcaggctttgcacaatgtcaggaccctctaaagttatctggctaagacaagaatgtgttcagttgcaaaggattcaacttccaaggcttctggatgttggaatctttgcctcacggtgatttctgatggtagggctagactgattatataaggtgtgccacatttatttctaggattcctaaattggccactatttatcaattaggaaactcactttctatgacagaagaaaacatttctgcctatattcattctacccgtgcccttttcctgctgacatttttacacgataaaatgctatctttttaaataataaaatctgaaccagatggaaaaagtgaattgtctctagggcagatttattatagtcattgaattcagaaatgaagagaatgtaaagaagggatattaaccatatagagcttttacaacacgaatcttcattctctgaattttatatgagatggccatatctccctctctctatatataactttatttaaagagatttaaaactcctcaagaaatgatgctttatttctttcctttaatgactattataaggttgaaattgtttctgttttcttttctttaattgaatctcatcagtttccttctggagtgccaagttttgttttctcaaactctctaccatagtactacttcaaattgttgaaatcgttctgctttcatttccacatattcagaagatacgtatattgttcttgtaatcttttcccagaagttgtaaacagtgacaccagatttcagtcactggtaaaggatcatgtaaatagtagtaatccaagacatcggatacactttaaagagaaaggaaaggagttaaaggaagttggctgtgttacattactgcctcagaaacttcacagtggaaagttaaaaaatcttcccagagagtttgcaatcaatattcattcctgcaaattcagatgccctaagaaggcaattgaaattaattggagtgattataacaaaaatggggaaaaggaggaggggtgaagaacagcaaaaacaagatttaaaactccaatttagaagaattaaaagttataatgtgaaaggaattttttttaaagtgaaacaaaagaaatgaagaagtgatatgccatatcgaagagtctggtattgtctttaaaatatccctacaggacaaagaagaataaaaaccatagttttacaagtcattagcattctaagtcaagtctgcattttagggacatgggtagaaagccctgagcagaaactgatgttctaatagttgaggaagaataaaacaacattgataatcaatggctcaaaaagaagacagatcaatcatacgagtatctcctagggttttctacattaaagaatgtctcttttagaaaggaaaacagacatcacaattagactgtattgtttgattccctgcacagcattgtaaacaaagaaaatgatgacactgcccttgccaccaccattggctacaatttgtggtatgcttacaaggcattctgctaagtactttatatttgtgtcttcttcaaccatcacaaatatgctgagatattgtcctcactttataggatataaagtgaagcttcagagaagttatgtgttttgactaagatcaggcaggtggttaagtgacaggtctgatatttgaactcccgtccaactgactccaagacctgggtgggaagcccaggcatgccatttatagaagagcattgggatctcggatactcaagatttttctccgcatttgcctatatcaccataataagactgcggaagtacatgaagaactagattacaatatcattgttgtgactaatgttttagattgttattattctgagatcttttgtcattatttccattgctctatgctgttttgcctggctgttgctttattattgaatgaacaccctgagcaaggttcgcacacagctgttagaaatgtggaagctagacctttttcctggggaaggagatgggttgaagaatgtgaggaaacaagaccaaattaggcccatcaaaggagaacctgcttcctgttccttgtgcctcgtagcatctgtcactaccaacggaaactcagttctagtggtgaaaactatagaaggccttagccatttttttcaatagagttctatttataacatgaaaactcccttcttggactgtggggaatgagttattgaggtccttgaaagataattttggtgactggcgatgtccttttctaataatagctagaatttattgactacttagtaggaatggtccctgtgttaagtactgtacatacttgttaaatcctcataatgattatgttttattattcttattttacagaggaggaacctggggcgtaggttaaggaacatgtccaaggctacacagtgaataaatgaaagagctgggatttaaccgaggccttaacctctgtgctgcatgacctttactatttttcctctgataaaaatgaaaatatttctcttaagtacttagcttgggaatgaaagacaggtgtgtaaataaccttgactttgggtaattggcttcaggcttatccatcctactccgggccctctcccactcacatttactgtctttctgtatgtcttcctttcataatctttttcttcctccttcttgccgtggaggtttttttttttctcttctctcccttccccatagtccctgcgttgcccttgccttcttagtgcttaaatctgactctggctttgttggcattatttccctggtcttttctcaatctctctttcacgtctcctcctagtatttgaatccctgtttaccaacagcactgaaatgtgacaatgtaaagtgtaaaaaagcaacgcaggacaaccttgacaagtccagataataatattttcatcctttccaggaaaaaaacaaagaggaaagctttgtatctttctttgttccttctcatcaggaaaatcatctagctggaggtctcagaggcagcttctatctggcaaccttccctgaaacagagcaaaactgttctatgattaggagaacaaggtggagggtccggcccagagtcagggtcaaggttgacttaggcttcagttcttgaaggacaaagtgtattagatcctgccctcagagcttggcagaagttacttcattgcttgaaaggcccaccgtctgcgtaaatcttcttaccttttcattatctgcagcgaagacaagatccagttctcagagaatgtattaaaatagaaaaacattttgctgcttttgaaaaatggttccatgtcttattttctgctgatgattaagtacaaaaaattattatttcaaatagattgctggggagagaaaagaactctagatggatagtgttattctttttgtcacggtaatcctatttcttggctcagaagttacacatcatgggagaggtgacttcatacctgaaaaaatttgtattaaacatttgaccaattatagagtattttactgcctatggaatgttaatatgatttaatacgtttacctaaaatctgcattcattaaaaagtctgtgatttgcgcataatcgctgcctaaatgcttgcctcagccctctctgcattgcgtgcctgaagatcgtggggtggctagaagttctgaaccattttcttttatctctcagccaaggtgcatctgtctaatgtcttctaagcaggtgttattaggtgtgatttctggttggctgagaaatcaatgagtggccagctgcggtggctcatgcctgtaatcctagcactttgggaggccaaggcaggtggatcacctgaggtcaggagtttgaaaccagcctggccaacatggtgaaacctggtctctactaaaaagaaaaaaaaaattagccaggcatggtggcacgtgcctgtaatcccagctactcgggaggctgaggcaggagaatcgcttgaacctgggaggcgaagattgcagtgagccgagattgcgccactgcactccagcctgggcgacagctctgtctcaaaaaaaaaaaaaaaaaaaaatcaatgagtatagcagatttcatcatgctcctttcccccaactctttatattttttagtttaacagatctttaagtcctctacaagtgtttagctctttcaccgcagaacctctgcctcattgctgccccagaatcctcatcccactgactcctaaccctcaagatctcagctttcacatcatttcctcagggagatcctccctaaagccttgaccaggtcagctccctctgaagttcagtgcttccctgggaccctggacttcctgtattgtgatgctcatcgcataaattgtttttgtgactctgggaaataaagggcactcaacaaatattagtttaattggtgaatgaatttcttagaagcaaaagtcctagaagctgctttagtatgtttcaaacagtgacatctgagcatgtcttccttcccctatagacgattgcagtcggttggaaaagaatcacacactacaaagttttgtatgttgccaagaatgcctgaggtagaaaactcaattttggttgtctcctctgctatcagttttgggcccctggccttggccacctacccggcatacttgcccttaggaccgaggagttttgttctgtgagccaccaaagattactttggaaaaggaagtcacatactggcttttctccagactgaatttaggttatgtcacaattgtaatcatccagtttggcttcaggaattacttctgcctttacaagttattcaagaatcatctcttgcagttaatactacagtttgatgtctttgatttgtcctagagaggatacctcaaggtatatgtatgtgggcacatatgtgtgtgtgtgtcttgtgtgtgtgttcacagcagccatcttcttccagcaggcctgaagtcacacatgtcatagcatggcttgtattctgtgtcattcttcctgtgagaggtggcagattctttgagtcaattcctgtgagtgctgatggattttcgctgagccattttaccttttcaatcccttccttctatgacttctggcaagtagttgtaagactgttgataattatgtttctctccaggtatctcaaaatgtccttattgacattatatcatttgaaatcacaactgatcagtgtcaggtagatgaagaaggtgttattatatctcttccccagagaggggggtcagtggagttaactgacctatccaggcttccttagttccccggtgggacagccaggatgaaagatagagttttctttctccaggtctccaagcgtcctgtcttggtctgtgtacagaaccaagtggcttctgtagtctaacagacataccagacctgtaaatttgtgacttcaaaccagaatttcccttcagctgtaagattctttacatccccccactctgttctggttaatatataagttagatcttaggactggagccaggctgggtaagaccgaaaagccattggccagtaatcctgtttttcttttcatcattattttgcgatgttgctttcttttttgaaatcttaaaagtttcgcatttgtatctgcttctaaatctatcaagaacggaaagtttcttcccaggactggcacacacaaagctactgtgagccttgggcatgtgtccaggcctttccagaaagcttccctgcctggtgtgctgagaaacgctctgccgatgaggagggcagggctctgcctcgtgttctattgtgctgtttgtgtatgtctttccctttctctgtttcttcgtcctcctcccccttcattcctcttttgtgtgaaaatgcttttttctggctgattgagtatctgagtttgtggtgaactttcaaagccttcttaggctaagctacaggaaggtcactgtcacaaagagtaaaaaaatgtatagatcgccagagttcattaaaaacatcagattgaggaacacaaaatgtccacctaagggcaagtctaatgtggacgaaggctcctctttagaactctcctagttcttctgaggctgcagctctccatagaggtaagtgctgtgtgcccatcagaaatacccacacgagcatgcagagatggaggcaaggatgcacatattttgtagttgtgacaacctgaaaataacttaaatacctgccttccagtagaagaatacttaattatggtgtgtccacatcatgagaaacaataagatagatctagaggtaatgatgaagtatctgtaatatactgctcagtaaaaaagcccatgttgattttctttctatctatctatctatctatctatctatctatctatctatctatctgtctatctttttttttggagatagggtctcgctctgttacccaggctggagtgcagtggtgtgatcacagctcactgcagcctctatctcttgggtacaatcaatccacccacctcagcctcctgagcagctgggactacaggcgtgtaccaccacacctggctaattttctgtattttttgtagagatggggtttcgccacgttgccctagctggtctcgaactcctgggctcaagcaataatcctgtctcagcctcccaaagtgctgggattacaggcgtgagccaccacacctggcacatattatgtatatttaaatatgtatacatatccacagaaaagcctagaaggatatattctaacagttaacaaaaggtcctgggaatgggattaggatgaagggagagagtaggtattttgcttttttagtttatgtacatttgtaagacttacttttttgcaataaataatgagttttatcataataattaaggatcacaggcatttaagaagtgaataatatattagcatcactgactcttacctgtaattttgtgtttccgtctgggtgttcttttcagtgaaacactgtcttgttgttaggctgctactgtttttgacttgagtatatgatatgaattatcacctctccatatctgtttttccatcagtgtcatcataagagtatcttttcactgaaatattaagaaacattaagcaagtatagtggtgttaattagattaattcatccctctttttaaaggtgcaaaactctttttctgtaaaagtcaagctgatgtaaatgcaaatatcaggttttcaattaatttctggctttctggaagaaagtgaaattattgtttatcatttcatttaatctggactaaatatttggagtattgaattatttctatgactttcatttgatggtttcatgtatctactttagatgcagataattgaatattatagttccaaatgctttaacgttccacattagtgaaacaatgatctacaccataatgaaaacagtaacacatttattttctttctgtttgtacttcaattccaaaagttaagcattaaattggctttagtcatacttatgctttgatgatagtccagcttcttggtgtgaaatcaagatgtgaagaaagttagacacacctgtgaaagcccagccttcactttcacatatgtgggtaataacttagtccagttatagtttgttaactaaaaaaacaatttctttgaagtataattaggtgataatgataattttaaaatgtgctaaaaaattctttttggctgaaaaattttggtaaagtgtttagttaagatgaggtgttgtgtctctgtcaataaaagatgcatggattaatgtatagtccctgtcatcttctccagccttcagcagtgactattccgggaccgtatggggtaactggttgctaggcaggcagagtgttctgttctgttctccttgtctgtggcatgtgattgagtcaggagtgttggtaaagtcttctttgaagatgaagcatagaataatagcatgcaaaacattttatcctttttatccttcagctatttgtctctagccttcagtgagtgggtgccccaacctaaagacaacatgctgtgttattactaacatactggagggagctgtgcacatacaaatgaccctgtctctttttgtgccctggaaccttgtcttcccctaggtggactctgtgacccacagagccatcagaagaaatcacctttgcttatcaagtttttgttctttatcttttaaagacataacttctctacctactgtttctgctacttgaaacatattcctctcattgtaatttgagaaacaaaaggataattttatgaggacattttcagtgttcatgctgaagccctggtgatccttgtcaacttgaatttatgcatttatctttccacactcaggcacttcctttcatcagatggatttctggcctaccggcagtcagttatttcctaacatattaggtggcagattttgtgggatttaatttgagcataatcttattgtgtacagattgctttgaagtttcttcaggactcactaaaccttctacacatcaatttttctgccctgtatgggtttttccaaagtttagcctccttaaaacaaacaaacaacaacaacaaaaaaccttatcagtttcactgcagcactccacttaaaacaataaagtttagtttgttttcaagtgctttaaatccattgatgtttctaggaacttttggatgaatgatctgttgaccacccacccaagtttccaggggtgcccctggggtccaccctggtgtccagggattgctttgcctccccacagccagttgggtgcagtgactctccatttgtctttctcagtgcaatcgcttccatactaagggcctggcttgaccagtgtgcagaagacttccgagagccccctcacttcccttgcttacagaaactgctggattatctcacacggatgatgccgggctctgacccagaaagaagagcacaaaatcttcttgagcagtttcagaagcaagaagtggaaactgacagtgagtacttgtttgttcccagggaaaaggctagattctgattctccagcctccacgctggagaaaggttctccctgtgctggctaataggaaaccttggtaccctcaaaacaacatgctgctggaggattggcttgagtataaaattctcaagattactgaagtactaattagagagcctagaattttagacagagaagggtattttcaagactacctaatctggctccctcattttatggatgaggaaactgtggaaactccagctcagaaaaattaagtaatttcctggggtttcttctgttaccaagaagagggtctccttgatgaactttaatcttcccttatcaacatgtaccatgctgaacctgaatttgcattttattacctgtttaatggctccttctagccttccatcacaaccactcccgtctagcagtcaaggaatgaagtctagttctgatcctgccctcccaaaagcttggaaaaggtgtttgtccttcagtatggaaaagcatcactgtaacgggtcccctgccagtgcagattgtcatcatttagcatctataagggcctcatcaaaggaagtttctgcagctgtttttccctatttgaagattaacttcctatttgcaaggacaaaggaaaggccaccactgcaggttatgaggtgcttggaactattaggctttgaagaaagtcagaaagaggctgggacaggcttccagtgtgatgttgtatcctctcactggggtgctgggtgacagtttccatggtggctgacccacttggagcttctgacaggcattaccctgaagggatgcctgacttcatcagtaagggaaaggaaatgttcctcagcaccaataaggaaagctgcatcagctccaaagaaaatagacctaaattccaaacaatacctgctgaatttcttatggatgggggtcccagagagagggaaatgcaattgcatcattggaagctgactgccaaatactctatatctcagatgacttcatctgccaggaatgtttgaataccaggggcactcctccagctgcggacctcagctcccttcagggcctccatgcctggctttgtgctggagtgggaaacgctgtgttggagcccagctctccccactggggctgcccctggctctgagcctaattggggaaccggtgggaccagtcattcattgtttccaacacagggactgcaaggcagagctcatttggcaggctgaggcaggggagagggagattgcctcagttcccatgtgcttgttttacccaattttactcctgcggaagaagcaagctctcctatatgtttttaaaaagtaaaatcgtgcttcatgttgttacttatctctggaggagaatcaaaagcagaaaacagtgaaggcatggactatgccccagagagaaaggatcatgtaatcttcatgcacagcaacattatagacacacattgggctgctgtgtttgctgaatgaatgaatggaaagatcaagccttagcacataccctgctccttgactgaagtgggttaggctctgcattgcagggcaaatgggatatatgtatgtatttgttgacaagacgagggagaggccgtttctgaacctttatttgggatcccaagtttctaattacacctctaaattaaacagtgccagagttgtatggaggaagaatgatgaaattagattgcttaacatcctccatgtcatggggttttagcttcctttagcttgtacctgtttgtgtcgcagactccggggataggcagtgatccccttctacgtttttcagtcataacccaaccccattggcatctggaacttcaagtccagggtaaaggggcaatcctcaaatcacatacctgccaccagtataggcagataaccacatgctgccctaaaggggaagtggtgtagggtccactctcggaagctccttttccctggaaaatgaaggaaagccactgtgacttaatccaagatgcccaatagtctttaattctacaaagaaagaaagaaaaggctcaaaatataagcattctgggggagtagtaacatgctgatttacatttctgctaagatataactgaatgtaactagagttttctttccttgagaacaggtttgacaggaaggagtgtgaggggtgtgaaggggctgaggttgggaaacaacccgagcactggggaaaggttccaggaaaggaaggctggggatttaagtcagaaaaccttcatcaaattccagtctttcaaaatggagactggaggtcctattccaggtgtgggctcttctgctttttattcggaatcctgggtactgattttctcttcttcatgctgtgccctatgtaatttgctaattgatgatcttggctgtgataggttcaggtgaatttagttgaagactgttctgcttcatgcattcttagctttgggtggaagttgaaagtgactctgaacattttgagaattttgagggcttcgtcagcatttctaacaccaaaatggctcattttattgcccaaagtcatacctgccttcatggcgagtccttccaggcttctggttataagtcgcccagcaaccaaaaattgcatggttggggtttaggagttagttggattagtcctggagctgatctgatcaaaaagtttgaaagagccctagacaaagggctctctctagactttgcctatcctggctctgtccttggcctaggagccagtgatttgtcagagtgagagcatgagggctctgatcttaatagagaatctaagaacaagcagagatgggaagatctccattgttctcagatgcattgtgcttgtggttgtctccctgtggctgttctggaggattggccctcttcttcctaaacaaggagtaaagtctgatgactctataagcaagattatatacactggcgccaaattactaatcttttccatatgtgaacagatgggcttcccaacacgatctccttcagcctggaagaggaagaggaactggagggtggagagtcagcagaattcacgtgcttctcagaagatctcgtggcagagcagctgacctacatggatgcagtatgtcttctctttgtgatcagatgtactttcacttaaaacataggggagtgatggcactggtgccccggtgacagcagtgggataatgtgattttaagtcttcttgaatccttgagacaggctgcgcctgcagatacagagttaagatgtgtcttgaatcaatcatctgaataattcaggcctgagctcttcttgcaactctaggagaaggtgcttttggagctcaagacacagagggaaataagaattcgaatccctgtgaaacaaaatctgccttgttctgtgggtatttttctccctttacactcataaatatttcaagatctgaactgtttatttggaggattgtaaagggatcaaagtataagttagaataaaataaattcacagaatccacatgtgattgtatctggcccctcatttccacgtgtgctttctgtacttttgaagtttgaatatttttgtgagctggacatatttgagtatgtcagtcagatttcataggtcggtgttagatggtaaatacaagaggactgtgaggagttatcgtggtggctttagctcttctgctttatcacttttgacaaggcagtgtggaacagggtggagattttccttctagtgaacattatcgatgagtatattaattatttacttttgtctgttgaaatggacaccatgagacaaatcaagtagaaaaggattatctggccattcacaaaaataccaatttacaaatgacccagatgacatgctttgccatatgaaatgtctgtgttgtccttaaagtcagttcctcttttgttccagcaactcttcaagaaagtagtgcctcaccactgcctgggctgcatttggtctcgaagggataagaaggaaaacaaacatttggctcctacgatccgtgccaccatctctcagtttaataccctcaccaaatgtgttgtcagcaccatcctggggggcaaagaactcaaaactcagcagagagccaaaatcattgagaagtggatcaacatcgctcatgtaattgtcttttataaaatattctttgtgtttggtagatgcaagagactgctccatcacttcgtttaaatggtttagctgtttggttgaaaaggcagtcaaaagaccatatatgagagcccactgggtttttgttgttcttccagagtaagaaaaaagttgcctttctaaacttggcagcttatttattttcctcttttttaaaaaattggacccctgctcacttcttcccagttatgggctctcacactgctacctctctagagtgagacattctgtctgctttcccctttgtattcacgacaagactgagtgttggtttcagcaccatgttcagtaaatataaatgtatggtctgcatgtcaaaacagactgcccttcaacccagagtgattacctatgccccctcccagtacctggaggcattacatcttctgcagttttgaagagctggtacttcttcagagtcctgaatctcttttctaaaggactgagacacttacagagatctcatattaatctgaggtcatgtctcatattaatctgaagttggaggggaggagtctgttcctaggcctgactcacattcttctgagtgttggagtctagtctcttggatgaactgcttacataccataggacctccccttctcagcatcttatctcatgactgagaaaatggcaacagtgtgcagtcagtgggccaccaaatattttgtgaacttctaatgtgtgtaaaccacaatattctgtacttaggggacatactaggatagagcataattatttgtttgcaggaacccgtacacaaacaaggaagctaagatatactggaattatctcagcctgagacagtagaggagtagggccatgggagataagcactgtaaaagtgggggagagagaaatcatttctgatgggatgatcaaggaaggtttcatggatgaattgacatttgaaattaactttgagtaacagataggatttttggtatttgaagattagagaggtttttttttttctaggcaaaagaaattacatcagcaaaataatgattttgaaaaattattaatatgaaaatatcatattaatttgtgttctgggctctatgggtaaactctcaaccaaaacacattttgctttatgtccccttaaatatatttttccttgagcccctattgatagggcataatgttacattctcttttgctgtctttgattaaagagcagagacacaattgtgccagataatttgccttgagtcttcaggtggtctgttattacagacttcttagtgtattatgaaagtcagcaagaaacaaagagtgtaagttgcataaacaacttctatttctcctattctaaatcgagcttattgctcagcaagtaagagatacaaaagaagttgtgagtgagatatagtgtagaagttctctgtttttttagaatgataaggaattatttttttttttgccataagtgtcacagcatgtctcaaaagcagactgtctacccctaattcattcaactactttggctatagtgacaatatagcatctgtgtatgtgacatagtggggctcaagcgatgacttttggtccaaattgaatgtaaattgtgcatttatgtagtaataagaaatgcaagttgaatcatttgaagtatatttcaaatcccatatcatgtgctaataaagccaagggctcttactttttttttggtgatatcacttcctaatactgagtatgttgtatcttttacaattgtgtagggaaatgtaataaaataatgaggcttaccagtggtttgctaccaagatttattttacctttcctgcattcatcgtagtcaatttctattgaaaggatatttgaaaaagaaaatttttctgacctaatatgactatattttcttggactgcccttaatggtatgtttttacttttgcatcacatctcctggaagatgcctctttttctagaaatgggaccagatgccttttgtactcctttaaacccttagtttaaacctctttttgaataatgtgttccatgtgtttatttcaatttgcatgatgtatctgttcctgagttcctttttttattgcaagtttcctgatttttagaatataacttttgtgaacctttgttgaaccatgctcccataggcttagtttccagattgcaattcagaacatttctcttgttctctctctcttcccctccctccctccctcttttcctccctccctccctccttcccctccttcttctctctttctctttatatctttccaaataaggggaggacattgaggcatttaaaaagggtggacatgacttttattaagtactttggcatttactctaaagaaaatgtttgagggtttgtttggcatagttttcagtgtccagattttggcatgctaaattagagtgctgtttttccttcgtattcaggattaacatttctttgtgaaatgattctcgaagtgatttacatttatgcccaatcactctgggacttcttacctgagatactctacacaaaaccaaatacgtgctcacatggtgtactcacttgtaaacactgggcctagtacgctgtcatgtgcctgtatatgaagcatctcctttgacataaggcctggtccagtctcctcacgttgctaccttccccatgccagccaagaatgggactttctccctgtctgttttgctgtccctgctattcagtcacaggactttgactccaaggtcactaactgctgatgctacaggctccttatggtagcttaagtttaaatagggagcctctctccttacccagaaaatggcatccagaatgtttcctgttctctttctattttgttttaaaacattgccaaaatgaattttattttaaaaggccgagttattttggaagcattgaagtaccaaggtgtttttgaatgtttatggttgcaggacaagccaatttgaaaccaaatgaatgtgtataaaaatatccccccttggctaagagcataaaagccaaagttcaacttgtggtgaatttttattgccaaattatatacacctctgtggacaagggttggtgatgagatgttcaataccatctgacctcaaagtggctgctgcccagctcattttgggatctaaagaagatctaaagtgcatatttttaggacatctgtgtgctttcagcagaagaaagttgctctttctagcatagctctgtagacttacctccattagtgtttttactaggaaagctggaaactataaaactgtaacaacaacacaaaaaaatatattgacgagagaaaaacaagcatactgtgccaaaatctataaagtgtttcgatgactggggtgggaggaaggagccactttttgatgttcactatttatacagctgcctattttgtggtaagaattcatagcagctgtgatacctctaaaacaggaaaccaccaagtcattgtaatattgatagttaaatgccttttatgttttaatcactccccatgcaggaatgtagactcctgaagaatttttcctccttgagggccatcgtttcggcactgcagtctaattccatctatcggttaaaaaagacttgggctgccgtcccaaggtaagttcccaagtgtttgctctgcttttctttggccgggataattagtggttgtgatgagtcctcaccttcaaagcttgtatcgcataactagagaaacatatttgaaatcctctgtgtgtttcaggcagggtgcatcttacacataatcattaatgacttttgaggcagggctcctgcagaaatcaaactcattctaagtataccaaagccaagattattggctttggggatgatttgaaggatgtgcttattatctggattttgagggataaggttgtggagtgatgaagttacagcaatttgccattacttctggttatttttcagcctcactacaaagccctaagctattttaggactcaaggggtaatgtgtgcagataggacattagttcttgatgttcagtaggaaactatttagttgtccttttagtttcagcattttaaaaactatcttattggcattaaaaacctttaaatgttctttcctaagtacctgaaattattaactggccacatcctatgctgtttttcttcatatttcttggtgcaaccgttggaataattaacaacttggtttcctgatttttgcactactgccatcacttccatttccggaacttcactgtagatcaaagaactttgtgcaaaggaaggaaaggtgagggagggggcagttctgattctctgtcactacagatttagaggctggggattgtgtcatgagtacaactaggccagctacattcaacaagtttgcccaggtttgaactagtcaggaagttaggctatatcagggaagaatctataaattctgtatggtctataccacatgtggtatagtcagtttcagttaggaggagagggatgccagctggcttcccagccaggctgccttagtggggcagaatggaaggtctgggtcctcagtttcataagtttactcagagttgatcaagccctaagagactggcattgtttgaatttgcaagagccccaagctggtaaaccagagtttcataaatttatgctgaaaaatgagtgccagaatcctcaagcttgctgataagctcatattctcgttcaggggatagtctacttggtgtaagccaaattatttattaggtgattctttgatgggtaaaaagaaaaaaataaagtggatgtttataatgcctcatgttacagagctgtagaagccacagctacttgcactccaaagctcgtgctttgtttatgacatcaatatttatcagtagaagaactagcaggcttttcaaagaccaatgcaattttcttgattattattctttttttaggttctttcttctctattttgaataatcaaggtgattgtgtgtattaaagagagattagttggttgattttcctctgcacatttctccttaagaacgatggggtcatataaaatcattacttgataggccctggtgaaatgcgatgggaaaatcagaagcatgcagtgtccccacccttcacacctccacttcacctcttctttcccttaccaccactctccactcaactgtagtatagtatcaaaaacaaagggacagtcaagtgttaaaatgtagccttactcaattgattgcaaccttgtctgattgccacgaaaggtaatcctttctttgatggttgaaaaaagaacactaaggaaagtcacgtaaccagcctaagatttcttccacagcaagtttgagactaaaacatgagcaaaaaaaattaatggacttgtatcttagtctccttggctgccatatgaaaagatttattctagctggcttttaaaactattttctaaagacaaaggaaaaaccctctaagctgcattctgtgtaacatatgtttctggtttgtttcttagttggtttgtatgtgttttagcaaggacactacagaagtgtcacagttccttagagaacacacttctatatcagctttacatgttctccattgctaaattcaaggaacaggattaagataacttatttggacatggtacatctatacagtggaatattttgcaggcataaaaggagtgtagtactgatacatggtgtaacatgaaggaaccttgaaaacatgctaaatttaaaaagccagccacaacagctacgtatcatatacttggacttgtatatgaaatgtccagaatcagcaaatctatggacacggaatgtagatcagtggttacctagggctgggactgggaggacggtagggtcccagggtgatagctaaagggtagagggctgctttttggggtgataaaatattctaaagttgattatggggatgactgcacaactctgtgaatatactaaaaagcattggactgtatacttcaatgatatgtggattatatctcaataaagctgttattgtaagaaaaaagatatcttatttggttatcactttccctataatccttgacatttgtcgctttaagtagacaaagggaatacctatttatttctcttcatttagggccacatataattaattttgaaattattttctccaaatatgaatagcttaatggttttctttattatttagagtaatattacactcactataaaacaggctcttaataatggtttttttcataataatgaaaatgttgcatatatagtgatattgcccctattaattctttgtcttcagaatcatgcactcattaaccctggagggtgtgtagagaaaaccatgaggctcacagagatgtagtgtcctggaaagggagaggggcagagcagatgctttgcatatgtggtttcactcactgtcccagcagtcccataaaagcactgtcatatttcccttgtagaggtgagaacattgaagctcaggaaagttaagcagcttgtccaggatcattcagaaagtgagtggagagatgcaattggaactcaccacccctggttgcagagcccatccggttccaccattctctgactctgggagtagaaatagtggcctgtgagccagaaaatttggcttccatacctacaaccctcagcagttattcgtggaaatttgggaaaatccctggttctggcatcgtcatctctaaacttaggggcctggccaagatgacctctcagatctgtgggctctgtgtgtgtaacagtttttttttttttttttttttttttttgtttaactcactgagaagaacatgtcctaattgaacaacttgatgccccaattgaataatccttttttatgattataatatgcatggctagggaaatatacctctctccacaggggtggccaagtccaccttaaaagaaataaaaagccatcccgcataaaaaaaaatcatgggccttatctgtgcttacagtacccaccaaccctgagatcagcacagtccctccttagacatgagtcctgaggacagctgggccaaaagtgtcgggttattcctaactcttcattgttaatattttcttaatcccttttcatagggaccgaatgctgatgtttgaagaactttcagatatcttctcagaccataataaccatttgaccagccgagaactactgatgaaggtgaggctcttagtgaggctgctgtgtagtgctgttaatagctctggaatccattcaaggaagagtagtgtgagggctccttaagttccttcaactccaaagaaagcctaaagtaactagaaggcaaaaaatttttttaaatgcagaatctaagaaacttggggctgagaaaattctaagtccagttgagctctctctttctacctcccttagcttgcctgttatgcaagcagattgtgaaacttgagttcatatgtgtatgtacctccttaacaagctactctgcaaataccaagtgctggcagttaggtgggtgagaggccctggaatattccttctcagcaaaacatctagaatgacagaggccaagcctgcctgcaattccacatcctttatttggactaaattgcacaatctgtcagtcagcagtatttattgaacaccaagtaagtgctgacttctgaatgacacactaggtaaagatatagcttagttcattttatgtctccagacatttgttgaatgcctaatatttgtaaagctttgaacctgcttctagaaatatgaaggtgactaacacaaacactgtttcctggagtttaccatctaattggggtatatagacactaaacaacaagaataaatagtcaaataaagacaactaacaggttgtgaacaaccatcagaggggaactagcatagaccaaatattatcctcatagtctttctataaagtagattttatcatcatcattttgtagatagccaagactcagagagggtaataacctgccctaaggcatacaaccaataggtggtagagctaaaatatgaatgtaatgtggtgagactctaaaacctgtgcttttatcaccaagacataaagctatttcttctgacctttttggagtaaggtgcaggatggatcagatccagcttcatagagaaggtaaattagtagttcagtaaatattggttgagcacccactaggtattggggataaaaccatattaaaggcagtgtttgatcttaaggggattacagtctcatgtgggaggtaaaacatttataaaatagtgtgataggtcctaccataggggaaagtcctgaactgggcaatcaaaagttgtgattcttatccttaatctccttttctataaatgggagccaatcaaagtatttggtctgttgacttcatagaattgttttgaagattcactatggtaaaatacttgaaagtgctatgcaaatgtaagttattttttgtatttggtgagctatattcatgtaaaaccaaagtatgcataacaaatgaaaataaatagagaataagctgcatatttgagcttagggaagatacttggagtaggagtgaaaatcaggtagaggtggggttagtaagaaaaggcatccaggtgctaacccttaggttagtcgatcctataagggcatttgttaaggtcttcatgactgttcctgtcctatgtcctacttatccttcatgtctcagtgtagactcctccttttctggaagccttccttcattctcaggtctgtgctccaggagaagctgtcatttctctgtcctggcacttatcacttgctctgttgcaactgcctgtctctctactggtctgtaggcctcttgcaggcaggggctgtatgtatcttttcactttgtatccctaatgcccaaccagtgcctggcatgcagtaagtgttcagaagctattgtttggctgcatgaattgatgggtcttatcattcacatgactttttaacaatatgcccactattagcccttcttggagtaggtgatatgagaagggcagtatgtgctgatgtctgactttggatttggactacctgattaactgcacactaaacaatcattactgagatcgtgttactccctgcttcacatgcccctggctttgcatactttaaatggaaacccatctggctggaaggagatggcttagtggtctccctgtcagcagtacgaagctagactaactggagccacacattcaaatccaaacagtcctgagtcttccttccaaagtagataaattgaatactgtgcagctcattgcctggtagcagccttctggctgaaggcttagaagtgaagctgtatctagacattaaagatcccataaacctttcttaaatgcagaagttaccccccgtactctaaattaaatttcttatagatatgactcaaattccaaagaaatggaaaacttggctgtgaattcatgtggtctgtgcattatcattaatgatagtgaaatgctttgggcagtccatgtatatctgtaggtccttttccagtcatttttgttaatcattcttcatatgaagtgtctaattctgagtgtaaattgtcagcacattttttttttaaatggaatcacaaggtacttagtttctcaaaagagtcactaggaaaaactaccggcctctgtttctagtgttactcctggttttatacggatttatggttgggtaacaatataatagtttcattttattttattttttgtagatatgtagtctcattatttttctcaggctggtctcaaattcttggactcttagttttaaatgacctaacttctcttcttctgggaagatgtaacgtgccacttatataatatggcccaggcaacatgattattagcaaaaatctgtggttttccttttaattgtttttaaaaatgtttcatttcctctcaaagactatcttaaacctgctatgtccttgtgatttctgaaacctgggtaattctaagcaggtgaattatagtctggaaatttcaagacatcagggaagaaagcagaatgccagcaaatcttggttctcatgattcttggtaagaattttttcggttgactttatataaaggactgctagaaagccccagaaattcaaccctgatggagacgtatgttcagtgacactccaaaacatgctaaactcaaagttagagcaagagtctgttacaactgtgacagttctgagctataattgctggtagctactgagcttaagttaaccaacatttatggagatggatccagagtccagtagacaagttccatctagacctagtagaagagggccctctgaagcccaagaacagcatggatgagggtagctgaactctgctaaagatggttataaagaaaaggtgagacttaagcaagccatttgcactaagagacggagagggaagagaagggcagagggggagataaaaggagagagagagggagaaggagattgatggaggaagagggagatttggcatttatccaaacataggtgatgattaaaatcatgagattggatagtatttccaaagacatgagtacagcagaaaacaagaggataactttgacaaaaagaagaatcactaagagaatatgagaacagcagaggaggcagggggagagaatgagtgatacagtcacaaaaacctatgaaaactttcaagaaggttcaagggattggtgttgtgcgacattgcagagtaggagatttggggctgaggaaggaaaaactgaaactgctggatgtggcaggtaagtggattttcagttgacacctcatttggaataatagggactcgtcggtctttttagatctctagcagggatggaatctcattctcatgaaatcataaagtcatggaatcaacaagtcttgtagctccccatctcaggcgtttctctctcctatctaatgaggaggttgtcttaagtgctcttttgagatccctttcacctctgttattctgtgattcttaggagcctttgaacttttcagaaattctctttaggaattttagccatgtctacaataacttatgatacattattcctctgcccataactgacatactggagggagaccagaaggacctacacaccggaaagaggtgggcactcttattcaagtcagacataattgatttctcactctaagcaaattctcaagaatttcggaggactcacaactatctagcacaggaaaggcgcatattaggctgctttcttttttttagaggtggggtctcactatgttgctcaagttggacttgaactcctgggctcaagcgaccctcctgcctcagccttctgagtagctaggattacaggcgcatgccgccatgtccagtataggctattttcattcatccctgtgaaaaactatgaatgggagatcattaaatagtggctctctttattatcatttgtgatgggaagaacttaaataggtaatgagtcactgtgggttctgtcccagtagtgtacctgggacctgagttaaggctgagagatggaacatgttgatgctctatcactatcagcaaggccaagccactgaaaaaaacccttttgtggttgtacagtagtggaaggtcacgtgctatggtaatacataaatctcaggaaaagtgactaaggaaaaactagtgtagaagttatatactactgaattgtgcaatttacccccccattcatgcagttcctggaaaatgagaacttaacaagaccccaaaaccgcaaaagcacttaatgttcagtcagcaaactcatgattactcattatatagaagagtttgttgttacaatagacaggaggagagaaagggtagccatgtgtcctcaggcaccaggaggaaggattgatttgtaagagttccaaacctgagaggcaatttagaagaactgactgggggctggggatgtgtgaaagttcgacttttatggattggtcatgtagtacaatattggacttcctcagaaaacttccggtgcaaaagtttcatttagctaagaaatgctacagaagtagtccctttctttcacagaatgctggcacatccatttcaggccaagatcgagaaatcacaaaatgtactgaggaagtcgatctttgttttcaggatatctgattactttgagtttaatttgggatctgtaaaaatgtcttcatttatgagaattgcctggcttgtattgatgattgctttcataaccaaatcaggtgatcttcttacaaagtaaggggaaggccaggtgtggtggctggctcatgcctgtaatcccagcacttggggaagctgaggcaggtggatgatctgagatcaggagttcaagaccagcctggccaacatggcgaaaccccatctctactaaaaacaaaaaataaaataaaatataaaaattagccaggtggtggcgcattcctctaatcccagctactcgggaggctgaggcaggagaatcacttgaacctgggaggcagaggttgcagtgagctgagattgcgccactgcactccagccttcccagcagagtgagacttcgtctcaaaaaaaaaaaaaacaaagttgggggaagaacaagaaaatccaagtccaccagcctcgttataaataggcaacttgcaacaagccagccaagtatttgcataatatacatcgtgagagcctgctggaggcctcttcattttgcatggtgttccgagcgagagttatgcagggttgtgtgcgagaaactagatgcctctttacttcttaccattgtggcatcctgtatcaattccctctgtgtgcatttctgtttctcaggaaggaacctcaaaatttgcaaacctggacagcagtgtgaaagaaaaccagaagcgtacccagaggcggctgcagctccagaaggacatggtatgtctggccctcgtcttccctgacagctcacagaggagaagggccgtgtgcgtctgggctcccacatggcactggcaccttcagtcaacagggcacccaggctttcagaaagggtctcccattctctaccccatttgttctcagcagccctgggaggtctataggagagagatgattaccctcattcaactagtaggaagtaagcactgggtggcaaatcctgttttctggcaaagttgttttctgaaggtgagggggagtctacagcaggtcgacttcctccctcttgcagtctcttccgccccctcctgcacttagaagctgctccaccttggcctgagggcctcctgagcttcctactgtagtcagcttctgatacatggtgaccaaggagaaagagtgtcttctccacagggccctggtccttgtactcagagatcttttcatttgttctaatctagccattgcccagctctccttactaatcccaaggctaaccaaatctttatagtttttcaatatttaaaggagcatcatgcctccctcctgaagactgaaagataggtattatcaactttagcttcattttaaacttctgactgttagcataaagtgtggaagaccagagggaggagattagagactgacaaactctaaatattctgctttaagagggttttctctttctttggaaagctcaacgtaagtaagaaatgtttttgaatgataggactcttccgcaacatgaagcctataaaacattcacagtgttacaaacttttttggttgttcaaagacaagctaaaaatagctgttaccaaaaaaatagattattttagtacaggatgagaccttgtacacagaatgggaaggacacactgcagctgacagtgagttcctgaaggacaaaaccctccttggtatgaacctcacaaagcagttctggctgaggaagcagccagcctcatgtcaagcagcctggctttaccctgtttgaggctttgtgttctgccaaaatttccagaattggcttgatgagatttaggataagggatccatggggaccgctttttacttttcctttaggatgtttagtgccttggtggcttactgaagaagagagatgattttaaaggagatttagtgaaatgaatatagtgtatccctgcagttgtaggtagaagtgcctccaccttcatttccaactttttattctggaataagtttagatttacagaaaagctgcaaagctagaagtgcagtttccctcattgttaacatcttctaaaaccatagcacatttgtcaatactaagaaactgacactggcataatactattaactaaaatctagactttgtttggatttcaccagttttccactagtatcttcttatctgttccaggacccaatccggcataccaactgcattttgttgtctgtcacccctgtctcttcaggtctacgacagtgttttcttgactgttttttatgaccttggttgtcttaaggggtctatccaggtattctgtagaatgttccacagtttgaggttgtctgctgttttctagtgattagactgagcttctggatttttagaaagaatatcacagagtaaagtgcccttctcatcacatcacatcaaggagtgaatgaatggtttcagcgtgacatctggtgtcatgttgatggtgacacgaatgatgttgatctttattacttggttaaggaagagtttgccaggttcttcctcagaagttactgtttttctctttccctcctctattatttgagagttagtcaccaagtctagcccaaggggttatattaatagtgatgccccatgcttttgtggtacatacttctctgtgtacaacagccaatggtgaggcaatgactatccagtgccatccccaactaccaggaatgtccccatgctctgaaagagaacagacatccttctcacttgagccaaagcaaaacataaaccccacagtcaacacttttgaacagatgtgtatgatctcctggctttgaggcttggttttcatgatttcacaagttagatattagatcatggagtttctatcctatttgtgtagaaatttaaaaaatgttattcatggaggttagcaccactggcccgcagttaggccttgaatacatccatttgctccagcttgaagattcctaaaacccctcaacttttcaatgacaataaagacagttttgctttggatgctcttcagggtgtgatgcagggaactgtgccctacctgggcaccttcctgactgacctgaccatgcttgacactgcccttcaggactacatcgaggtgagttccatgtgggtggtgtgatcgggcctgcagccttcccactggataccctaaagagtagttaacttctcttagtatcttttgaaggtccaaaagtacatggcattgtgctagctgttaggaggaatacaaagaataacaccaaagactaacaccagaagtggctcaaaatccagtggaagtaattaatatatcaaaataagcagtgaacgatagtaataatcgaaattcaaacaaatgcattgagagaacatgggagatgacaattattattatttttttgagatggagttttgctcttgttgtccaagctggagtgcaatggcacgatcttggctcactgcaatctctgcctctcgggttcaagcaattctcctgcctcagcctcccaagtagctgggattacaggcgtgcaccaccacgcccagctaattttttgtatttttagtagaaacagggtttcaccatattagccaggctagccttgaactcctgaccacaggtgatccgcccaccttggccttccaaagtgctgggattacaggcgttgagccactgcacccggcccacaatgaactcttatgaggggttgtgatgaacagggctcatgaaggagtgggtttgggtttgaacaagactttaaggccgggcgcgatgtctcatgcctgtaatcccagcactttaagaggtcaaggcaggtgaatcacctgaggtcaggagttcaagaccagcctggccaacatggtgaaaccccgtctctactaaaaatacaaaaattaggctgggtgtggtggctcacgcctgtaatcccagcactttgggaggctgagacaggcagatcatgaggtcaggagttcgagaccaccctggccaacatggtgaaaccccatctctactaaaaacacaaaaatcagccgggcatggtgacacatgcctgtagtcccagctactcaggaggttgaggcagaagaattgcttgaacccgagaggcggaggttgcagtgagccgagattgcgccactgcacttcagcctgggtgacagagcaagaccccatctcaaaaaaaagaaaaagaataaataaataaaaatacaaaaattagccggtcatggtggcaggtgcctataatcccaactactctggaggctgaggcaggagaatcacttgagctcgggaggcagaggttgcagtgagccgagatcgtgtcattgcacgatctaggtgcccagcctaggtgccagagtgagactcggtctcaaacaaaaacaaacaaacaaacaaacaaaaaaccccacaagactttaatgttgagtaggactacttggtggggtagagagtcagtcaaatttgtgatttttcaaatatgcttttctttttgtattgctgcctgctgtggggtatttttctctctctctgtctctctctctctctgtccccttgtccctctttctctctgttccccctctctctacccctactcccttcatcccccatcttctctgaaagggaaaatacatgaaaactcagataaacaacttgttagtagcagcaataaaatattaagtgaagaagaaatttcaaatttgaaatgaaattgaaagattgcttgcatatttcagtatatactacccccttgttatcatatgcaaccagcctgcttttattgtatcttaattagaagaagtagaagttactttgcatagatctacctacctttggatttgccacagtgttgtggacacatttattcattttgcatctcctgacttctatgtctcttcacatcctctttctcagcttatctcaggaaacacccatcagtgttggggaattctggggagtaaccaaagatttagaagttaaattcagcctactgagaataggagctgaggggatgaagaattgaaacttaacttttcatgatgctatggagaaatgacttcccttttgataaaccgtatgagtcaatgaccatctgttttagttgcttttggtaagggaaaaaagtgtaatggaatatttactcaagcttttatctttactggttctgcaagtgtctttggatcctgatttgtaattatttatcattactattttagttggtttcagacatttcaagagaaggctttctgcttatcctgccttataataatactttttttaaaagcaaaacaggactctcttcttccacagtagtcgtaattataggatcattgataattgtgactttatcacccctttgatctattttaatgtgacctacgacaacatatggctgtgttttaaagtagcttggttgctcactctttttattaaaatttcttttagggtggactgataaactttgagaaaaggagaagggtaagtagagttgttggctgtgtttcctttgtctgagcatgaaaaaaatgaaagaaatggggacttaagtttttttgtagaggcagaaaaaaatgagttagcacctactgaacgtttatcatataccattttgcttggcattctcctatacattatcccccactagccttatgaggtaggttttatcatcctcaattcaaaggtgaggaagctaggactcaagagattaaattactggacgagaatctcttggtggcaaagccagggttctcatcctgtcctgatgccccaaagcccacatttcttccctgcccactccttatctcctttacaattagcttcagcaatagcaggcttgccacttaattaataacaatgtattttatacttgaagattactaagagtagactttaagtattctcatcacaaataaatatgtgaagtaatgcatatgttagttagcctgatttagccattccacggtatatacatgtttcagaacatcatgttgcacaccataaatacaaacaattttttaatttgccaattaaaataaaaaccaggtttaccctattaaggataaggggtttctgatgagtaaatgacatagaagagttaataaagatggtaaactctcgtgggtatactcgagagaggaaaggaaatggccttcgtcttcggtgtaggtagttattctttccctttcgtgtcagcataggaaggtgtgctcaacatcaatttcactcttcctgtggatagcacagttctgaactgtgctattcaagataaaacagtcttgaaatttttctgtgattttcatattcaaatggcatatttaaatagatatttaaaagactcaaaggaaaatgagtgagcaaaataataacttcaccctgtagtactctcgttatttttcagtactttcacattccacaaatattgactgtctacctaacatggggggggtttgggaattacagcagagaaagaacagagctgcctgccctcgtaaagttcacaatccaggagagaggtagacaaataaataggcagttataatacaacctgaaaagggtttgtgagcagaagtagtgggtgttagagaagtatataggtggggtatctatctccaacttgtagggccagagaaacttccaggagaaaatgacgttgaagttaaaaccaaaaaggcatagaggagctaaacaaagctgggcttatcagaacaagatactaacctggacaaatgtaaattttttgtcccatatagacgatacttttttctttagcatgatggtaaatattccttgaggatactgagaccaagggccgaggtcactggatggcaagttgagacttggagaatctaccagttcttgagttacttctgtcatgtcctgtaatgataataaattcagttattgccccctcagttcccctctctgtcatttaacttcagaataactgtggttggtaatctctttcctttttagactaggatattaaacttctggaaagtttgactgtaaaacctaaacctaaagcttatacccattgctgacttaaattttttttattgaaacatccaaataagtataaataattttcaacataattatgtacttgcctctctgtgagttttaaaagacttagttaaatgatttagtggcgtagtaaaaacccaaggattcaggaaatctaaacattcaattttatgagacctaggactgtttagatactcagccctaccaaaacttatttattgaggggtaaaggttgaggaagatggggatggggatcttgggagctccctgacttaaagtatttcttttcttttttttaagaaatatgaatagaaattaatatattttatgaagtacttaaaaccttaaaaatcatttttctattccaaggatgaaagtgaagaagagaaaaaggaagccactgtaacttaacgtagtgactagtttgggttgctttggtagcttgttttatacaaattgctttctcaaggagaaaagaggattaaaaattaaagcatacaaggactttggagagttctagttagaatttttaagagttagttagctcctttatttttaaggaagcagtatttcagaatcctcctagatggttttcttcatcttttatcctaatgtggtatattttcatgttgaaagattctatatttggttggccttattattcagtcttttttttttaatttttggtattctgtctgctttaggaatttgaagtgattgcccagataaagctcttacagtctgcctgcaacagctattgcatgaccccagaccaaaagttcatccagtggttccagaggcagcagctcctgacagaggaggagaggtgggatcacctgtcgttcatcggggtagaactgaagtgttggcaagaaaaatgctgcatttaatacctcgctgggtcatttattcaacaactatttagtgagcagctgctaggttccaggtccttggttttcaaaggcgcatggtgtggcaggaaaggctgagttgatagcatcaagatgtactttcagactcttgcttggccacttatttatctttgtaaccttgaacaagtcatttgttcttccctatcttaaggatgctcatctgtagaatgtttgtgaggcgtaactaagatcttatgtgggaatgctttgttagaatgcttgtcctcagcgttgtcaccaccaccactgtcactgtgtttgtcattcctgttaattgatggtagctttccaggaagctttcaacctagaggggttgagagactcatgaaactttgaaatatgatgggtaactacattcctacaaaacctatgggaagaattggggaaaataaggaaaatataaaggcattaatatttaggctggctgtaaaggagaaacaagattttgccataagaaccggaagagaacattccagaccgagagagaacacaagcaaaagcttggtggcctgacatgtttggcatttgaaggaacagtgataactcaggtgtggcagggacacaaagaacagtttaaaaatagtgggatgggcatagaaaggcatgttcacttgagtgccctgcctgctggctcagcacgtccctgtcctgtagcctgctcgcttgttggcagattggtctgcaggccatatgtggcccactgcctgtttttacatttttaaatgattggggtgggggggaacaaaaaaagaatattttgtgacacgaaacagttatttgaaattcagatttcagtatctacataaatatggttttattgaaacacagcccgttcatttacatctcatctatggttgctttcatgctgtaaagacagagttgagtagttgcaacagagaccatatggcccacaaagcctaaaatactatgtgatcctttacagaagaagttggcccatccctaccctagcccaggggatttctttggaagtttatcataagggagagtgaaattgacagcaaaataagtatttacaaaaaaaaaaacttgaggtttagagaaatatttgaatgaattaatgacagcatttggattcaaactcaggtctgcccggctctacagcctaagctctgaagatggctgtataatgttgggcacccttccccacctactcagtaacgaaatacatctactgtctacagctacaagctttcataaaaggcacttggaatcacatataaattcctcttgtgcttgtgtcagttatatctgcctggcagatagaggtctgaatctggagcatttttaatttaggaagttttggcaattaaaaatttaaaaaagtatttgtaggccaccctggccaacatggtgaaaccccatctctactaaaataaataaatatatatatatatatctttatcagtaatgtaattgcctatgtctgttcattgacgatcagatagattacaaaagtctcttcattttctttagataaaactaagtcatttgtgcatgtgcacaaacacacatacaaaatagtaggaaggaggtaatagagaagaaataggagggggaggtagtagaggaaggaagattcttccactggcctagcagtgggatgagaatgatcagaatggagttagtttttgatgctgccaaagtgcatatatccttgtatttgaaacacgcagaactaaatagcctcaatccatatgccagtggaggtgagggaggaagcacataagataaatgtgtcaaatcgggccgtgaagtcagtaccccctgacgtttatgataggacaacgtttgtatatatctttactttgaacaattagagccttctctaaaacaaaaccaggacatcatgtgaatttaagtgtgtttttcaattctctaactttgacctcatggagcccccttctctttctcagctatgccctgtcatgtgagattgaagcagctgctgacgccagcaccacctcgcccaagcctcggaagagcatggtgaagagactcagcctgtgagtgtcccctgggggttctggggctccaagagggtgccatcagagtcgtgagaggagatgtattcaacaggatgaccttgagccagggtgaaagtgaagagcactccgctcatttgttaagccgtttatccttctgtcatgaactcaaagcatttgctgagtccattcttctccactcccctctctgttgtgaatcaccattctctcctgcctgaatcactccagtaacatcttcactgtcttctggctgccccttacccaaccattcattctccactaaatagctaggttgtcttttaaaatgtacaccagattatgttgcttcctgtataaaaacccctatagcttttattttaaaataaaacccaaactctgtatcctggtttactaggccttacatgacttaacctgcagacttccctctcttacaacattgccctctgttcaccagtgttgaagacgtttgcactggctgtgcctggcctgaaatgctctttcttcatgactggctccttcaaatattagcaaaaatgttatgtgccaagagagaaccctttctaatgttgctgtccacccctcattctcattcatactagctgcttcctccagtggaatgtaagcaacctgagaacaggaaccttgtctatcatgctcgcagttgtattgcctgaggccaggagtttgagaccagcctggacaatgtagtgagatcctgtctctacaaaaaaatatcacttaaaatattagctgggcatggtggtgcacgcatgtagtcccagctacttgggaggctgaggtgggagggttgcctgagcccaggagttcagtgttacagtgagctatttttgtgccactgcactctagcctggatgacagggcgagaccctgtctctaagaacaaaacaaaacaaaacaacaacaacaaatatatatatatatttatacacacatatatatatacacatacatatatatatgcagtacctagctctcaatatgtgcctgaaaaaccaccattatttttaatgaaatgaatcagttaatatctttttgaggatttggggggatcaggattctgactgtctttatgggcatttgatatttcccagcactgtctctccacctacttcagtgagtcacattgagacacaggcagggatggcacatgaccttgagtgttgccatgtccccggtgtaacataaagacctctgctggatgtggatagcaaggtctcccaccatcagcggccacgcaggctgctatctgccatcaggtgatatgggtggtatgaggcattgtgggtgggttggaacatgcgctttagtagaaagcatctggaagatcatcctgtgttttgctcaccctctctttgttcagatgactgtcctggccctgcggaactctagatttatgagcttttggagtcagctcttgaggagaatttttcatagtatcttgctgtcttttcatctttgcagatatgggggaatgaactactgagataatctgaggggcctgaccaagccttgtcagctggtaagactggcatgtgcacagggaatcagctccctgatagaggagtccagacatgcaggggatcctgggtgtccactctgctcactgaggcagcagaaggaattgggagcttctggacccactatggcagtcagaggttcttaaggaaaaaaacaaaaattctcaatgcaggcaggcctaatcctgcgtcctgctacctctatcctcctgccttctccccatcctcatttctatgctactgcttctctgtactcctctccaagcccgggatctatatgttttgtggtgggagttctaatacccctggatcctctgtcttcactgacacagacaagtggtcagtcctatgaaaacatttactgtgaaatccagagagggcaggactgtgagggtgctatgcccttcacaaagtgtggtaggtactcagtacatctcttactagtaaaatcttgctgggataacccttggtatctgcagttgagtttgggcatctattatgaaagcagttcatatgcccccatcttatttcttgtacatacaagggtgtttgcataccattatttttcaaaagatttcatgatcttcttagcatgtttacaaatctgggaaatgcatttttgctgttcccacattcaatggctcatcattccaaagaggttggagaaaactttgggtgcttaggcctagtttgaaagttagagatgcctactactgagccagaatgaaccttcacaacgcaggacaaagcaggaccttactgaattgtagaaatggaagaaccctagagactctgagataatggatggaggaccactagttgacatcctttcaagatctacctttgtaatttatgaagcagtaagaaagggcattatttttgcttctgtgatcagagtttagctcatacccctatagtccctgtaatgctcctgtaatgcttgaagggtcataaaaggaagacagggaaaatggggctggagatagcagggtagagataaggcagagcaaaaatatgcttgagctcttggaattcaagcatataattccgaaaatatttaataaaaaatcaagttcaccttcattgtttctattattgttgttattttatagtcagtacttgtttaggttcagcccacgtgctagttgccttgcatgccgttccttcttaatctgactcccgccctccttttaccactacttgtggtgtaaatctgttaacggtaaaccttctcagtcttagtctgagaaagtctttattttgccctccttcttagaattatattagacgggtatagaattcaatactgactgttactttcactcagcactttgacgatattattcagtgtcttttgacttccatggttacttttgagatgtgtggtatctgcttaattactattcctctgttttatgttcccactcctgttgcttttctttcttctttccttccttccttccttcctcactcgctctctttctttcaaaagagttttgctctgtcgcttaggctggagtgatcttggctcactgtaacctctgcctcctgggttcatgcaattcttgtgcttcagcttcccaagtagctgggattacaggcacatgccaccacacctgggtaatttttttgtattttggtagagatggggcttcaccacgttgcctggagtggtcttgaactcctgaactcaggcagtcagcctgcctcggcctcccaaagtgctggaagcactttgagagccactgtgcctggccccctgttgattttaagaatttcttttgtctttgatataccagtttaagtgggagtttagtcttaccctattcaggacatggctcttggatgggaggattcctatggttcaccagttctggaatcctctcagccaccatctcttctgatatgggccttcttccatcctctccatgtcttctggaactcctcctacacatacctggggctttcttactgctttctccatatcttttcactgttctttctatgtctttatcttttgatgatgatttttgaggattttcttcagatctgtcatctagttcatgatttttttcttcaagttatttaatccttccactgaggttttagtttaagtcaccacctttttcacttagaggtgaaatgtttttcaaattatcttcttcctttattaggatgtcttgctctgagctccggttttcaatttcttcttttatgtctttaatatttcctaacatacttattttgcagcttggcttatagtagacatgcagatatttgttggatgaataagcacattattagttttgttctgacagttctcaaatttgaagttctcaggagtctaagcctgctttttgttatgcctgttggctctctctttcagtggaatatttccttgtgtgtattttgtaattttgtatcacgagtttatctttatcaggggattctctgaagcctgggctgaaggtatatccctcccgcaagattttctttttttttaagaaaaaatctagtttactagcggtgtcaccggttgagagtttctaaccccatagaccacataaatagcaaattggagtgaggcacagacccagctcacacatgacttcataggagacatttttcttctttccatgctcaggcaagaacagtctccctgttgtcttcctatgctagtagaaagatatttttctggcctatctttttagtaagggtatagccctttgtgggccctggctgtatatagttttggttctaactcctcaccattcataaacagaaaccctcatctttgggccctgggtgtgcattaaaacccatatcactattttgccaagattggggcctcccactcccccaccagagcagctgcagaactagctcgcgtgcttctggttttcagttcctttttcacttaaggcctgtagggatttcccttcctatcttgcaagctcaactaaaaagagtttttaatatttcttatctagctgttttatagaggaagcatttaggatactgtagttcacagattgttggaaatagaagtcttcctccttggtttcttacccaaagcagtgccatcccttctttgcctgtgaagatcattttatggtaggaagtgatgggggtatgctgatggtatcttgatcctgccaaggtggtccatagactgttaaaatgtagaggaccattgacctagaaagacttcagattagtactgaataatctatgtgttctttgaagttggaaatactcttttgggacaagatgtttactactatttgttagaaactttatagcgaatgtcctcctaaaataataatgacagaacacacaagactgaaaaaacatcaagggcttaatcaacacaaaatatttgcctaatcatggattccagatttgtaacagcccaaatgcttggcattctgtttttttccagactgtttctagggtctgacatgatcaccagtcccactcccaccaaagagcagcccaagtccactgccagcgggagctctggtgaaagcatggactctgtcagcgtgtcatcctgcgagtcgaaccactcagaggctgaggagggctccattactcccatggacacccctgatgagcctcaaaaaaaggtatatactcaacccttctcataattcctaatgcaggcacctacatgctctttgccacaccacagcaaggaatgtctgtttttaagtggatcactctatagtattttgaaagtcatgttttgaacaggcatcaaaagaagagttcaatttggggacatactactaatagaaacaggtgtaaaagcactaagcagtttcgtttattcatttggcctttgaaatattgttctatacccacctcttaaggcactggagttatttaggggaagtaggacttcttagaaagagcaaaaagtcagagatggagatgtgtcaggttcttggtgccatgttttgtcttagccaagcatttatcacaataatgttgcattgcatgccactccaaaagtcagtgacttaaaacaaccactatttatctctcttatgtatctgctggttggctgatctaggttgggcttgacactaggccacagatttggtccaggtctgttccacttgcctctcattattgttggagtaacgggctacccagggcatgcccttagcatgctaagacggacaagcaagagggcaagcccactcgcaagcatatgtcaagcctttacttgagtcgtatcaaccaacattctattggctaaagtaatcatgtggccacattccacataagtaaatgaagcagagaaataggctccagttttagtgggaggaactctgaaatcacagtgcaaagggcacagctgcaggggaagatgagggattggtaacaaggatacattctcccatgttggaaaaaaggaaactgatgagaggtgataaaagaatttccgtcgagtttctattttctgtgactgcataaataaaaatttaaaaaccaaaatatcttaatcttaagatcttaattaagaccagtcttcttttttttttttttttttttttttttttgagatgaagtctcactactctgttgcccaggctggaatgcagtggtacgatcttggctcactacaacctctgtcttctgggttcaggggattctcctgcctcagcctcccgagtagctgggattacaggcatgtgccaccatgcccgcataatttttgtatttttagtagagatggagtttcaccatgttggccaggttggtctcacacccctgacctcaggtgatccacccacttcggcctcccaaagtgctgggatgagccaccgcaccccaccaatatcagtgttaatcttctgtacacatctgcttcaatctgttggttgaagggtttggatcagaaagtcaactatgacataactagaatttgcaccatttggggaaggtttctggctaaccaagcttactcaatagtgacttctggctccttagcttatggttaggtcagtaaggtagaatgttggcaatggtttcatcccttggtttatatctgctgctcttcaaggggacatgtgtgttgcttcacatggtgttaaaacaacagtggtaatcctggaaccctcaagtgactttgtcataatgtagccaatccaggaaaagcatcatattcaggattcatcaaactgagatgactaatttgctgctctagttggatttcttagctttctgctttgaaatccaggggatacaatcattcatgctctaaatattgaaagaaagccttcgtggacacctacggactggccatgctctcaaaaggcatttttcctcaacccgggatgtagtcattcttcgtgacttgacatacaaattagctttgtcaaaatctggaatgcagtctcatcattcactttttcacagcctctgaggttttataggctccatttctgatggtagacattgtaggaaagtaataactgaggtattgcccacattattgtgggatttctccctgtctctccaggaaggagatggaatcacagtcacaccttgtggcatagtggaaatgtacattggtccaaatggtaccttttaaaactatgcagaagcccagtgtgctttctcctgcacatcccttgcttcatcttttttgtctcatccctcatcagactggctttttaaattcttgcagaagtcatggctctttattctttggatgaacctttctcagagtcatacatttcttaaacatcagtgattcacttggatgcaagtagctcctggactgcacaatccctgcatattagctagaaaggctcgtgattctcctgcttggcacatagctggactgagctgacctccacacttccttcctgacctgagagcctgtgacagccgccttctccaaaagtcctccagactgtcattcttccttttccacaggctgcactgtgaggttgctcttaagggtgaagtgtaatttatttgcattcctttcttcattccccgatcatgatttctaaatattgatttttgcacttgctcctcacttcttaaattctcaataggaatttgggggctcatcaggcagtctgtttagagctgctataacccaggcatattctaggctttatcttaactataaatgtcactagaatcatagaaaaatctaacaaaggaaatagagtttggatagaggaacatgaaggcgaaaaaattgaatgaataattggaaaatgcacccccttaactaatatatctgcaaagaaacttatgctattaacttatctatcatcagttagtcctcaaattgagccactaagttgattcatttgggaacataaggaagaaaaaaacccaaaaaccaaaacaaaaactaaaccatattatgatagagccacaatcagacccctacccatgagaattgtcacatcagctggctggctgtaaactaactgtgcaatagaactgaatgtataattatgccacaggaggaaatctacaggaaataagataatagactccattttaatcagaagcctgataaccagaaagctcaacttctatactgtttccatggaaaggcagataaatatgaaagaaatgttatttattttataaatgacttccagaatattttataggattaacatggtataatttagcttaagtcattccgggaaattctttataattttctacaataataatgggtattttaaatggttcaatttaatgatttttaaaagtacctcttccaataacttctttctttggttattggtattgcatggatgagaaatgtgtagttaatcagaaaagcatattaactgtagtactccatttcttaattgtccttgatacacatcatgaaaatgtatacagttggctctactagcaaatgtggaaagtggtgaagctgcttaaaggctgtatttcccttgagcaagtcacttttatattctgaatcttattctcctcgtctttataatgctctgcattttgttcacaagacagttgtggaattaaaatgggataagataatatgaaagttcatgataagcctcacagtactaaacataccgaggtagcagcatactatgttgattcatcttattgtcatcagccacaggctgagccttggccatgtgcttgctctgggaactcgacagtgggaatcagggagcttgggttcctgttctaggggtgctgtcaactagctgtgtggacctggagccccagttttctccctgggtctcaggttcctcagcagaacaggtatgggactagttgatgtccaaggcctttctagcactaatattcaatgcagagccgtataatctggggtacttctcttagaaacttctaaaaatacagaactttctctctcactacgaaatctgactgcagtaggactgaatcaactgcgttggcaaggctttcctccagccccgtaagcttctgacttctttgggaacccatattgcctccagtttctggtgtctgctgccacctgctggttaacttctataagaacagctaaaacctagggaaatagaactgctttgcctcacgtgcttatagagtgattaggtcacactgagtcaccgataggcatctaccactgatggggactcagagtacttacaccagggatgagacacatgtgtgctgtgggctgttgtggaggaaataactgcagtctatcagtcttgatatctacctctgctttgaaaattgcaaagctgttggccagcgttctaatctgttttcttctggggtgtgtttactcttccagctctctgagtcctcctcatcctgttcttctatccattccatggacacaaattcctcagggatgtcttccttaatcaaccccctctcctcccctccgtcctgcaacaacaaccccaaaatccacaagcgctctgtctcggtgacgtccattacctcgactgtgctgcctcctgtttacaaccaacagaatgaagacacctgcataatccgcatcagtgtggaagacaataacggcaacatgtacaagagcatcatggtgaggagcaagccctgacccaggagcgggtttccatttagattgtgtgtctgtgtctgtcggccgctcagactaatagccctaaatatgcacactcaatattagcatatacatatatgcattcacacagaagggatgtgtgtcagttccaggtctccctgggcatagatgctgaatgatatatgtatataaaatatatatacatatatatgcacacacatggtgtatataggatataattttcacatcttaaagaaatgctaaaacttattcgtttaggtcagtattagccatttgaaaattctcaatttgggtgacagtgtaaatgtgctccagggaggatgacacaacctcacacatttttggaagccttcctatggaattatatgtctggttttatcattgaatttccacacattcttagcagtgtactcccctgatggcagatttttgtcatttagtcatttggatcaaacctagttaataaagtggatgatcaagctagaaatacagtttgggttaatgaggaacgatgcctataaaatgagactgacctttttgagcttcttgtaaaatctgtgtgtttctgaggacaattgcaaagatatttttaataatggcagtcttttgggaatacacacagagcctctcatggcgataaccttgggtatgtgaggtctggtaggtttatcacaagaatataaactccttagtttatgggagataatcatgtattggaaatcactttatcctttgcagcaaaatcccacagctaattccacatctctcctcatctttatcactcgcctctttgaaggcacactcagtgcttacaagctcaggtctgaatatggcataagtggtatggaggctccacataaaagctttgctaaagcatttattgagtcaacaaaatatcaaacatttattgcgttctagtcattagatcaggctttggggatagggagatgagtgagacatttctgcctttgaggaacttttaattagaaagggagcccacaaagcattattcacaatgtgcaaaataatagagccaagatcaggtggtaaagggccttgtggcccacacagaggagtgtgttaatcccgcaggcaatagggtcttgttgaaggcttttaagtagtgatgggatttgctcattaagaaagtcatggcactgtgtttgctggagtgtcggggtagactggaggcggggaagcaagttaggaagctgctatcatgttccatgtaggagaggataagggcttgaatgacggtcatgtggctggagatggtgaggatttttgaaagcttttgatgaggtagaattgtagaatccattcatttagttaccaactttttggttactgttgtggaggactagaggctgtctgggtagttggtgggtctgtgagatatgaactaccagaggaggatattcagggacatttaaatcagaggtaccagtatgacatcagatggcattgtctgatagatggtcagaaacatgggctggtgcaaggctggtgctgagatcaaatactgggagttgtcaaaccccacaggggggacgtggtctcgcgagactgagtgtaggatgaggcagaatgcaagtggtaatgagggaggggctaataaaggagcacccgagaggtagaggaaacacagggaagccaaggtcctccatgtggttactgcctgctcagcatggtctgttcacctggcacctcttacctgcaccaatcagagagaatgtccactgcataactctacagtgtctctgaattatagcatggatttgtacaccaaacagttatgttttgggacatgcctggtcagcgtgcactctgctcagtctggggggaactgtgagtggttggactgcacaaacctctactgcccaggaggagtcacaggttgtgcatgctgtctgagtgttgggagggtagtgagcagaagatcccctgccccctgctctgagattcctccttccccagcaaatgggctgcctctgtgagaatcacctctcctgccaaccccttcctgtggccctttatattgcaccaggtggtggcactcacctttcatgaaaatcctgccagcgcatgtcacaggcttattctggagagacgacacactgctctcgtgctctcattctaatcgttaggcctctcaggagaaaccttgctcacaggacgtacctttctgaaatgtattatgctgtgtgctgttgaccagaagatggaaataaatcagtccaggttcaggcgagactagcagttctcaaactttttgttctcaggacccctttatactctgaaacagcattgaatattccaaagagctccagactatgtgggttgtatctgttgatatttaccacattagatatttaaactgagaaactttcaaaatgttgattaattcatttaaaataacaataatgaacacattgcatgttaatgtaaattttattttttaatgaaaaatatctatttttttccaaaaattattgagtgagaagtgtggcattgttttccatttctgaaagtctgttaaaatgtgagtgagactggctttgttttgttttgtttttgtttttactgtgagtacagggtactgaagaatacagtgacagctagtagatttgtagttagaaaccactggaccgatttgtgctgttgtgccagcaattccatccaccatagcttctgcaatacctatgcaaatgtcaacacaaagaaaagacaaacagcatcttagtattatcatgaaaataattttgatctcatggatcccctcacagatttcagggaccccacgggccatagattgcacactgagaactggtggcctagagaacttgctttgcaagagcaactaatgtccctggaatccaaggcccttccatagaagaagagacagcaattagcccttgtaaaattacctcctcagtgaccatggaaaaatgtcttctaccactgaacccatcactctttcgaaatgatctttctctccattgtgtcaatcacagagtcagtctcccaagatcccttacacagggaatgcagtatttctgtcacaggaaagtcaatgagggcgacaccaaagcatcgttcagtaccgcgcattcagtacagcagccactggccacgggtggcgatggagcatttgaaatgggaatactccaaattgagatgagctgagggtaaaatatataccagattttgaacacttagtacaaaaaagtaaaatactgcattaacaatttttgtattgattatatatgctgatgtaatatttggggtgttcaagttaaatatcacctttcaaaaactttttttttttttgaggcagagtcttgcactgttgcctgggctggattgcaatggcacgatctcagctcactgcaacctctgcctccctggttcaagcggttctcctgcctcagcctcctgagtagctgggattacaggcacccacgaccacgcctggctaacttttttgtatttttattagagacggggtttcaccatgttggccaggatggtctcaagctcctgacctcctgatccacctgcctcggcctcccaaagttggtgggattacaggcatgagccacctcacccgtcctaaaaactttttaattgtggctactagaaacttaaaatgaaatatgtggctcacattcgatacctatgagtgctaattcagtctatcagcataaggatgcacgcttgagctgtgaatactcattgtaatcataagtttgattcagcatcgctttgatggtacaaagtaataaacacgcaagggaaagcccttggtcatcttgtcttcattgggacatacctggggaagtttaaggaaaggagaatgaaggtagcctggctgtctcatatgacttacccaccttagcctgacatgcatcccctgaagggaggtcttctcctttagctttctgctactagtccagtgtgacccagctttgggagtattttcttcatactatcaaaaacatattttcctcatttagaattttgtgtgcacctacttttcccttgtaaatgaatatgccagatgttttggtaacagacacgtgaacaagatctttgctgcttacaaggacccctttgtaatgcacattgtttatggaatcacaaacaccagctgctgccccagatcagagtgaggcatcttggcactgccatcctcaggcacacaatggcagtttctgggaggaaatgagacttctgtatgtgtcgaggggggtcgtggggggctttctttctatagtcctcttgccccctggtgagaacagcttttatttttaagtaagaataatctgagttttcattcacttctttcaaacttaaagaaatcacccaaggtatggtacataatttagctttcttttcaggttgctctgcacaccctgcaaatagttggctggcaggcagtgaggtgaagggaagaacatcagaattggggacgagggaaacctttaacttgtgcttttaaaacacttacaagctgatgtttattgaagcataatttgcatgtagttacatatgcagatcttaaatgtttgattctttgagttttaataactatatatatctatgaaactactaccccaaatctagataaagaacatttccatcctgcctgccagattccctgtgccctttccaatcaatcccctcctaacctagaggttcattttctaatgccacagattttgtttttcctttttttgaaagaatagactccactggtatgtaatcttttgtgtccggtttcttttgcctaagatgatgtttgtgagattcacctgcattgttgcatgtgccagttcttagttcccttcagttgctcagtaggattctattatgaatatactacgatttattctcttttcctgttgatggagattcagattgattcagtttttagctattgtgaataaatctgctatgaatgtttgtgtacaagtccttttgtggacgtatgtttttattccgcttggtaaatgcctaggagtgggactgctgaatcacagggtcacctgtactttttgaaatggtcaatgggcagaactgcgaccatttttatcccgtgggttgtaaccagtgccatagaagcagttcaacatgggaggataattttgggccaggactaataatgctttgcatttttcacaattccctcatatatattctttcacgggaacttcaaccactgtggaggagataggcaaggaaagcgttctctccattttaatagcggatgacgctgtgactcagagattaggtgactcgcccatcatctgtggctgctaagggtagaaccaggactagaaaccagggatcctggctcttggtccagttccaattccacgagtccgttctttctggaaaggcatcacaacacaagacagcaagaatgagagggtcaggagaactccctcaggaaacgtgaagctaagtactttacaaacctgttcattgtctttgcagttgacgagccaggataaaacccccgctgtgatccagagagccatgctgaagcacaatctggactcagaccccgccgaggagtacgagctggtgcaggtcatctcggaggacaaaggtgggcatccttccgagacaggcatgttccttcccagggcaggtggctagcacatgtccacagtgctccgcgtttagaaggcagaaaacggatacgtattgttttattgggacctagtggtggtttttgatagtgcaagggtgaacaaccgtgccatcacctcacttgtggaattaagtatctcaaaccgctctccgattccccagctcttgtttttcctgcgattttgatgagtatttcttctgcccagtctttctgagctcttcaaacacttttctaggaagaagtgtctccctgtgccaggaggcagagggtaggggagtctgttgggcattgcaggtggccacacacctcctttacccaagaatgtgtttctaagttgtgtgtgaatctgaaatttagtggttcctgtaataatttctcatcatttcaattaatcatgtatgaaaggtattttctttattcatgatcaattttaaaataacacaaacctctaacttgaaggttatttacctcacatttattgaggcaaagaactggtaatctatgaaaggcttcaatatgcctgggaacatattatttaaagaaatctcttttatgaaatactttttgggggaaataatcacccttgcatgtatctgtctgctaatatgaatttggggattgtatttgttgagagaaggaaacaggctggtagaaaactcctctgtaccttgtcacttcacagacagtgactgtcaggataggtctcttctccaagtgcagaaggagcagcaaatattgttgaccgaagccaaccctttctgccgccagaccccaaactgtccattgcagccaccttaagtagtcctctgctcaccaacaagcagtgtcccctataagtgagaagcattccacaagctaggctatgggatcagcatgtcacccagggctctattgctggtttagaggagagtggctgaaattagaatactaccttctcctagagattaaaagctacagcctctgggaaaattctttttcagtttcctcttggaagatttctcattcattcagctgagccttaggctgtggggcaacactttctcagttataaccttttgatgtaattataattataattctaagcctaaaagatggtctcaagttgtaccattttgcttacaacacagcactaaggtgaggctggtgggtctaaaggtccaggagtctcgaggggtagccaggacccagtgttgcccaccagctgtgtggtcctaaatgcaagctgctggacccccgggccttggtccttaattagagacaataccctgctggttcctcatatatcacagggcgattctgaagataacaagaaatcgtgtacctgaacatggggagacactaagtgatatataactgtgaggactattattactgacctgtgagtatgtgggcagcagcatgggacactttgaggggattgttctccgctgagcctttgtgcacagaatgtacaggagtcacttggaacctgctcatatcagtcttgttgttggatatcaatgtttgaagttaacttaagactcaatttgtccagttttacaaccatatgcctctctggttgcctccccgaccccactaccacagagctagacttgcacattttaccttttttaattctgtttgttttttcaaatactcattacacttgagtgctaaatactgtataccttcttgtggcgattactcaaggatctagaaccagaaatgccatttgacccagcaatcccattactgggtgtatacccaaaggattataaatcattctgctataaagacacatgcacacatatgtttattgcagcactattcacaatagcaaaacctggaaccaacgcaaatgcccatcaatgatagactggataaagaaaatgtggcacatatacaccatggaatactatgcagtgataaaaaaggatgagttcatgtcctttgcagggacatggatgaagctggaaaccatcattctcagcaaactaacacaggaacaaaaaaccaaacactgcatgttctcactcataagtgggagttgaacaatgagaacatgagaacacatggacacagggaggggaatatcacacaccggggcctgttggggggtggaagactaggggaaggatagcattaggagaaatacctaatgtagatggcgggttgatgggtgcagcaagccaccgtggcacatatatacctgtgtaacaaacctgcacgttctgcacatgtaccccagaccttaaagtatagtaaaaataaaataaaaattaaaaaacaaaaataaaagtgaggctgggcatggtggctcacgcctgtaatcccagcactttgagaggccgaggcaggtagatcatctgacgtcaggagttcaagaccagcctggccaacctggtgaaacccgcctctactaaaaatacaaaaaaatacaaaaaaaaaaaaaaaaattagccgggggtggtggcacacgcctgtaatcccagctacttggggggctgagacaggagaatcacttgaccctgggaggcagaggttgcagtgagctgacattgtgccactgcactgcagcctgggcaacaagagcaaaactccatctcaaaaaatataataataataaataaataacttaaataaataaaataaaactgagtcaaaataactttgctttgatgatttcatattacacttggaacaatccttgttcaaaaattacagatgtctagttgggaatcattgaaattgaaaatagtttaaatattaaaagaaggggatatttgctgcaatatttgctgctccttctgcacttggagaagagacctatcctgacagtcactgtctgtgaagtgacaaggtacagaggagttttctaccagcctgtttccttctctcaacaaatacaatacccaaattcatattagcagacagatacccaggaaggggagcatcacacactggggcctgtcagggggttggggaaaaggggagggagagcattaggacaaatatctaatgcatgcaggacttaaaacctagatgacagattgataggtgcagcacatgtatacctatgtaacaaacctgaacattctgcacatgtatcccagaacttaaagtaaaatactataaaataaagatatgcacgttcagcacatgtatcccaaaacttaaagtaaaatttttttaaaaaaatatacatactttcctacatgggaaataaaatactcgtttgacgggattacttcaaaaaatatttcaatatttcaagtagaattctggagtgctgtagattttctgttttttctatgtcattggattctcttagtctttgagaaaatctgcatactggggtggaaaatggactgcaggagaaacgaaacccgagttcaaatcccagttctgctattcactagctgccatcttgggaattttctttaacttttcttggcctctgtttcctactgtactttttttctagttttaacattttctattggaacatttaattcatggagcgaatttctaaaatctcatttgtactaattttttaaattgggattgagaagctggggccaatttttggggtagtgatggtgatcactgtctggttcaggtcacattccagagatgaagggccgtagtcccgttcttgtgtctgggcaaggtttacagctgccgttgtcagtactgagctgacctccacaagctgaccatcttatctttccttatctttttcagaacttgtgattccagactcagcaaatgtcttttatgccatgaacagccaagtgaactttgacttcattttgcgcaaaaagaactccatggaagaacaagtgaaactgcgtagccggaccagcttgacgttgcccaggacagctaaacggggctgctggagtaacagacacagcaaaatcaccctctgaagggagggaccagtggccccttgtttgccaaaggcagagtggggctgagaaacaggctgcggtgattgcaattaccatccggtgttcgaggatcattggtgaagtcagcagatatttattgagttcctgtggtgtgcaaagcattatgataggcaccgtggggaaactggaaatgaatttgacatgaaaaggatgaacgattcactgattctctttgactcatttgagactaaaatgcagaattaccaacatttaaaacatatatatgcacatgtatttggtatgcatgtgtatctatataaaaatatataagagggactttatgggatagtatggactatggaaaaacaaatttgcacaatggcctgggaagttgaggtcactttttacagggaaatagaagaaactgagaacctagtctcgtatattctgagtaaatggaatcagtcctgggaatagagagtgtcctttgtgccagtattacaagaagcccaaactttatttttataaagggagaggatgactttctcaatcaagtgccaccagataaaaacaactgcagaggctggaactgccacaggctgtatgaaaggccactttggaaagggtttggatgagctggtggccttcaacctctgcctgcatctgccactttctgctaccctagggaggccaggaggagcttcggaggaccatcgccccactggtctagccatcatgacacctctggaggtgtcaagctcctgaaacaagctcatttcagtttctggcaaccccgtgtatttccgttttccccctaaagaacatatcataatcattgcacaaataaccatgttctttggtaatgaagccagaaaagaaagcgcaaaagaatggtgactcatttggactcttatctgtcttggaatgtcactgcttcattgccttctctgattgccttttgcatgtaaaactatgtgtctggagtcttttgccatctggatcttagtacctctttattatgtgcaatttattcctcaggtgtggaaatttctactgcaattgactacgtttgattattttgagcttgtgaaagatttctgaacagtgattgtcccgttaatagcccctcagaagatgttccctgctgataacagcatcctattttacttacttttatagcattactgtgcctagtcgtggggaaagagatggggctgtatagattatctgaatcatttgtctaagaggtacattcttccagatggaatcaataacttttttttttccaggttcccgtgcttgctatcacagtatcattgttaagtgacacttttgtctctcataacaccatcacactcttccttccaagtctgagctgtgctggggtttgaactaaaagccatatgtggaatattgacatgtgtaagaagcactttcagaatgttgtcctttttaagaaatgattctcaaaataccagtttttattccaaaaatttagagaacaaacccggaatatgaagtgcagattgtaacatggagctatttttttttcttaatcccataatacagctcctaaaagttgtgtgggatttgcgttgcataaatagccatgtgaattccacaagaagcaccagggaaagtttagagatttgcggcaatggaccgaagaacgggccaggaagtcctccaatttcctttggtctttccaggagattggactacacattgtaaagactgactgggtttcaactagtcaaaaagcactttcttctgttttcaatccctgttcgatttgtgcttctgtgcttgtaggagagatggccagggtggcagccctcatgcaggttgaagtatatgtagcctcagcctgatattcttggtgcgaaggtaaaaaaaaaaaaataaataaaaccattggcctggttgagggcgtgaccaccaagacatatatgttgtgcccgtgttcatcctgtgtatttatactgtatatgtagagtctagatttatatactgcaatgtaaaatatatatatatttaccttttttaaagacaatggaaattccaagtagctaaaacttagcttcatttatttaatgccactttaaatgtcttaaatttgtttcctggtggacagccgggtaatgcttttagctgctcgcatgcttgtctttctgcatctccatcatctgtttaccttttggttaaactaataaactagtttgggacttggctggcatgtgctgccagacccaaagggattgtatctggattattaaccaggtgggttttgggttccagtgtgtcagtaagcttttgggaagcccgctgaattggttggaggagcacagggaaagccagtggcagagttaggtgggatcctccccactggcaagtgtcacaagcctttgggggaaagaatgacttccttaggagactgcagtcagagatgatgccgttgctagattgctgttcttagggatggagtctcactctgtcgcccagactggagtgcagtggtgcgatctcagctcactgcaatctccgctgcaccagttcaagcaattctgcctcagtctcctgagtagctggtattacgggcgtgagccaccacacccagctgatttttgtatttttagtagaggtggggtttcaccatgttggtcatgctggtcttgagctcctgacctcagatgatctgcccacctcagcgtcccaaagtgctgggattacaggcatgaaccaccgcacccggcatggggacacttaataatccaacttagagtgagggtccaagttagcattttgtcacctttctgagagcctttccccgcattttgtgatggataccacctgcataattcttgaaaccgcccatggtgccttggaagccagggggacctccatggagggaggaaaggcattcccgaaagaattacacttgaaatccttttaaactgatccatgcagtttccccaaaggcattacgtctgaggccagcttcactggacagatgcacagtattgtcatttatcatactgttaaaaagttcccaggattattttctagtagatttctaaatggatccaaattatcaaatgttctgtgcccttgtggaatttttagaggaagccaagtagaaattttaataataggaaattgataatatggggtagggcagaaaaaaaagggaattttgtctttggtacttgttttttcaagatcattctaaaagcctgtttcccttgttttgcctttttctagaaactgggcctggggacagtctgcctgaaggaataatgtcttaaacttgtcttctttggaacgtttgtaaattctccctgcagcgcaggatcattaggaggcatacaatactgctttacgtgtcctgatttcagggggactgaggaggttcctgactcaaacctctttttcttcagatgcctacatttccactaggcaaagttatttccattgcattttgcattgcttttccccctagacatctctcttaaaattaaatacctttggaagggatgtgttaggctaggctaggctggaccgaagtaacaaaccaagaaatttcaacagcttaagaccgaggtttattttttctttcacgggacagtgtaatgcaagccaggaaactccttagtagcttttctctaacagcagctcacagatccaggcagcttccatcttgcaacttcgccatctcggtgtttcccttccagtcacagtgatgataaagagagtaaagagaactcacaaactgttcccaactgccttagaccaaagcgacacctgtcacttctgttcacagcccatcaaccagtccccgggcccgatgtgagtacaggggaggtgggaaatgcaggagaaacctggaggagttgatgaacacgaccacctctgccacagaggggtaatgccttctcctagggtgcacgggtttgttcaccgttggcagtcatcagaaagtgtttggaagagatggcagtgaggacttgagaggaggctgcacagaacagaggaagagttgaagaaagagagatgctgaaaggagaaaatactagaaagaacaatttaattttgtctagaactagccttgatcttattttttaatttaattttattttttggacagggtctcactctgtcacccaggctggagtggcgcaacctcagctcactgcagactccgcttcctgggctcaagcgattctccaacctcagcctcatgagtagctgggactacatccgcaagccaccaatgccctgctaattttttctttttctttttttttttttttttttttgtattttttatacagatagggtcttgccatgattcccaggctggtctcaaactcctgagctcaaagcgatctgcctgccttggcctcccaaagtgctgggattacaggcatgagccaccacgcccagccaatctaatttatttttaatttttaacatacagtcactcaccaacaatttattttcttctgatgtggttcctactttgatgacactaggagctactttacagatgtagttgtaagtcaggttaaaaaaagaaacctaggaaatgtaaagtatttacacaaaacccaacagatcaaataggagccaggcaaatttaattattttagactcacaatttggcaaccattattgggtgtggtttctcaacatctctacccagaaacctttgtggaagcaagtttcttacttaaaatttcaaggaatccaatgtatgtaatgttttcttaagagtttgaaggcaccttacaaatcatgtagtcagtggcctcgtattatagatatgaggctgagacacagaacagttaagttgcccaagttttagggacagagctctggatcatcaaaccccactctgagcatatcacactgggccaggcactgaatggaggaggctctcctgacagacacttccacagcctcacggaactggagagaatccctgggatctgtgggctccatccccagccttccagtcacatgaattcccacaaactatctcggtcagctgggcacctggttggttctttgaagtgtctgaggaacattctactgagggtcagagcactgccacctactatcctgagcatcatttccatcccacagatgaggaaatggccaaaaagatgattattgtgagttagcaccccagctggattggaatccatttctgatctgtagtctcgggtgttccccgggggtgcctgcagcgggagaaactcctaggagaggcatcaactgacaggagttaacaaaggaggagcagatgggactggggcttgagtggcgttcaggagagccagttttaagaccacctggatcagcctccctgtaagccagttatcagtatccaagtgctttaacacaggcttctcagaagaaatcatttttattcctaccattatttcataccaaagcatcattatgtgctacagttccaatttcttacacaagaatgaaaagggttaccaatgcagcaagttaaaaaaaaaaaaaaagaagaagaagactgaatgatttaagctgtttctgaattgttcctgccataaaaaaaaaaaaaaaaaatcaaggcaccagttttgaaatgggagaagcattctaaatgagactgttagcttgccctttgacatcgatttctgatcctcatttattcagtatctaacatccaagtctgcagaaatatgttatctgagagtttgcagtatgaccagctgaataatcagtatatgaggtttcacaggggagacagacatgggttagaagtgccagctttatgtatcaggctgtgtgtgtgtgtggtgagacagagtgcaagagtgagagattaaaacattaaattttactgagaaaacaagaaatgagacacattatcccccagcagcttggaagtggatgcagtttggtgagatctgactgcctcggtctgactcccaggccacttactaccttaggcaagttgcttcccttagctctttgccttatctgaaagatagagattaatgaatagttcctacttcttgaggttcatgctgtattaaactacacagcacacgtagggaaagtgcggttcactttggtgcatgatacaagagttagttgctgttattcctgggaagcttctggcctaagggaagtcatgtcttcaaagaagccctccaacctcctcccgggaggagccaaatggtccagacgtgaaactcttagaggtggggcttccacgtgtggaacggcaccctgcgaaaagctaagcctgcttgctgctctggggagagactgactcacggagctggagggcgtccagggctcctgcagcttgttccacggctggggtccaaaaaggctcacagagacggggatgtgggcccggcgcagcctccctggccagcctgcaggctttgcagtgggcactctcgctggacgggctgtgacaggagaggctggctgatgtcaagcagccctgggccggagtgtccctctcagggcctgagagatcggccaccacacagagctggcagcgattcccatgagtccccacctccttgggtggatttttctcaccagaaactctgctccctgctcctgggtacccccttctgtgtctgtccacagtccctgtgtctttcctacaggaaggggttctcgactctggttccagaggccctgtccagggacaatggagatgcttgattgtgagttattgctcttccccaagcattgggggcactggacatttcacttgttcctgtgcaagcggttcaactcaacaccaactcaatctctcccatagttgcagacttaaaaggataaaactctaaggacaaggctgtcaccacttccatttgaagcctccctcctaccacactattttccccattggttccctctcctctttcttggcctgtgcactggcatcactgtctccagcgatgggcttgcattagtctcttctccccactccttgcacttctctcccagactgtgctctgagcaccaggactttgctccgtgtgtggtgcgctagaagctgcctctttcctctcccctcggattctcaacaggcttgcaccactctgtcccttgcactcaactctgctcatggtttcctcccctgagctaggcctgagcaacaatatcatccccttcaagtcttcacaatttatgctagcaatttttaaaagcagttaaagcccttcaggccacaccatcaaaatgcctggacaactgaactcctgtctgggggtctgttccaaacttctcatttccttttgggagaagaaactgtcgctgattaatttccaagcatctaagaacagagagagagagagagctgcccactccactttgaaaatcaaattcccccactagtaagagcccagacatccacccagccacccgtggaataggaaacccccatcaaagccttgccaggtccatgggggcagagctagtgctctgtgggccctaggattgctcagacatggtaagtttactaaagcacctgttccagagaagccaggctggagaattacagggacgggcataaaaacaaactccataaattaaaaataaagagaaggcaatcctcagagacgattcttcattctttccactctttttgagggcagatgggaggatggatggctttggattggaagcaacacagctggtgtcacagaggctactgaacaaagatcagctcacatattagcacatccatgggtggaagcaaaatactagggcatttcagtaattcacagagcagaaaggaagccactcttctgcccagcaacaaagtttaatggagccattccaccacttaccttggaaccccattcagtgtctgacaattctgtcaatgaattcttcctgaaagctcacctaaactcctcttgctctgtccctgggataagagggagcaccatttttcacgtaatcttttgtaatataatgtactaaaatctaccatcattacttctctcttctccaagcaggtacaaaaggacattgtccacactttggttcttgtctcagctgccctacactgacttagggccgcgggctcacagggaagcccctcatatgcccctcctctcctgctggccttcctccctcagctgcatttaattgaaggacagccggttcccctgaaataataaacatcaccacaaaacatcatgtgggcgtgacatttccaaagctgtctactcttagttttcagaacgtgtcaccccttacatgctattttcttctcatatagccagcctcattttaactttactttgtcattatttaactccttagtgaattaacttctgtcagggagatcacttctggatcatttctttcctctgtttagttggcaagaatgtctcaaaagcacgttatagaaagcctcctgggaagacacatctttattttatagttactagcgggagggatttgctccaatcataagggaaaaaccataagattcccaaatttgtagctgagtgggaatatttcttgttttggacatcaacattttactggaagcctctgtattatctgtcaagatggtaaccaaacttagaattctcccagaaatgctgggctctgtgcttatgatgagacagccctgagaaggagacagccctgagagggaggcagccaacttgccttgccagcatgattgtgtctcagtcttgtttgttatcaaccccaacacatgcctaactcttctgccctactgagttcccatgaatcccactttggccctttcatagtcctgtcaggcaatgcctggacagcatctccacccactgtgcccagccctcctccctcttctgaactccaattcatcctccaaaacccaacccaaatgtcaccttctcagcagagctgccctgacagtcctcctctgcccattttgttcatctctgaaataaaaccatcctgtttggcagccacctgctttatgttgctcctccattggactgcgggccccacacagcagtagggaccttacctacttctctgagcatctcagtgcccagcacaaagcctgcagcaaggcagtgttcacagcctggtttttgagattaggggtaagcttgatctaaaaattcaagcagtcactgagatcaacaaggattttctttttgttgctgctgttatttttccccaggaaaaagctctttggccttggactggtatcacagtatctcagtatcttttgatgaacggataggctgacctgtagcacaaaatgcaagatggacacctccactccctcccagtgggggctctcttccatctttctgtaccttggaatccttttcagcttacataacagtacccatcagtttaaaacaaccctcactgcacagtaagggcagcaaccaccctcccctcatttgccatggggatcacacagcagtgatggttccccctgactctgacatccttggtcaagggcagacctggtaatctctgcagcgttggccattgatcagtgcctgcggaagcaattgacaatcatatctttgagctaagtttttttttaatttttcacaaagagctccagaaggcaaatagtttatcacttccccactctgaaatagcacgcaagacagatgatgcaggggaacgggtgtccactctttcttgttctcagagctcctgcagcaggcctgaatgaaccgcaagcggggcccatgcagcgtgtcctctgcaaagtgcaggtgttcagtccacacacagcagcaccagcactgctgatgtcacggttgtctgtccagaagatcccacgttagatcccaagagaaatccagacagggtttagcctccagaggcagagagcgggtgccaggcccagatgcaaaggcctctatactgacgccctcacatgacactgcaaaggtcaaatgtcaaaggtcaaatgtcttggcttaggactataagggagagataggacaaataatgaggtcaaggaacctctggattgctgaagagatgactttaaaaaaaaagtcacatctgcggctcacagtgttcaccagaaaagaacactgcttgggattctagacctgagcagggagaaacaaaccgggctaaaggagacagaactttcttcacagtagaacagtcctagtctaaaatgctagaatttaagtccaaagtcttttaagaatgagagttcttaaatctgtcagaccagctgacaggggaacaggaaaaaaaaaattctctattaaacaaaacaccacaaaaatcaacccaaacttccttcaaccccagcaccccagccacctcccaccccattaaaaaagtcattaaagtcatgcacacatgcacacactcaaatatgaaaacaaaaaccagatacccaaggaaatcttaggaatcacctaaggaattttcactcgctccccagatgctctttctgtttttctgggggtgggtgggaaaggaagtcacactgacagctaagtctaagcggcacaatttagagttgggtgagttccctttcctccagcggcctagcttgctggtcagtgtagaagggtacccacagtgagtcgggaaggaaggccgaggctggcgtctggtggaaggcaagctgcctcttgtcctaaagtggggacccgcccctcacctggggagatgaggctgccttgactacctatttggtgatgagacagcttggtgatcactttctctagactctgagccatgctgttcaaccttaatgtggcaatcagtatcacatgggcagtgaactgaagaattaggtgtctggcttaaagtgtatcttacactcgtacactaagcttgtgtatgtagcaccacccgcctgtggactctgctctgaagggccctccccatgagtttaagtgtgaagctcagggtttggggtgtgcacggccccccatatggctgcatggtgcatggacagtgatgaggaacggtgctggtatgggatgcctgggagggtttttctggagacaaaaatttacagattgagggcatgagaacataaacttgagggaaaccaccatgatctatactaggatgacagattgtggagtgggaagaaatcgtgtagtccaactctgcattttacataaaatcaatctgtgaagaaagcagaaaggactcttaggggatatcttttgagaaagggtgtccgcctgggattctaagagcttccctggttgctggcctaaatcaggtgaccagccctttgtttctgaccaggtttctcacctgagatagagaatcatttgtttccaaatagttcaaatccccccatccacaggcctccccacaagagcctggctgggaaattcaggagaatcagattgccgaaccaatgtgtccacacccaccactcccccgggtgccgtggaagtctgcaacatctgtttctctgccttatcctaaagacaatatcttcgcccattttgtaaaataaataattcaaaatataatgaaaaaactctggcaaggatagttgctggcctgaaaatgtgctctgtctcttagcagtgactcacagaactcacacctgcggtgggttcccaggctaaggggtggagcggagagcgtgaagctctgtagcagcgcgcaaacccgggacagggcaggatgcacagccagtcctcaccctttatatattacatttatctttataaatagagcatcctgactcgagtggccataataaaaaagccaaacattgagttttttccctcaaatacctacacaaactgtcaaatatctactaaattatatccacatggcaaactggtcacctctatatgagaactccaactgccatgatggtcacaggccaagtctcagtcggacccaaatacccacccctactggataacagggactaagattttttttttttaaaaaatctacttttcaataagacttgtgacagaatcctttaaataaaaagccaaataaatatgattttaagtgattcctgtcccccaaaagttgcacacacaagttttcaatgtcatataaaacggacaaactagaccaataagtgtggtctagttggcctggctgccttgactacatatttgctgatgtgacagctcggtgatcactttctcttgaacaagactctgagccatgttgttcaaccttaatgtgggaatcagtatcacatgagtagtgaactgaagaattaggtgtctggattacagtttatcttaacagtttccaaaaaacctgtctttcagccgtcttgggaaatttgggttgaatttccttatttccttccatggtcaaaaatatgttaatttcgatctatcacactagatcactttggttagatgactgtgaccactaagaacaaaacaaaacagaaaactggagcaaacagatgaatagccctttagaaaaaccagaggatgttgaactgatgtgggccacactcccagggagccttcatagctcatcccttgaaggcacagtgtccagggaggttggcggtggcagggcctctgtgttcttggcattgctgtagatgcggctttgcttccgggacttccaggcatgtgtcctatcccagtcggtggccactgtctcattgtcccagatggtggaggtctccgtgtcactcaggtaccccggctggcctgtgtagtgcgtagggtagatgagcaagggttctgcagagaaggctttcaggtccctggattcataatactccttgtactcggctctgaaaacaagaaggtggccggacacatgagggggcggaaaggagacttacggaacagggacaaagagtgaaggaggcctcctggttacctcatgagttcatttcattatttcaattgtgtcatttgtgaaaaactttagcctacaaacacaaatatttctttaaaagctttccaaagacaagctcccaagcaaaaagatcaggacatttctgacgtatttgaatagactagtttaaaagatgaatttcaggtctgactccaaaagttaaaaagtaagccctgttagaccataatgataaataaatacgatcacttcaccaaaaatgccctgctttgggattaataaatgagacacctcacatctggacagcagtgatggggcatgtggcacgtggaggcttagaggcacgcaggcttggctttgtgctctagctccctgctcaccactccggttccaacaggtgtaaaggagacggatgacttggcctccctctcagggctcctgtgcagagtacatgaggtgacatctgaatgtagtaatttcccttttgtttaggggataatggtttgacctccatgtttctgctaggacacagagataaagtcagtctctgacatgttatatacaagagggcacacaactccatttttactgaggacaagagacaaaatgaactggtggcagcacaggaaatctcaacagctaaaatgagaccatctagtgacgagatcacccagcaactgagagaaggggccaaggttagaacgaatgctgctccatcaatgaatttaggaatcattcattaatgatttaggagctgctgttatgtgtagcatttggactaggctctaaggacacagaggcataagactgttactgccccaaagggtttatagtttattggggagattgacaggtaaatcattaattgccacaccttttgataagcgctaggtcagggtaagctcctgggctatgggagccccaagcatcacactgcccttcttccatggacatcatgctcaggtatcaggtccacactccctgaacctcttacacacccctgcgattgcaggaatcacaatatatcatgatgatttgttcatgagtctgggttcctgaccagattgtgagctatgcaaaaatgggtatctctgcttagccaacagtacccaatgacctgagccaaaggaactggaaattttgaggtgcttaggaagatggccttcaccttgaggtgtatgaggttatggaaataagaagagcaaagacaaggaggggaccaagcacattacattcagttcaactacaaactggatattacaagaatctctgggcaggacactcaccatctctgcctcaccttcccatctgtacaaagggataaatcacctgagttaggctctcttaatcataattatgagaagatcatttaggaaagcagtacaactttagaaaatatcaagtactaccagaaatggagagcataattcatgaagaggctgtgcccaagggaaggcaggcagttcagggagactcacacgggatgcttgttgtacatgactggcagaaactcatccactggcagcatcttcccaaaaggattggctccaaccagcttctgtgctccttccagagagatgacgtagcccagggtccagtaggaatagtcggcttcgaccaggtttgccacattgggcactgctttctctggctcctttacttgcatcctcttcctaccaatataactgtaaggaaatggcagaggagaaaaattccaccttgactattatgccatgataaggatgaagcacagctttggtttacatagatacctctgaaatcctggactgactctgtctgtcattaaatgatgtatcacatccaaaagtggatccaatcgccagtcaggactgccatctgccatcactggggccattttgctagctccatttatcaacacccccactattcctgcctagtggacggttttcaagacggaaagtaagatgtcgtaagattaaaagatctttcagatcatttcttaaagatgggatggggcttccagctgtgtttacagaggttggaaaggcacaaaaaaaggccagatgggagaatcctgaggctgctgtcttcaggtccccagagtgtcagccttggatgccttctgcacagcactccgagtgctggtgggaaacacaggaccaaataagctgggggaaagagtcagtctgcagtgaaggttctgggaacccaagagtggccctaaggggttccttttggggaggatgaatgacagctcctgacaggcattctcctgcctcacactcgtccagctgtggccaggcttcctcccagacatgctgctctgagaaaggccccccaggcaccttccgtcctccgtgaacaacttctacaacacaggatgcacctttggccactcccatcttccctagtctacccatggatctgtgctccattacttttgtccggaacctattgatttgggcttgactggagcaacctgaggagttgcctccttcttgcctgccaggtaaagcagtacttcctctattttgccctaaaacaatctctttcaacattcaagggattcccccttgtgaaagcatcccaggatttgtagaacaagtctatgttcaatcttcagttcttctgagaacaacaaacatatatccccagccactctctcttcagattacggagtctgagcttctctcgtgtctcatccagtggaagggaaactcttatcgagcacttgagaggaactagagtgatagaggtgctgagttaatgctctaactttaattaatttaattttaaatgttgaagctgtgtgaaatatatatattttttccatgaaacaagttcattgttttggtaggacgacagtttactttttttttttttttatggagccttgctctgtcgcccaggctggagtgcagtggtgcaatctgagctcactgtaagctccgcctcctgggttcatgccagtctcctgcctcagcctcctgagtagctgggactacaggagcccgccaccatgcccggctaattttttgtatttttactagagacgtggtttcaccgtgttagccaggatggtctcgatctcctgacctcgtgatccacccgcctcggcctcccaaagtgctgggattacaggcgtgagccactgcgcccagcccagtttacttaaacagctgaaaatttagcttctggattgagaggtgttctaagtgtaaaatacataccagattttgaagagttggtacaaaaaaaaaaagaaggtaaactatgtcattaatggttttaaaatattaattacataccaaaatgatgatactgtttggatatttttgttaaataaaatgtattaaaactaatttagtctaatttatttttacctttttaatgtgattactagaaaactgaaaatgacatatgtggcttgcattatatttctattgaacaacactccctcaatgattccaatgacttgttctattcttcccttttattattttcttttcctggaaagatgtaatgtggcaatcatgaacagcttattacctttcatgttttaggtttaagtaacatttgtttcttttttgttttagaaaataacaggtacaatttaaaactgttacagttctttaagactatataatagattttaaggggatattttgacttgatcaacctgtgaaatttagaaaacatttttttcctgtatccttatcaagacaactgttcttccttcttgcatctgtcggtactttgtcctgagaaatgcacccaccgaactacatgtgaacgggaacgtatgccagctctaaaccttagattctctgggctcagtcttctgtgattatgaggcttaagtgaagttgcctttatacaagtcacgtggacatcaagtagcttccaggcctgtgaggccttaaccacaggctgcggagccatccattgagaaaggctgaagtgcagcgacttctggaggatataggaagaaacagtgatctcaagggactgtgcagaatgccaaaccaaaccacatgaccacatgactgaaatctgacagggcataggtgtcttattacacagtgacgcattagttgagccattgctaggtttcttctgagctcagagtggcccattttctgagggaacaagtattccacctgggcccacagttaaataccgcctgtgggtgggagaagcagggacagctcctctgctgcagctgctccaaagaagcaggctcagagttgatgaattgcctttgacacacagctgggagcaaacacaatgcttgggaactttctgcttcattggagagaaattgaaagtgtcatttgttttaaaaagaaaatgagagagagaaaggaggaggcagaggaggaagaagaaaaaggaaagaggaagggagagagggagaggaaaaatgaaagggaagggaaggaaaaatgaaagggaagggaagaaaaaagcagaagccactcaattcccagagagtagacaaagaacattaactaaatgtcagctcagagccagcactcccttggtgagcctggttttcctgcatcagcctcagacccttccccaaatctagttgtccatgttcttcatgtttgtgcagccccatttcccaacagaggagctccctggctgaccctctaacctcccaccttctcggaagctgcagaggcaacctgctgtcccgggagctgagtcttaaatatgacacaggactttagagcttgaataaatggcctcttctccagcttcacacccactccatgtgccacgttaattgagggtgggatttctgctgtgctcctaagtaagtgctcagtgccacaccttggttctgtctgaaggtccctgatctgcaggccgactccaggtctcagacaatcttccacagtttcccaccctgaagagtagaaggatgcaaaatccagtggctaacctctacccatttttatttctgagaacatttatggaaagaaaactagataagtggaagcttaagctgtatctcctactggctgtggaggtggggctctctgcgcattggaaaggactgagtgcctctcagagccctctcgtaagatcatcttgtcactcacatcagttcccagtccagctgagcctggtcaatgttatccatcagcttcatcagcttcttcttaaactgatgctcaaaacgcacatcgtcttcaattacaagagtcttctctagctctcgatcaattacctgcaaaagtcatcagtaggaagataccctatgaaaagtttgaaacccaatttttattagataaataagtattaaaaagtcacgagtctagtagcacagattcataactggaatctaagcaaatggccatcaacagtagaatagataataaactttggaatattcacagcagtgaggatatatgatcacaattaaacgcaacgttataggtgaatctcctaaatgtcatgttaggagagtacacatactgcatgattccattcatataagggaaagtacaaacaaaggtaaagctattcaatgcctttagaagtcaggatggtgactgcccttggggactgatgaccagaaggcagtacggggtgggggggtgcttgtgggatgctggttacctgcttctggatctgtgtactgattaacatgggtgtgttgtttggtttgtgaaatttccctgagctgtatcttttgatctatatctttttatacctatttatcacatttcacttaaagtttaaagaaaacaaaggcaggcatagactggatcattaaaagagaaagtgttcaaggggcctttcttcagggactttctttttggttgtggaaactgactgtttatcaggaaccccacacaccaatatctgctccagatatgtcttgatctgtaagacaggggttccacttctggctctgccacttcttaccgggtcaagctacttaataatttcttcttcggtaaaggtggtctgtccttcccaacccacctcacatgacttctgtgtgatttcttgtataaaatcacttaataagtgatgtcataataggtataatagaaggcattcctgctaatgatgataatgaattaataagagtgtggcacacaggacatgggtgtctcccccgtcaccaccccaagtggcaccaaagctactcctccttgcccctttgttgctggtcttgggtcagagggagacacaaggcaggagcagctctcatgcacatttccagaacagttgcgggctcactttacatctggccctaactcacctacgatagcctgctttcctttctcctcatcataaaactgcaatctgaataaagcattatttacctctttccagactgagtagtggctgagaaagcagccgatttcaccccttgttagaggcctggaggaatagggatctcgatagccaggcagcatttcaatattcagtgccttcagctggcttgtgttgagtgccctgcatcacataaaacacgtctggagattaacaagtcaaaggtccccaccacaaaggccagagaaagagagagttagttctgcaaacacccctcccccacacagacaaagacagagaggcttccctttattccttagaagttcctccaggctaatgtgtcacactagtattatgaggtctgggaagacaagagggtatcatatttttgtgtatccctcatagtgcccaacatagttctaagcatcatcagttttttgacaagatttaataagtacactcctatggaaattagttaaagtactgcaataatccaaggagtgtttgatcaagacctactgctgaatctctgttaacacagtgagctttgtgaagttcacagctgccctaatcctaacctgttcaccccagccctacaaaagccttgaaaaccagtagcctcacaactaagagagcggcaaaccccaccaacccagaagccactggcagggacaaaatggactgagactcccttaaagacctgcccccagaaaataatctctattcaacctgtctagtagctccttgaaaagctacattctcagagcttgtcttgatttgacctgactcagagttcattttctgtgaacagcactatctgcaggtcatttgtcaaaacccatgagcaacaactgtttaacattacagctgtttgagaagcattatcagctgatgctaacaagaagcccaccaaaaaacttaaaaggaaaaaccaaggaataagaggtccatagggagtttgatttgctccaaaatatccctgagaatctagaaggccccaggcatattcagggctgtccacacgcccaggaaaaacttgagaagtccctagtctctcacctctggctgaccttaaggatctggaaaaaaatgtagtgaaggcaaatgaataaaacactgcaatgaaggaagaatttggcatagtaagttttaaaaattaatacaaccatgtggtatctataagaggcagcctttagattaaaagacaaaaataggttgaaagtaaaagaatagaaaaagatataccatataatcagcaatgacaagagagctggcagagctatgctaatattgggcaaaataaatctcagacaaaattcatgctagagccaaggaaggacattttttaatgataaaaaggttaatctgggccgggagtggtggctcacgcctgtaatcccacgactttgggaggccgaggtgggcagatcagaaggtctggagatcgagaccatcctggctaacacggtgaaaccccatctctactaaaaatacaaaaaattagccggccatggtggtgggtgcctgtagtcccagctacttgggaggctgaggcaggagaatggtgtgaatctgggagctggagcttgcagtgagccaagatcgtgccattgcactgcagcctgggtgacagggcaagactccatctcaaaaaaaaaaggtcaatccatcaggaaggcataacaattataaatacatatgcacctaacagaacctcagaaccatgaaactggaagaattgaaaggagaaacagacaattcaacaataataggggaagacatcaatatcccacctgcaataatagaactaggcaggaggaagacaaggaaacagaagacttgaataatatcttaaaataatcagacctagcagacatctatagaacattccacccaacaatagccaaatacacactttcaagtgtgcatagaacattctctaagaaataccattttttagaccataaagaccatataggtcataaattaagtgtcagtatacttaaaaggattgaaatcacacaaggtatgttctccaacctcaatggtttgaaattaaaaatcaataaccaaaggaaacttgggaaattcagaaatgtggaattaaacaatacactcctaaccaatgggtcaaagaagaaattgcaagggaaattagaaaatattttgagatgaatgaaaacacagcataccaaaacttatgcgatacacttaacatagtacttggagatatagttacagctgcaaatgtctctagtaaaatagaatatctcaaataataatcctcccatccatcttaagaaactagataaagagaaaattaaacccaaagcaaacaggaggaagaaaataataaaggttacagtacaaataaatgaactagagaatagaaaaacaatagagaaaaatcaacaaaaccaaaagtcagtcctctgaaaagatcaacaaaattgacaattatttgcctaaactgatgaattaaaaaaaagtaaactcaaactattaaagtcaagaatgaaagaggggtcactcctactgaccttatgaaagtaaaaaagattatatgataatactatgaacaattgtatggcaacaaattagataacctagatgaaatggacaaattgataggaaggtacaaactaccaaaattgactcaagaagaaatagaaagtaaataaataacaagaaaagaagtttaattagtaataaaaaaaatttccataaagaaaagcctagaaccagatggcttcactaggggtttctgccaaatgtttaaaaattgttaacacgaatctttcacaaacttccaaaaaaaaagaggaggagggaacacatcccagctgattttatgaagccaatattattttgatacaaaaccaaaaacattataagaaaactgcagaccaatatcacttattaatatagatgtggaaatcttcaagcaaatactagcaagagaatccagcaatttataaaaggaattatacagcatgaccaaatgggtcccaggattatcccagggttgcaagtttggtttaacatgtgaaaaccaatcaaagtaacgtaccatattaacaggcaaaagtcacatgttcatcttaatagacacggacaaaccatttgacaaaatccaatacccttttatgataaaaatactcaacaaaataggactaaaagggaccttcctcaacccagtaaaggccatctgtgaaaaacccacaattaacatcatacttagcagtgacggactgaatgctttccctctaagatcaggaacaaatcaagaaactgcactcaacagttctattcaacattgtacttgatgatccagcaagggtagttggacatgaagaagaaataaatggtatccaggtttgaaaggaacatataacactatctctacttgcatgtgacatggtcttgtatgtagaagatcctaaggaatatacacacacaaaggaaaaagtactattagaactgataaaaagggttcagcaaggttgcaggatacaggatcaatatacaaaaatcaattgtattcttattcatttagcaatgaacaatctgaaaatagaactaaggaaatagttccatgtaccatagcatcaaaagagtaaaatacttaggagtatatttaacaaaataaatgcaagacttgtatactgaaaatgacaaaacatcattcaaagaactaaagaagatctaaataataaaaagacattccatgattacgaatcagaagacttcatattgttaacacggaaatattctcccagttgatctacagactcaatgcaattcctatcaaaatcccagctgccgttttctttatttgtggaacttgacaagctaattctaaaattcatatggaaaaagtaagggacccagaatagctgagacaaactcgaaaaagaataacaaaattgaaggactcatacttcttaaatacaaagctacagtcatcaagacggtatagtactggcataaggatagacatatagatcaatcaaataaaatagagagttcagaaataaatccttacatttatgggcaactggctttttacaatggtgccaagacaattctacgagggaaacgaaagtctttttaacaaatggtgaagggacaaatggataaccatgtgcaaaagaatgaatatggatccctgcctcatgccatatacaaaaatttactcaacatagatcaaatacctaaatgtaatagataaaactgtagaactctcagaagaaaatttcatgaagtaaatcttcatggctttgaaattgacaatggattcttaggtatgacactaaaattactagcaacaagaacaaaaaataaattggatttcatcaaaatgaaaaactcttttgcttcaatgtataccatcatgaaattgtgacaatcaataatgcataaagttaaagaaaatatttgacaattacatatctgataaaggacttgcatccaggatatataaagaactctcactactcaactagtttccctggtccatgtggtctatgaatgggactggtgttcttggaggtatttgaagcagtggttcctaaactctactgcacccaagaatagggctgacagatttaggaagtgaaaaacacaaaacactcagtcaaatttaagtttcagataaataatggataattttttagtataaccaagccccatgtgatgtttgggacaaatttaactggctatccagtattttatggggcaatcctgtctaagaatcaccttgaggcttcttaaatgcagatcctgggtccagcctcagagagcataattcagcaggtctgagatgggactgagggagctgtccccttaaccatccgtggggactctgatgtgagtgtccaggtcacactttgggaaacactgatgagattctctaagggagtcataaaaacttcaacagctgctagccatactccttagttggagttatgcaaatagaaaacaaagctactgatattctaaaccaacatataacatggaaaggcacattttataaaaatctatgccttgaaatagtttagggtgtcaaataaaagggcaaagctgaacaaaataaaaaaaaaaaaaaagaagggatctaactaggttccctgtgttactttcctgccatatttccaggaaaagtggccactatgatcggtccaggcagattgtggcaggcatctcatgcaacaggaaatgtacacctttatgcattttccatctattttcttcagattgaccaagtttcagcactttatgctctaattcagctctgaacacaattctgaacacattccttctgttacactacagaaggctgaaaaccaccacaactgttgcaagaacccccagagacgggacaatcacatccaatgtgagccttcagtgtaatgaagaccaaagaccactggctggtgagtggatttcaggcctgctctacaggatgaaattaacttaaatgctactacaggtggccgttttgaaaataagactatcctctaatgaccgaagagacttagagccccacctgggactaactctctgtcagagaagacacatccacactccaatcacatctgcaatgggagaagaaacccaactcactttccatccacagcctcgacaatcttgacctcaatctcctgttcatacagtgtgcgcagcatccggtcccgcctgtcctttctgcgtttgaggtttatcatgaaaatctaatgcaagaaggaaaagggaaaagacacataaattactcaagtcttcttttaggctgtttgaaaagtttagtaaatgttttagatagaagaaggagtggaaaagataggaagaactgtcgtgaaaattcatttctatctcacatcagtgtttaaggtaaatgatactaattcaaactgaattattttcaaaactcaactcttcgtagtgacttaactctctttgtttttctgatgttcattgataaatatgttctcccttctcttgaaataggaaagtttaaaaaactactctttaagaggtcaaaggacaatacgatcctatgtttagaaaaacctaaagatgccaccaaaaaaccattagaattgataaacagcttcagtaaagttgcaagatacaaagtcaacgcacaaaaatcattagcatttatatatgctaacaacaatctgaaaaagaaatagaaaaagcaatcccatttatagtaactacaaaaaaatttaataatactcaggaataaatttaaccaaagaaggtaaagatctttataatgaaaactataaaacactgatggaaaaaaatggaaggatattaagaaaagaaagatatcccatgttcatagattggaataattaatattgctaaaatgtccatactatcaaatgtgataaacagattcagtgcaatctctaccaaaatacaaatgacatttttcatagaaccagaaaaaaatcttaaaattttcatggaaccacaaaagaccctgaatagtcaaagctgtcctgagcaaaaagaacaaggcttgaggcagcacactacctgccttcaaaatattctacaaagctatagtaaccaaaacagcatggtactggcataagaatagacaacacgtagaccatggaacagaatagagaaccagaaataagtgcacacatttacagccaactcattttcaacaaggacaacaagagttacagataatgaggatgtcctcactattcccagacttaatgaaccatagaagtatctaaagctttgtgaatgcctttacacgtaaatcaatgttttaataaggtccttttgctacaaatagtaagaaactcattttaaatgttaaactagtgactttaactgccagtgagaaatgaggatgacacatagcatggtaaagcagaaacctatagaaacaagtcaggtggtgttgacttcatcctgactaaccatctggatgactttgaggagacattaatgtttatgggtccagttctataaaaatagggaggtgcacaaactcatctttcaaattcagtacagattaaaatgtttaagacaggtggtttataataaagttggctttctgctatggccagaataaaggagaaactttgtcttagaaccagtctggagttcagattgtactgtgttaaggtttggttcacatggtcattctgaatgcagtcataaatatatgtttcactggaattaaaagctacactaactaaaatttcaacccttccttgcaaaatattctcatttctatccatttataaatccctgggtgtagaaactgatggaggagcaagatattccctttgaagaaattgtccacctgatttagggccaagtagattaagtgcatcctaattttactaccttccttgtttacctaactgggtaattattttgtaaaaaacataattttctgtggtgactctatttgcctcattacttgggactttataacttaatgggttgtgttcttttagtcagaatcatactgtgatgggtcatgcctcatcccctaattttccagatatggaaaggaaagggcattttctcaggtataaacatgaagccacctgaggtcactctaagagaacaaaaacagaacagaacaaaaaatcaacagaaataaatccaaaaaggcccccaaaaacagagacctccagtctgggaagactttcagtaaataacaatccagttccagtccctgccaggacaagtgcaataaaactgtagccacgaagtaaaaacacagatggctcactcacacttagtgaacagtaaacagagaaaagagcatcagagccaaatgcagcccagacaccaccagtgaggtcacagagtccgaggaggattgaaaagcccctgaaaagccctttttctaccatgctatctctgttccatacggagaggtgactaacctcagactcaggaaagtagagtctccgagcctgtgccacttcatggagttggccttctcctgaagggctctaggagtgacccagtccttacaccgtgtcctgcccaaagaagaccggaactggaagatcctggttttgtcttattttatttgctttggtttggtcctcataggaatgtttttaggaggagaaatgaatctatgtaaggacacttgggtcctttcacctagggaaccgagagagagctgtagggaaggaaagctacagtaacatgtggaagctggtccactgtgggtgtgggacaaccttctctatagccctgatcatttttaaaaactatttgcaaatgagtcttattcctctctactacatgcagctcatctcttctcattctgccctttgtggaaataccatagtagctgttaactcttccccacttaataatcatgaaatattctttcccccttcctgaagtatagctccaaatcagtcttacggaagaaatcttaattcccagttctagcgtcaaatccctttgagaaggctgtactctggggacatgtacatatatgtatgtatatgttaccatgtgataaataaggcatcttccttcgattaatcagtggcaattagcaccaagctcgaagcctgatctgttacatatccagagtccatggaagagttctcagtttgtggactcctgaggcactgccctagcttctagaccaccaagctccttctgaatactgttcagcagctacaggggacacccatgagagagtcagtgatgtggagtcacaatccctgccaagtatctgttacgcatattaccaggaggggaacctcttaatatttctgcttcattctttatacaactaaaacttaataataaatactacccttagaatattattaggaagttcttgcctgctgaaaggcagaattttagaacaaatatgtttttttttctttctttgtcctctcaaccctgctctctaacctttttccatggaagaatagtagaaataaaagaaagcacagaaagttccagaatagtttccacttgctcagatgtggcagaataaaattaaagtcctccatatctaaaacatgtatcctctgtatcttactcttgaattttgataaaaaggttgattaaaaatatcacaatatctgctcctagaaaatatcaaattcactttcattactaaatggtaatttctttctaagtaaatgattaactacatttatcatgatactcctttttttaagataaggaaactgagaacaacaaaaaccaagtagttttcccaagacctcagagccatttcagcagccaagccagtcttgctggctctcagatgcaagctcaggcttgtgttccaaaatgaacacacaagcctgcacacgcgtgcatgtgcacacacatatagacacctttcctacctcatcaaatcccatcttgtctggatatttagggacaactgagacatactgggagggttccattggaggacggtcaactggaagacacaagaaacatgcagagtgctttgttaatgaaagggtcagaaatcagaattccatccgcatgcctgatctctagggttggaatataacttggaaatacagggcaggggacaatggcagcagttctccaggattgagtagccacacaggaaccctgctggtcagggcactggtttcaggagcatttgattatatggagattgcaacatttgctccacttcccttaagacttatttcaagaatatttgggaggcagtttaggataatggttaagaggaagggctccagagtcggatgatctgggtccaaaccttggtttgcgaaggagtaggagagttaggggacctctttaagctcatttctttggtgtaaaattgggataatagaagtgtatctgtgttataaaatttaaatgagacctgcgtgcaaagcactcaccactttaacacagtaaatgctcaacaactcttagctattacttactatggcccatgatgaaagagctcagaaataggctagaatttttactgaaaaacacttttttctctgcatttaaaattgtcaaagtgggggactatttttatcccacctgggcaggtttaggtgtgggtgcgcaaaaggtccattgctttaacaggatctaaccacagagagctggcccatgtctaatgggaagattccagctgggagtgacactacttcttcaataatgaaagttttatttatttgatactctaaaaaagcttcctttgcaaactatgtattttaaagtttggaagtaatattggttaagaaacctgaaaaggccttgaagaatgtttagtattataaaaattcaaagtcctcgaagaatgtttagtattatacaaattcaaagtcctcatttgattttccttaaagggataatacaaagaaaatttaaaatgatagctggtaactgggttgttgaaagaactatgggtaatggccatgactactgtaacgtatctgttcacctctattccaggcacaggagaggaatacactctcttgcccttgaagttactcagggctatatgactttctggggaaagtttatagtgtggtgctgctgctccactctccaagggctcccccgacactgcccttggtcccaccactgtgctcatagcggcatgtgtggatatggatagcagatgtgaattggaagcagcctggaacattgcatcaacacatgaagggcagctcccaggaaagacacctgctctgcagacttggatagcaagaaataagccattgttgtatgaagccaatcagatttttatattccagcataactttgcccatcctgagatactgtccaaagggtatgatctgtttaacttcactgaaatattatagagaaatcctgacatccaattttacttattggcgaatgatgtgaaattctagaacgtagtgagacagagttcttaggccaaacacaagagctggtctcattacttcaaacttgacacttacagtcatatttctgtgcatatgcagtgcatgtctttgtcttcccaatagcagccgagaatattctggtcctttctgctccactccactccttattagtttcttttaaaatcaatagggagggtccaccaggtacacggttaggtttttaagagaaagaagcttaatgtaccagcttcctcctgttcatgatattgtctgaggagctgtctcactctccctcctggggcctgagacttgggaagatgttatattttgagttacccattctaggctgctggtctcctttggactcacatggcctgtgtggctttaacatttcagccaaagagactgcttttagccactttgtttccatcaaacataggcagtcattgcattcacaggacaagtgttgcaaaaaaaaagccacaagtggttggctcccgaaagtcatcactgagcaaaaatatcagagaagtgtgcttgggttttgccactgaaggcagcagtaagccacagaggaaaacaggaagtgatacagtgagtcagacctaagaaacttagtctgtggggagaaggatgtatctttgctgacaacagacttgaaggttaggtatatcctggcttctgtttgtagtcatttctgactccatctttcataattgatctggtctctcattaaatcccttcctggaaataatccttccctgtactgccacttgggacaatgggcttcattgctttcgggatagtttcaagatctaatgtgaataattacagccattgttacagaggtcttatcactcacagaacccagagttctgtgagtgatatatatatatgtcacatatatacttgacatatataatcacatatatttaatgttcacatgtaccatgggatatgtatgagtgtctctatttttatagacaaggaaacaaacattaaataacttgcccaagatcacagagctgatagagctggtatttgaacctaggtcctactcctttaccggagctcttaattcccattccacatcatccccagagctagtccttggtggccactggtattagccaaccaggcaactgggctgggtccagagtagctcatttaagcccagtcatgtctggaatagtacatgatagattgtacttggatcaaatcctaccgcttcttctctataatttctcctgaacttcttccattgttgcagcctagcttgggtccttacccactatgcctgggctgtttttgatttttttcaaacacttacatgctctcagtctttcctattctaattaatcatgctcactgttgtcaaaataatcttccgccgcacagctctgttctcaactgtaacagtcacactcaacactatatttaagggcttaacaggttgctaggtgttttcatagtcaccatgtaattttatcttcacttttttgtggtggttttttttttttttttttttttacaaataaagaaactgagaccaagccagatgtagacttgtccaaggtcaaatactgagtgattggcagagctggaactcagttttagacataacttcaagtccaattatcttaataatttttacatgatgtactgttgtctcaaaatgtcaatactgagagcaggtacctgagacttcctatcaccttatgctgtaatttgcaagagtaatctcctcatgctttatagaccatttaaatctaacatctttataagatctggcctcctgtcattcatctcccgaaggcagcacatccccaaattctctgtgcagcttctaatgtactaaatgagttatcacatgaaaagagatgggcacagtgcttttaataagtgttagtcattgtcgtcataacccttctcccacctcactcaaattcttcaactctgatttctaaaactccagtctacaattcagaaattccctgaccatccccttcacaagattttcaattctcgtccactgatgcctgataaaaccctaatcctggttaaacccattgcccacttactcagcaccaagaggactactgggagaaacatacacaattgtgttgactgagtcacttcaaagctacaatcacagatgtcaaattggcacttgacaccaccaaatgatgtaagtgtcctttcatagtaaatttattttcccactctttgagagattgtatcttttgtcttctctctcctaaaatctccaaaatctctgtctagctcatgactgactggcctatatacttcagaaagaaaatattcaaaatcaaattagatctaccttttcaatccacctcaagtccacaaaccaaactgcatgtgtatcaatacattctgccatcccatctgccacagtagatgaagtttctatctagtatagcctctgcaatattgttctgggctgcaacccaggacaaaaaccctcttgttttcaccttataattaccttctcttttacatcatcaagatctccttatatactggatccttgtgactggcataaaacatactgttatatttctatttttttaaaaaaacagtacaaacaacctaaccagaaaaacctttcccttgacctcttacccccaacagcctccatcggatttctccatttccccatcccatcaagattcagctttctcatctccccattggcttctcttcagtccacttgaatggatttgtgttctcatcattgcactgaagtggcccatgtcaaggtcatcacagacctctctcttgacagaaccaatgaccaattctttatccttattttccttggcttctcagcagcatcttggctccgtcttgaaacacttctcaatttttcctcctagctctctggctgttttgtcttccccagggatctgtcctcttctcatcctgtgttcttttactacatgagttcagactgttccacagcttcaaatatccttctgatgctgatgattctcaaatatctgtctctagctggagtttcttccctgaactccagacttatatatccaactatcttctgcctttctatttagatgcctattaaatatcttaaacttacgtgaccaaaactagctccccaacccccagtctttttctataaagtctttcccatctcagtaaatggcatatcaggctaaaatcttggactcatcttgattcctttctttccttcatggactgcattcaggtctctgtaagtcctgttgctccaccaccaaaatatatcctcaacctgtctgtttctcatcaactccttgctagagctcacatcccaatcaccatcatgtcccaccaggagagaggtactggtcccctacaatctagtatcctcaccacagcccaaatgatccttctaaatgcacaagtcacttcaggccatgccccctctgccccaccccatcttccacggattcccattactcttggagtaaaatctaaattccttaccatggccagaatgttcggtgtgatctggacatttcttcttccattacttcatctcccttgacccaactcattctttatgccccaatcatgctggccttttgtccctggaacacccccaagcttttcctgtctaacagtctttacatgtgctgttctttccacttgagacattcttcacccaaatattcatatggctgcttcccagatatattgtctattgtctaactctctgtgttagaatataagttccctgatggcagggcttctgcctgttttgttcactgctttatgcccagcatcttgaacaatctgcggggtacagtatgtgttgaataaatccttacagcctgattatctcttctaacaccttcattggctccttaagataggaattcttctttagctgaagaagaattcaaggactacaacaatgaagccactccaccctctcgaactttatttctgcctactgttttaagtcagctctccttcagcatgagaatacttcgtcttttcttggtctgtttcctctgcctgtagtgtcctcaccataccactcttcttgtttaaattttacacttgtacccaagcttagcctaagaacgattaggacttgaggctctcctggatcacacaggccatagcaatctctctctatcccaaattcctatttctttgatattttctcctttctcaaaatgctatactgtgttgttagtgtttttttaacatctgtctgtttctcctattaaatcatacatacctgaaaacagagaattgatcataaaatgttttgaatccctagtaccttcagagaagacgcatacattacaggcattctatgtttgctcatgaacaaaatgcatatactaatgcaagcttgttcaaccatggcccgcaggccacatgtggcccaggattgctctgaatgtgacccaatacaaatttgtaaactttcttaaaacgctatgtgattctttttgtgattttttttttagctcatcagctattgttgtgttagtatattttatgtgtggcccaagacaatctttcttcttccagtgtggcccagggaagtcaaaatattggacaccccgttcctattcttcaatcagtatagtctaacaacactattagcagccatttatttactgcttattgggttctaggcactatgcaaagtgtttttaacacctagttaatcttttattagagaaggatacttgactgataggattttgtcattaccaactttttatcaatcttacacggacttctaggccatatttcttcattatacacctcaaaattttatttttccaacattttcttactcctattgtgttctatatttttagaattcaggacagaaggtaagtataagaatgaaataaaatgcgatatgtaaagtgcttagcactagaggtggcatgtgttgggagatcaatgatgaaagctataatttacaggttcttctcaaatgaactctacctggctagcatggtagtgtgcatatttgtaatttacaatcattaaaatctttattgatgacacgtgcatttctgtgtactgagagcttatactctcagccctgtgggagaaaacaagagaacataaggtctggctggcctctctctgaggccagagagactctccctacttgggagtcgagaccgagagccatgaaacagggataataagggacagcactttatcgagaggtaaatggagtcataataatagcaacacctcattattttatggagttgatatagtcttttatttgctcttctcaacattgcaaaatcactctatagatgaagaaactgaagtcctgaaatctgattctcccttcaaaagcgacagtgtctaagttcaagcccattattctcgctttgggttcagtgcccttgtcaatacagttttcattcattcatttgctcatttgttcatgcattcagcagattttttttggtaacaactacatgccacgcactgtgctaggtgcttggaatacaaagcaataagatgccacccatatcctttagggcctagaacatagggaaagtggcagaaaaagtatgtattaaagaaattcgcaaaggagattcctgagggctggttcaagaaatactgtcacagtgaaccagctccttatttcatcatttcatcatcattcattcagtcatttaacaaatatttgctgggcatctaccacgtgacagacaatgtgctaggtcctgagactaatatgatgaaaaaggaatttatagtgtaggagcaagggagtgggaagcagatactcatagacaactcaatggatctaaaaataaactcatggtctctgttttcttttcttttctttttctctttctttttttttttttttttttttttgagatggagtctcactctgtcactcaggctggagtgcaatggcgcgatcttggctcactgcaacctctgcctcctgggttcaagcaattctcctgcctcagccttccgagtaactgggactacagatgtgcactaccatgcccagcttatttttgtatttttagtagagacaggtttcaccatgttggccaggctgatcttgaactcctgacctcaggtgatccacctgcctcagcctcctaaagtgctgggattacagccatgagccaccatgccagccatggtctctcttttcaaacctctcctttatgctacatgccctattccatttaaagttcctaaaatcacccccagacactcaagacagaacttgggagttttctctatgcctcccttttgctcatctacctacaatcaactcttggctatgtcctttcaagcctatgtcctaagcttctgttccttcctctccattcccactgttactgctctagctcaggtcctcaccaccttttgcccagtagccgtgaaatgtccaaagtggtctcttcacccctggcctgagaccagcagccactgcccatgcatcccatgcatgctccacctacacttttcttacctgtagagtgacctttctaaatccaaattcaacctgacatttctgtgctaaaatctttttgagcgtgcctgtcctttcagctgaagcccaaatgccttcttatacatcagagcctcttggcggggctcctgcccactttctagcctcagtttctgctgttcctccctaaccacctccactgcccacgttcacacccccgtgctctactgatgaataacagaaaatagtccctgctttgggaagccatttcaacatcttcccctaggttaggtggattggttactttctcttttagccaccattgtacatcacacataataaaaagcatagctactgatgactgagcacagcaattcatgcatcatgccagacccagaggcaataacaatagtgtttaaggacatgaactttggagatagcaagatgggttcaaatcccaatctgtcatttgtttagcagaatgatctagggcaagttacttaaggtaacatctcattgtttttcatctttaatatgggcataataaaaacccttcattgaattgttgcaaggattaatgaaacaacaatgaaacagttttgtacactttaatgtacaaaaagtgcttagcattttatgatgtaacagtgatatctgttacatcatgagctattattaagttaaagtcataactactgtggctgtattagcctttttacatataccataatgaatctgcccaaaaaccctggaagttttcattatttccattttacaactaaggatattacttgctcaaagtcatataattagaaagcagccaagttagggtttaagtccacaccacaaaacactattatagcacttatcagatcttttggaaagtatttacttgtgtacccagcgctcttccaggatgggaagctcccacatggcaaagaccttgtcatattcatatttcccataggaaaaatttaggaaagaatgaacaaataaatagctatgtattcagccaggggagactgatggctgtgagattccaatcctggaagaggagggaagtggctggtatggtcactgtggcaatggaacgagagccatcccctctgctcctgggtcactcactcattgcttcaatctgcacatggatgaggttctcgatgtcttcctgcagtgtctgatggggcttcagggggatgggcaggtagccatagtgctctctgttgcagaggtacatctggatgcctgaggatccaagagagggacaaagccaacaatcagaaaacatactgctgagtgacaagcgaggagaaggaacctgaactgtgtctgatgctgagtttgacactgcaattaaataagtggttgtttcaggtatgtctatagacctaaaaaatgctcctttattaaaaaagtaaaacacagcattggggactaataaaaacactcggctattcttcagcccagaggaaattgattttttccctctgaagaaaaagcaaactcatggcctggaatgaacaaaaaaggcatgaaaggatcaaaagggaggcaaggaattcccattctggagagcagaatggaacactgtaatccacctacaggaaataacaagaaaatgaggaatgaaatccacatttgatatgaaagcaaacaggaaaattctgtaacgctgacagattattaaagctaaatctaggcatacatagaacaaaaaaacgaaaaaacgaaggaaatttaaaattctccaagattctccctggttttattgcttcccttagcaggcatggatttggagccaaccaacagacatgaaacttccaaaatcagttcatatagagacaaaagagtctgcatttcagaatgtcctgttaagaacctgtagtgtgacaataccagaagtatgcaatacccttctcatattcaaattgttcttcatagccccacctgataacttgcagagttataaggcatctgtgtttaaccagacagctagaaatataggaatcaggatggtctcatacacatcattggtcagcaattgacactcctgatcaatgataagactgcttagtgaaaaggatgagtccgccatgtatccaagcctctggtccatgtatccaagcctgtgatttgttaattgcgataattgtcagtgttttccagagagataattatctgcatagggactcctctattttgtgcagatgaaatttcctccagtcagctacatcatctgtcaaatcaggtgaagctgtctcatggcattaacagagaggaaggagaaaagaaaataacctttattccctgcttttactgaatctggcttgaatcaaggctggtctaccaagcactgtcccttctcttgccttcaccgagcaaactcattagctctgctgtttgcccatatgaatgcttctggggagcttcaaagtgcaccttcttgtaaagtcatgatgaattcaggaagtggaaggaaaaatatattaaagttgcatctctaccctaattaggcaaaccattttaccatttaactttctgaggcttccataaaaaaatgatatgatacctatccaaattatccatcaagtgtgagggtacaaggaaggcatttttagacatgcaagaccataatatatttacttgccatcatactttctcagaaagctgctggatgatgtgagagaaggacgaggaggaaaggaaggaagaggaggaggaggaagaagaggaggacgattataaccaacaagaaagattataaacaacatgaacaggagagtcagtgtataagagaagagaaataagtcttaggttgatagcttcagcaccacttggattagaatatattagaaagctccagaacagacgtcttcgcaaatatgcaaaaaaggacatctgacaaatctggacattctgagaggagtttgaggtaattagtgattagttttggatcatactagtaataataaaactaagcaaaaaaggcaattattaaaggaattgcctccaaagaatggcaaaggaaaactaatcatagcctatgaatgaccaagcttggagttaggcttgcatgattacaacaagaacactgaccatcaatctgtttgaaattacaatgggagaacagggtgatgagaagaatgtgtttgcatgcagagggcaaaaaggaagaaaaagagctaactcctcacagtctatagtggagagtcaacaaataatgcccacggtgaagccagaaaatcaagaagtagcaatgcatgcatattatttaacatggaagtaaatattagagataaaagtggttgccttctggaggacagaagtgatgcagggtgatgtgcaggggactgttcatttcttaataaaccatggggaactatatgaatactttcaaccatgtgcatgggcagtttgataacagaaaatttaaaagaaaatgtattaataattagataaagtctatgaaagagtctgcactcccagtgaatgctgcttctggggaagacaatttttcttttgaaaaagagaagtgaattacgctacattttgaaggactgtttttcttttaaacatattaaacattttcttgtactcatatagtaccttaacattgcagattgatgtaattatccctatctttggtgatgaaaaatcagattcaggctgtcacttgtccaaggtcacatagtaagtcattagtgccaaatctttgtccctaaagagccaatgccaagtgctttctacccagtcagtaattggaagctcagttccaagaccattagtcactaggggattgccatccctccacaaggggacaaatttgatcactaccagtggtgttcaggatctgtctgcccattgcccatatcactcacctcttttgactcacatcagacatttggaagacgactggctggcactgggatgattcctgtggccatgatacagaacccagatcactggccacaatgggaggtgaactcttgaccctggactcattacaggaacagagacgcgcctatgaccatatgtgctctcttcttgggctagaagggtggccaagccctgctcaccagcacacttggattgctcctcactcatcacccacatggggcaatggctagagtctggggtgaaagatttaggaccaaggtttgtggttggatggtcctgcctgggacatagatgatacacagctagggagcttcagaagagtgagaacaaaagaataccaatcatatttcatgaagaaagaggaaagtgctttgctttgaaactaaggaaggaagagcctggagacatgccctgggctgcacatgactcccaggctcattcatgtttctcttgaaaatacttagagataagtacaatattaccttaaaatccacagttgtcaagaaagacctttcatttccccaaaatgacagtgaatctttcctgccttgactcctgccctgttcatggtctgcaccgccagtctggcccttagctttcactgcttcatgactattagttgtgttttcacatgtaaaaatcttaactcccaactaacaccgtgccaggaacagaaggaaacacttgggagttcatcctctctctttccttttctatctcctcttcccaaatgagtcaccaaacaactttgggtgtctacctgctttcaatgttctaaaaaagccttttcaaagtctgaccaataacacacaaaatcctggtgaacaggccaagcacagggcagagctgaaaaattcctgcttaacctgaatcatttttcccataccaatatccaggtattggtttcatacaatgtatcataataatttagttcattgcatcataataatgctttgtgcagtgactataaaggaggactctgttaggcagtgtcattcgtgtaattgttaatatctcactttcttggaacatcctaacttcaacctctgaaggaaagggattggcactcaaaggactcaaaaagccctgactttgcttcccatcctggggaagtcagagcaaatcacagaccaactgaaagaaggagtttccattaacactgacataggaatctttacaaaaatcttccaatcatatgaggattgcttttgcctagacataagggctacaaaatgcctacacctggccaaagggtctaaattgctccagcagccaagggggaaatcagcctgacccatttctaccaaatattcttattctcagcaaatctacaactgatgagtgggacatctatggctttaaggagagtctgatgtgtgaattgtagcttgaatttgtattaacattctcatctgccagccacttcctcagctgccggaggatctttgcaccatcttttccaccctcagttatatggccacagtgagtttattcaccatcttcttggtttatgaacgtatttttgctagtggttaagtgacacatttctggcacattaataatgggacccaacttctgtcaggaaagtctgaattatcctaacaaagctttgctctgttagatgccatgtgtcttgctgttgaactgctcttgtgaattttgtcctcctgaagcaagtgtagggtgaaatgagagaaataactttccttcctgttgacttgtctttctcaaaaatctccaggccccactagaaatgctttcccagtggttcataaaagacctcagtctcgctttgcctctccttccacagggactgaggctgagactgttcggtgcctctttatctgttctttccttcttctagagtgtgaaaattgcagtgcatgcatgcagagaataaagacgacattctgagcctcccttacagtgaggtattgtcctgtgactaagctctagctaacaggatttgcatggaagtactgcattcaacttctggattgcacacttcaagggacagggagagttctccctgttgtttctgccttgctggctgaaacgcatccatggtggtgagacacctgggactccacaattaagggcagtacctcgtggagtgtgagaagcaatacacaagaagcctgggactctgaacactttgtggaacaaagccactacagcagctcagactttttcaagaagaaataaacttccatttttaaagtctggggtctttgccagtgttgttttaggcctctgtgacagtttcctaattaataaatgaacttctataataaacaattgcaatgcagtagcaccacagagaagcaatcaccttcccataattcccaatatcaccaccagtccctccaactcaaaatagagtgggttcctgggtagaggccagccctggctcttggtcattggtgctcccagggacagcaacatagagggtgctggtatggttattgcagacaatttactgcctctcactaccagacatatgagggtttttttttttaataaaatgcacaaaacaaaggagctggtcattttgctgtgtctccattgtggcactacaaccaaagacaaacagtacctgcttgcctgctggagaaggcaaagacaatgatgtcatcaaaggtccaggtgtagtcctggtgtggggggtagaaagtcagcttgtccgaggcctccttcctgaggtcaattaggaaggtggagtggaccatggggacggggaagcagcctgtcctcttccattctcgaatctgaacgtagtctggggtcctcttatagaagccctgtaaaagagcaaataggtgggttgtgttttctgatttgaagtcttcatccttctcagtcatttgctagactgattcctttcaagtcattaccagctatatacaagctcccaaacaaagccaccttcactcctcttatcatggcctatgaatttccaagtgagcacaagaaatgctgtctacatataaaataatactaaaagggtcttgatataagaagtaacttttatttcagcatatctctagatttaataatttcataaaagtgtattttatgttgacttatgattaaatatgaagcatgagtattaagaagtggcagagcagttaagggcacaggttccagtgtcagactccctgagttcaaatcctacctcagctacttattgtctgtaggtatgggtcaagtgactcaaccttgctgcgcttatttcctcatctctaaaacagggatgacggcactatctactccatggggttagctgtaaaatttaagtaaggtagaacctgaatagtgttgagactactgcccagcaccaagaatgtatcagcaaataccggctcctattaaaatgacattacactgtggctaatatttgtaattaaacatgcattacttagatatacaaatgagggtcttctttcaatgcagttacttagtcaatattctggtgaagctgcagctgctccatagtttttggggattcagcttctgaaacgtccttctgcacaagcacacaggacaaccaatttccttattccaaagcttgaatcatttccagaaaagatgaagatatatctcaacaaaacatgcttacaaaacatacttgtggaagctttgccaggcattttggaaaatgttctaggtgatggcaggctcactggaatgagtgttaagttttgcaaagccagcactccgaagggcaccatactctggaagttcttatgtgttcattaatcagttgcatcacttcatggttacatttcctgttgtaattcagcatccacacataaggtgctacagcctcacctacttctctgacattcccttcaggttctagaagagtgtcctagctgagctaaccctaatgccgaccccatgataagggaggaggatcaaaaatgaggactcagaagatgtgggtctcagagtcatcttaatcaccttctagccgtttgatcttagtccatgcctaccctctttgagcctgagttttttctcctgaaaaatgggataacagctgctctgtcaatctcatagagctgcagaatgaatcacatgtgataaggtctatgaacctattttgggaactgcaattcattatatgaagtattatcattactataatgtttttattagcctttaacttaaggatcatttaacatcctctatggttttcctaatacttcagcttatgagcagtcttccaagagataaaggggactcgggttttttaaagggctgcctaagtacttgcgtctaatataaagttctagattacttaggaacaatattcccagaatgattagcttggaaaatccatgatgatgatgaatcactgaatatccttggggtgggggtgagaaggaaggaagcagggagagtgagggagaataaatgtgcctcctgcaaagaggcagagatgatgaatgtgttcctttttccacataaattgaatcttgttggtaataattcctgttcattggccagacaacatcaaggacattttgttttgaatgagtttaaaggctctgggaaccaggtcctgctttgaatttatgaagtcactggccctttctattcctgctctagtagagactaactgggatggtagaaagccaaaaataaatggaggaaaataatacttgtccctaagttgctcagaatttagttttactgtacaaaacaagtgagcacatttctcctatttgcttttaagcctgaaagtaaataaggagataatacaaatttgtaggctgcggccactaggataacccacccttgttgctgatgtcaaagcacaactcattaaaaacaaccctcaagtgattctgccatgtgaaacactgaaaatgtatgaatttaaaccaatataatgttttctcccaaggaagtgaatggctgttagaaatatgaacatattaccttcccaaaagagacacagaaaatagcacgcattcaaaatctcttacagctagaagaaataattacaacaaaagaggaatgcttcatccagtggtgtactggaccacacattgttaaattttcagaaagtttgcaaaccagttgacatgttgatagcttggaatccataaaaacaaaaatcacgttaatccccaccactctaatgacacctcatgtggcagttttacatgtttttaatagctgtatcatcaagtggctatactgcagtttacttaacctttcccttagcttaacaacatttaagctgtttgcatggtgggagtatttaaaccataaaaattggcaatgctaccaactagggtttttcccacaaagagccagttattaaacatttatcagcacactactgaccttatttctcatccaaaacaaaaccaaatataaaggggagactcaaactttagccctttggccatgagaatacattgaacatactccctctttttttgagacagggtctcagttgcttaggctgcagtgcagtggtgtgatcatagctcactgcagcctcaacttcttgggctcaagcaatactccctgctcagcctcccgaatagatggaactataggtgtgcacgacaccacaactggttaattttttgatttgttgtagagatgtggtttcgccatgttgctcatgttggtctcaaactcctgggttcaagtaattgtcctacctcagcttcccaaagtgttgaaattacaggcatgagacactgctcctggccaacatattttgcttagcacatttttatcctacattgatacatattacattaatcagttgaatttatctaattctttaattaaagaataaaaaatataaccagccatgagcattcactaaaacagaccactattttgaagattttactatgaaaaaaagaaataataaaaaatcaaaccttttttaacttgaattttataaaaataacctaccatggtagttttcattattagaactctttggaaataaatttggcaacatacatcgaaggtcattgaaatatttgtactttttttttttttttcttttttgagagggagtctcgctctgtcacccaggctggagcgcagtggcgcgacctcggctcactgcaagctccgcctcccaagttcacgccattctcctgcctcagccttccgagtagctgggactataggcgcccaacaccacgcctggctaattttttatatttttagtagagatgaggtttcaccatgttagccaggatggtctcaatctcctgaccttgtaatccgcccgccttggcctcccaaagtgctgggatcacaggtgtgagccaccgcgcctggcatatttgtactgtttgactcagtaattccacttctaaaaagctatcctaaggatataatcttaaatgctgaaaaattatattaatcatgacggtcacgatagttaaaaagttgtgaataatttaaatgtttttcaaaccgagataaaggttaagtaaattggaacatagccacttgatgataacacagttactaaaaacgtgcaagtttctatctatgatgttgttacggtgatggggatttaacatctgtcttgttggttttcttttaaactttttttaatttctaagtttttctatagtgttcttatgttagttttgtaaggacaaaaagaattaattaaaaatagtaattcctgaatcaggaattggctaatttgacgtttctaaggctaagctctttagactatttttttcataataaattaacacagaagagcccaactgggtgtagcattggacccagatttactgcccttcctaaaaaatgcttgctctgggaacacaatgacacgcatgtttcaagggagtaaacaagagaaaggtgaatgggactactgttgaccgggtgttgccttgttaaaactagtagccttaattcatttaagcaaaagacttgccttaggggtgattccgcaccagaaattagaatacaggccccgagactccagcatgggggccacaatagttttgttttctgcaatcagtagattgagggtctgtggattagtcaggaaattgtcaacatctatgaactaggaaaagaaaaggataatgttaggtgaaaaggtacttttcagtaatgagtttgagaataacccagcccttctgaaggatcccagaaacttgctcatgacatatggaaccagctatctatgtcctccttattgaaacccattgcagctaggtggctttcattcagtcaaaatatatttagtctaactttcgtatgttgggctctgcataaggcactaagcagtaaattggtgctgccatactgggcatagcctcaaccaggaaccaacctacactttggctagtgttttaggcacaagatattaatggctcccaagccattaaaggttcattcaaaaacacttattggctgcccagtctaggtacagatgggcatgcctacttagcttttctatagtaatgccagagtagctcaaaacagatctatcaatgaattttaatgtgacaagtagaatttttgtttaagtacattatatcaacccatgctaaccagtgaagctatttcctattcttagaagtccatgttaacagtgatttatttagagacagtataacaacagattctaatttataaaagaaataatcatactgaactatacactgaaaaagggataaactgacagattttaccttttgtaggttttatcacaataaaaaattcagaagtcttcatttttatgatagtccatctgtttaccccaaattttgtgatttaacatttgtacacttcaatggcatttaaacagctacacaatgttaaatattgtcagtacaatttgaaaacttctatgaaaggatttgtgtcacaagtgtgcgtgatacatttttgggcagattttcactgtggttgaggggatggggatggacataaattctccaaagagagcatcactgtgccaagcaacagatgctactccccagatcattcaggagcaaaagggaaccatttcagagctgttcagctgaatcacttttttagataattactttttcatatcccccaaattcttccaaaaagttgtaagaacaacttacattgctttacctacagcctttcctgtgagctaaaaatatgcagagttcttatgcctgttgcatggcagagaccaaataattcaggcacttcttcacttacccactgaaaatgcatgtgggcctgaagatgaagtccaggtagcccaattttaaactaccaaaaatttcattgtgcctttcttaaaaagtgggggaggcactgcctaatcaaaaaggttgttttgattgcttccatggttctagtttttggacgactgatttggatacacctgagatgacagttgtcaagaaatcaaacatctgtttttaccagaatgtagtctgaccatttttccctcgcagttcgaagggctgcctgtcgtagtttcatcacatgggcaaaccgggaggttggccagtgctttggtccaatttcatcagggtaagacctaaaataataataatagctcatcattattgagtgcctacatgtaccaggctctgtcctaaatgtttatatgtattcatttaatcttctatcaatcccaggaagtagatactattattattgttatcatcatccccatattacagatgaggaaaccggagcaatgagaagtcaagtaactcactgctcattgtatacaagaatctttacatgaaatatttcagtgggttctaatgagagccctttgaggtgagtactgctattctctgcatttcacaggtgaggatatcagggtagagcagttaagtcattcgtccaatgttacacaatggggcacaatcaagatttgaatccaagcaaaaagctcatgttcctagacaatttttatacatcccgacatcgaatagatttggagagtatgcagtgtaaaacatgagtttcccaggaaaatcaaaggtttaatctacttgttggagtctccacaaatgattccacacagcctaacacattgatctatcttaggtaaagtgaggtcgtgggatctctatcaagattcacaaaacagccaggccaagactccttcatggccacataggcaagtgggttggagcacgctccaaaacccttctgaaggcacccagctggcacggacattgatactgttgcagtaacccaaaactggccaccacttcaagatctcatagctgcactggcagtacatttgttttagtgagtgaaaaactgcaaaaacaatgagactgtaactaaacaaataaggttaataaaactatgtacagcacaggaattctctggaatatcttccccagttattgtttcaatgaaaatcagtggaattctcatttttctaaatatattccccccaaaaatgcctgttctaatattttttcacactgaccttggcatataatatatttagtcaaaacctggctgcagagaacattaccaaggtgcaaagaagggacacaaagtatttctgtgccatttttgttaggccaaactccattataaggcactctaaaggagtgtttacaatcttttacggtgttcagacttcactgttaaattttgcttgatatacagtccatgggcttggatttgagaaacacatatgtatatattatatcatatttatatatatttctttataatataaatatttataataattcttacatatagaaagactagaagaacagaaacttgttctggaatggcatttattattactataatacaaatttggctttcaataaatgacttctctggggaagaaattcaggcaactccttcattctatttctacagttccttaaagtaaaactgtagtagctttgggaacatttataatagtaagttttaaatacatttattcttgttcttatttgttcatccaaccagtattaatttagtgcctgccaagaacatggctctgaggggagagggggaatataaagtgtttatatattctagcccctgccaaagaacttacaacttatttagaaaaaaaatacattaattgcatagggggaaaatgttggttgcgtatatcattgtgccaaaaaggatgacatagaatataagcaatacaattgttgagacaaaggtagatatttataactgagtgattaagaataggtttctatagtaggcatgatttaggataagaattagttataaagaaggaaagggtcttccaggacctgcacaagcaacagtgtggggtttggaaataaaagaaacgttctggataaagcacattttcttttggtgctaaattcatggaattttaaaaatataagtcttaggtgtttgaactttgttcaggtcctaaagagtaagtgaagtatttttaataaagaaatgaaaccatttcatttgtatttgaggtagattgatttgactgtatggtatgtaggatgacttggagatagaagcaattaataaattgctatggtggccgggcacggtggctcacacctgtaatctcagcactttgggaggtcaaggcgggcagatcacagggtcaggagatcgagaccatcctggctaacatagtgaaatcccctctctactcaaaatacaaaaaaatagctgggtgtggtggcacacacctgtagtcccagctactcgggaggctgaggcaggagaattgcttgaacccaggaggcggaggttgcagtgagccaagattgcaccactgcactccagcctgggtgacatagcaagactctgtctcaaaaaaaaaaaaaaagaaagaaattgttatggtaaccaggcacaaaggctcacacctgtaatcccagcactttggaaggccaaggtgggaggatcgcttgaggccaggagttcaagaccagcctggacaacatggtgagatcatgtctctacaaaaaataaaaataaaattagccaggcatagtggtgcatggctgtggtcttagctactcaggaggttgagtgaggagtattgcctgaacccaggagtacgaggttacagtggagctatggtcatgccactgtactccagctggggtgacagagtgagaccctgtcttgaaagaaagaaggaaagagagaaagagagagagagagagagagagaaagaagagaagagaagcgaagaaaagaaaagaaagaaaagaaggaaaagaaagaaagaaggaatttctatggttaagataggaaattacctaaatgagcatcagtaggggatcaattaaataattatggtaaatgcacatacaacagtgattatgcagtaaaaaaaatgaaaattagctccttaactattgctatagaatgattatcaagataaaagttgaaaaaagcaagctctatgtagaaagtatacacattttcaatatgatcctccaaatataaaagtttgtttaaaatatgaataaataatatcaatatttaaaaatataaactgtcatggcaatttatttatgaagtaatgaaaatctgaacttggctggcagctgtgggagtaaacagcaagagagtactgtgaagatctctaaaagggagaaatggcagatattcagaactcacatagctacagaaatgaaagacaatgaaaagtcacatgtacctccaaacctggaagccctaaagagctagttaaagaggaagggtaaataatgagtttacaaatttcgcacttgctactcactctggttcatccataggcctccactccacatagtgatagagtctctgtacatttttcaaccactccctgaatatttctgttgtattatccacattgtgatcagtggctgccctgcatgagagaaagcacaatatagtttaactatgtcatccaatgaaagagagggaaatccaaaagacccctgactaactgaaagaagaatggctactcctggaaaaaaaattgtatatatgaaaataattccctcatagtccaaactagacaataaatttccaaagtgagagacactgcttaaaatcatctttgtgtcattagatcctaaaacagggctcagccaattggagaacgtgtaaatggttgcattaataaataaacacatgaaaacaccaagagagtgtaagcataaaatgaattaactgagagtcaattaatgaatcttcttggaaatttttctatatgttttaactttcagttacccaggatgtaaactccaccttttaacttcattaacaatgaccctcaatttgagcaataattctgcttcatcttcatttcaagtcaattttctgaccgcagcaaaatatctagtcaatgctgctttaatcattgtgaagctacaataataattctcaatataaaactcaaaatttaaggtatgttcaattatctattttggattaactttaccatcacgtttacaaaatagagtattttccaaagcctttaaataatgtacacaaaacttgtgcctgttctaccctgaaagtttaacaaatggatccacttgtaaaagggcctaactcatttatttaaaaagtattttcaaattgtatcacaaagcaaaacccaacacatgtaaaacagttattcagaacacctataaatgaagagataatgaaatgaaaaacagaaaaagagaagaaagcaggagttgtaatcctgacaacaaacgaggtagaattcaggccaaagagtattaagatgacaaagaaggagactttataatactaaaggaggccattcacatcaaaatatacaaagtatgaatatctatacattttcatatattacaggggttggcaaactttctttcaagcgatagatagtaaacattttaggtttacaggccatatactatctgcagctactacttaactctgccatggtagtgataaatcaaccataaacaatatgtaaatgaatgagcattgctgtgttccaacaaaactttatttacaaaaacaggcagtctgtaggctataatttgctgacccctaatatagtagaaagtatagaaactgtaaagaaaaacagaaataacaataataagagatattaacataccactttcagttaaagatggtacaaatggggaaacaagtaagtatatataggatctgtacaacatactaatagagacttctcaagtgcacatggaacatctgctagcactgaccaacaattacatcccaaagaaagcctccataaaattgaaattatataaacaacattctctgatctaaatgacatatacgtagaagttgataataaaataaaatcccccaaatccactaaaaactctcttataaagttgttttttaaaaaataacaattactagtggaaaaataaatacaaaccaatttcagaacttccaaaaattaataatgaaaatactacatatcagaattttgggatacaattaaagcagtgattagagaaaaattcagttttatatgcttaaataaataaaaataaatgagttaaatttctactcaaaaagctaggaaaaaagcaacaaagcaaacatatataaagaaattaataaagataagggtagaaagttgtgagatataaaacagaaaaagagtagaaacaaactaaaatgctacttctttgagaaagatcaataaaagacaagctgtagttaacctacctaagacaaacaaatataaaacaataagaaatggtaaggatgggaaacaagaagattgatttgaaagaaaaattttaaaaatgtgtaagcaactactttgtacaactcgatgataaatttgaaaactaaatataatagaagattttccagaaaaatgcatgttagcaaaattaactcctgaagtgatataaagcttaaatgaataatttccaagaagagagtaaacaggaaaaaaaccccaactaggctcatgtgtttttacaagggaattctaccaaatcctacaatagatacttccaatgctatacagcttgttatccagagtgcaggaaaaaaatgaaaattctaagttcttctaatattgcaagtataatattgatgtctaaaccttataaagatttacacacacacacacacaggcacacaactacagaccaatatcctttaatgcacatgctgcaaaaatcttaaatgaagtattagcaaacagagtccaacatcttattaagaaaatatagcatggtctaagaattttcaatatgaaggaatttcactaacataattcactatgtttatggacctgaagaaaaatcatgattatctctgtaaatgtgtaaaaggtctttaacaaaattccacacctaatcctggtttttaataaccacacagaatacaattcaagcagatactaaaaaaataagccactacaattaaaactgtgtggtaatgacacagggataaatgacatagggagcccagtggcacagaacagtaagtacagaaatttagtatatgataagggtgtcgtaatattcccatggaacaaacctgcacatatactccctgtatctaaaatgaaagttgaaatttaaaaataaataaagtttcatcaaaaatatatatgatataatacagttttgaaaaatgatcagaggtacacatgaaataatttagcttctattgcatcattactttcactgctatttgtaggatgatttaaaataaattgaaagtaaatataaataaaggccaagtgcggtggctcatgcccgcaattgcagcactttgggaggccaaggtgagcagatcatttgaggtcaggagtttgagaccagcctgatctacatggtgaaacccgtccctactaaaaaaaaaaaaaaacattagctgggtatggtggcacgtgcctgttagtcccagctacttgggaggctgaggcaggagaatcgcttgaacctgcaaggtggagattgcagtcagccgagatcgggccactgcactgcagcctgggtgatagagcgagatgctctctcaataaatataataaataaataaaacacaaaaaactccttttcattaaacatgaaacattatagtttttaattggttttaaattgccactaaatatattcaaaaaattttttttatctcctaaaataataatctttaagagagggaatgttcaggaatgttcaagagagaaaaatacattgttaagcaaagcacagtggaactctatttagatagggaatacatttctgtaaaataccaagaaacttaaaactatgtaacttaagccatagggtgtagaaaaatgggacatagaggtatgtaagtaatatttgaaaatattatcttgtaaaatagatacttaaattaaaactagcctacttaaaaacattatccaataactacagatgacaccaatggccaacttgatctactttcaagtgtcttcttgaaattagatgagaaccaactcttctcttctcggcaaggtctaggagggagaacgacccacaggcccacctggacattccatggcctggagagggagagaggtgatgtgtgaatctgacagttttgagggataccaggtgagcatgttaggaccaagatggggtaggaggagcccttagcaactcacagaggtgggaaagtggtccagaaagcaacgtggaagaaggccacaggctccactgagtttgtgattgtgccaaaaagtgcaacgtcagcaaaagtcacatcctttgtgactcatggccacaagctaccaacgtccagggtacgccatgaagagcgcaatgagagtctaaccactggtctcgtgataggaagcatgcagagagcaattcctgaaactcagaatttaccataaagcaccttattcttcacttaaaacattatgaagaggagtaagttaaaactaagcaaaacaaaaattccttatcacagtgttagccaaaagctatgagatttctacattattcttaaattatttataaacggcataagagaatttgccaggtgcagtggcacacacccttagtcctagctacctgacagactgaggcaggaggatcacttgagcccaggagttccaggctgcagtgagtacaactatgcctgtgaatagtcactgcactccagcctgggcaacatagtgagaccccatctcttaaaaaaaatagtctaggtaatttatacagcatctacttctttccttggttgttgtttcttcattacacaggacttcttaaattctctttgccttctctacatcaatgcatttcctaatccttttgacaaagttggtcttatcgtacgaaatgtgttttcctggtgtacagattaaacaactccaaaacctgcctaagcatccactcctgatgaacatccttagaaattagctgcctggagtatgcagaggtacagatgtctaattaaaaacagatgcacagatttcaaatattctctttattgagttaaaaaactgtctgtagtgttacttccctgaattaagattctgtttgttctcaggcttctgaggaaatgaacacgtcctccagttgtggttggagagaggtgcatgaatcctggtctttgaagtgcagggccaatctctcctacactcattcccagaggaggaagaggaggaagagcagtgagggccacaccagcccaccgaggaagcctggtggtccccgcttaagactaagtttccctgctcctcctccccaatgtcaaaaaaggcaaaaacacagaaatccaggcagacacttctaactactgccttgtaatcgctctgacaaaagtatatttccatttgaatgcataataatgaaagcaacacaggccctgggctattcagagggttggacagagagagataccaaaggcccatatgcaagctttctggaggaaacccgaggctggtgctaacggttctattttcagagccctgtagcacaaggcagcaacagcgcagtgcttgtcctgctgcagcactccacaagcatctagacacaaaaacctctgcggctgaggtggatttttccatgaagctaggaagctgagaacccagaatgtgtgaggcccctcaggaggagctgaggcacagtggcccctctctcagtctgaaggctccttggaaaatgagtactgcctcgaatctgttaccctcctcccaaccagaccagaaaaggcacccagaaaaatcgcagacatcactaatggattccttgaagaaaacaaatgatgtgcaaggacagctggacatctggagaggtgatctgcaagtaattgacagtcagtaatcaaactggaaaaccacagattgtgaaaacacaaatatgggctggctgggtgaccatgtttccgggaggctcatacggctcagtctttgcctcaattctccaactagagtggattcacacctaaatcaacacctccactcactctctcttccccagatctctgactcaggataagacaccaaggaaaggctggacacagtggctcacgcctgtaatcccagcactttgggagggtgaggcggatcacctgaggtcaggagttcaaggccagcccagccaacatggtgaaaccccgtctctactaaaaatacaaaaattaaccaggcgtggtggtgtgtgcctgtagtcccagctacttgggaagctgaggcaggaaaattgcttgtacccgggaggcggagactgcagtgagctgagatcgtgccactgcactccagcctgggtgagagagtgagattctgtctcaaaagaaaaacaacaacgacaaaaagacagcaaggagagctcagctcttgagctgtttttaattttctttgaaggtcatgttgggacaataactttcctttacctctaaggagccctggtacccgccagccaccaaggtctctcccttccacttttaggggagctgtggccctgagacagcttcagtgctcatggttggccacctctctgtccatgagtcctggcctgctttctttggagctagtacctgaaaagggagtgctggtagaaacaggtgccacatccacactggccacctcttaccctaatgctgcccatctgctttccctctgattctgcttttggttcctatttccccttcttcctcttctccagctgtgcaagttagcaaaagcccatgagtctcagattcaaaattgaattaggactaagggaaacacgtattggagatgtgatcacagcacatgtagggatccccttggctgatgatgctcccaggtcaacaggtgcactgtcaccgctacatggaagggagcacaaagagcagaccaagaagtcaacatgtctgcaggatgagacgctttactgcttggctgtggaaaaaaaaattgagatttatctggcaatgtctaaaaacattgacatttctccttgttccagaagttagttttcatttctaagtcttgcctcttaagactcagagccaactagaaataattagaactgactcatttattttgacaagtcctactgaggttgttagggctaaactcatattggtaagcatggggccactggaatcatattaaagatgaagactggatctctcagcaggtgggacacggaaactgaggacacagtactcctttattttattttatttttgagatggagtttcactcttgttgcccaggctggagtgcaatggcacaatctcagctcactgcaacctccacctcccgggttcaagtgattgccctgccttagccttctaagtagctgggattacaggcatgcgccaccatgcccagctaattttgtatttttagtagagatggggtttcaccatgtttgtcaggctggtttcgaactcctgatcctcaggtgatccacccgcctcaacctcccaaagtgctgggattacaggcatgagccaccgcacccggccaggacacggtacttctgatcacttccatctgtactgagactcagggaatgtcctcagcttccctgccacacccgagaaagtctaagacctctgtcactatagaagaggtctgcgattggtggagtagcaggatggcaacactggacaacgactgatctattgatcttgctgcctgagaacctgcaaaatacattccccagaggctcaagggaatggcagtggaatgaacaacaaacttagtcaccacctggacaatcctcaccatgactagtgagttggcaaaggtaaattttccaattcgagacttcaaacactgaactaccctctcagatgcttcttgttttcattgagcaaagaagactcactggtgtagaaaataaacagctccacctaaaaataaaattccactaatgaaagcaactactgtaattcattttcaagaaaggtcatatcatcgagtcccgccacctctgtgtccagtctcaaggaaagcctccccagcagcagacgtgccaaaggcagagacatgctcagccactcagcaaaatatgccaattgattcttctttcttggttactgggtagaattctgtctaaagatctggaatcctttttctgggtggaaactagatatggatatggttaaagacgtgaatatggattgggggtctggggattcctcccacaaaaagccttttcctagatcctattcataccaagtcacttagttgcaattcttcccaatgaactaagaaatcagaaaaactcacttctcatgaaaaattcctcaccaacaaaattaatgtttatacttcctcaacatccctcctcagtatgccccatttcatcccagaaacaatcatagacacgacacacctgaagcctgggtatatgtgatgtaaaaataaatatttgattctagaaattcaagcaaccaatcaatttcatccctaaatggcatctctaaatttttcctgatggtaaaatttgctgattgaccagttaacagtcaattcaaaagcccattatcatctttcaataaaattaataaacttaattaaacatattataattgagctattttttatactcatgattcggagatatatttttcttctctttgtgttaagaacttctcaacattatgccacacactaacccatttttagccttatgattaactaagttactcattatctttatttcccctgttatagaaaagaaggctgaggatgagaggttatgatttgctcaagtcatgcaaatggtgggtgctagagcttggcctttttatttaggccttctaatccatccctcaacacccaccctcccactccaggctccccaccacacctgtccaacaaagagtagatgaccaggaaacacctgtcaaattggaagttctctaccttgtcaaggatatgaatcaatatgaccaatatgatcatctcaggatgacaggatggaaatgctctagcaaaaaaacaaaagaaaaatgggaagattcattcattccctacaagctttgcttaggtttactttcagcataattttccttggagtcacaacccttggaattccatgaaaatatcagtgggagtgtctgagacaagacaaatatgtttctcatttgtctatctaccctcttcctgttttcgttctcctttggcccttgtttattcttcttcccacctttttcacccactcatcatggccccttttcttgtccttattggattttccaattctgttaagttctttattttgtggatgtaccctgaagacatgtagttactagttaaatgtagcactggtactaaagagaagacacagcaggatccaaaaacattttctccaggagtcctgaacctctacatctccaaacacatcaggttagattggacaccctctatctgtaattatgcatcactagcttgccatgcttccagcactgtgcttgctcttgtgttataattaactggttctatttctttcttcattacttgactttcttccctgaggacagggactgtcccagtacttaacagttcactataaaataagcacttatcatgagtttgatgagtgaatgaatgaacaatttcagggaacttctccccatccaacccaaatgcctataaatgctgagcacagataacaaagaaatgaaatgggccatgtatgagccaacagtgtgaaaggaggactgttgagaataggcacatgtgggccccaactgattgctgctgcactggaatgtgtgcccagaaatgctaggctttcaaattgtttcaagagaagctggctatctactttttagagataaaagtctatttataacctgtacaaacttttaggctgaaatgccatgaaaatattccaccctggcaggaggtctctggaaatcaacataaaaaacacattatttcatctcttaatagcccaggtccatctatccacacatgctcagggcacatatttcagtaattaaatatttcaaatatggctgggaggacagcaatactatcactttgctgctttcacaaaacagaaaacatcttccatgagaaagaaaagacaaacatgcacagattgagcaagatgtaactaattctctcaacccagtctaatatcaagagaattggaaagaagaaaaaaatgatggcagcaccacagaatgagtgtaagtgtacacttcctgcaaacaccgtacatacctcctctcattgcgcagcaactaagacatgattactgctgcacaaactttttactaacaactttattgagatatatttcacatatcgaatactcactcttctaaaatataaaattcagtggtttttagttgtgcaaccatcaccattatccaattccagaacatttccatcacctcaaaaagaaaccctacatgcattagcagtcacctctcacccctccagcccctggtaaccactattctgctttctgtccctatggatttgcctattctcgtcctttcttatcaatggaatcatatgattgtggccttttgtgtctgccttctttcactttgcatactgttttcaaggttcacgcatgttgtagcacgtaccagtacttcacttctttttatggctaaataatgttccatagtatggatatgccacattttgtttattcatttatcagttaatagacatttgggtgctttcactttctagttactatgaacgatgctgctatgaacattcatgtacaggtttttgtgtgaacatatggtttcatttaccctgagtacggctgctcaaattttaaatactatggaaaaagaataaaatttattttattttattctttaccctttgtggagaatctactatgttccaggcagtaagctgaccattttacgtatataactttaacatttaaagtaattttcctttaagtattattatccccattttacagaagaggaatgtgaggcttagagactctcttccaaagatggttttctttccatttatacttgatctttgatatgtatttttcttaatttctgaaattctcagttttctgttccaatgtagcagagaggaatcctttactctgcttcatgagtatcttggttgtacatgagatgagcagatgcaagggcccaggaatgcgtgggcagttgcaaggaagtgagaagtgtcaggtctcagcagaggagctgggtggagcagctgaaacaggacatggatgattaaactctgagtggggatgtccagcactgcctcatggtgcctggcagggcaatgctacagcaaaacatggagcctctgaaacatgaggtcatgggggaactggagccagcgcgaccacagggaaagtcacagcccaaggactgggcttgctacgtgcagcaattattgacaggaggatctccctgctctattctctggaggagaactggctgaactgcagtgacaatgtgggcaaagtggtctcttggattgaggactgggagaaagctgaaggaagtgtccatgttctgtgtagaaagatttactttgattcattcctttctggaaacaactgcagttaagaatgacaataaatattttagttatctattaatcctgagttccttgacctactattttgctaacgacatccttaatcaaataaaaagtatgaagtcaggaggcatggctctttcaccaattaactctgtaatcttaatgaatttacttgaactctctgtgctttgtttttccatctgtaaaatgggacaataacatctgctgcatctacctagctcactgggttattttgaggagccaacagcatgtgaaggagctttcaagaacactttccttgaaagctggccttcccctggctgtccccaacacacacacagatcctcaattaagaaataagacagcttgttgaataggctcttaagacacatgcaaaaaagttcaacacattcatttaagacaaacaaactagaattaccacagcctaccattttttaagaataaaagatacacatgcccatagcaaggactgctaattatctcaacatcagttcttctctttttccctagtaatagaatttttagctgagtctatgactgtccggcttaaagagtaaactttaggctcaatgacagcagagacatttgtctcttctgtttactcctccattcttaacgcttagaacagtgcctcacacatagtatgtgctcaataaatatttgttgaatggttcctttcacatcaaactcctagcctaataagaactataaaaacacctgtacagttccctcagttcaacagacactggctatgcatgtcctctgtgccggtgatcgtggcacttgctggaaagcaacaccttgtcattcacatcaagatgcacccagtttctcacagatggacaggaaatacagatgtgtaaataaataactgtaatttggtatgacattgttgacgatggatatatgacaaggtctccaagtgccagggaggagggagtggctagaaaggtgtgggaagggccacgagaggcttctcaaaggatcagaggcttgaattgggatttgaagattgagcagacattaagggaaggtagaaagaagaatgttccagaaaaaggaacaacatatgtggaggcagaaagggatgaaagagtctgatgtgtttgtggaactccacgtaaatttgttgggctaggacttacaagccaagagggcgagatggctgtaaggtgttagggctgatgcaattgtcagggatagggtaggcacaggacacagtgaagaggggtgaccccctttcctgggtccctagcatcttgccctcctttaaaaaataaactggtttataattctctgaaattatgtgtttttccagattgtgacaggtattgctgttagcatgagcatgcatttattctttgattcctcagaggaaatgttcaaaatatacatcatgtgctggcctattttattcagttccaattccatccgcaggtgcagctgccacatagtctgggttttctgcgaaaggtgtgatttctaacattcccacccattttcttcataacttcatttgtacctcccagatcatgtgtccaaagtaaacacttaacatgtgcttgttgaatgactaagtgaacaaataaatgcttgtataaatcaatgacacgaacaaaaataaagtggttatatttattaagggtctattacttaatgaaaagcagcagcaaatctgtaatagaacaatattagatgcatataaatcattttgatttttttaaaaagccatcacacttttctctgctacagtatttgtttccccattgagaaagctggactagaaatgtgaacaaagagaaaaagtataaatttacaaactgaattcaaagctgttttcccacagagtatcccagaatgacaacttggccctgactaaaaaaaaatgtcagcccagtcagtcactgttatccaatacctgttgtcttggttccaggaacaacactcctggccatttcaggagggagagacaaatgtttgctttgaatttacctgctttgagaaattttcagtctggtcttcccatatcacttcatttgtggttccttcacatggcggtggtgggggaatgttgcaggagactacagtttggcaggtgttagatacatgttcataaactatactcacacccacagtaaattgaagagtcccaagtcatatttttgaggagtcttgagttattttacttagtcgtagtgtcagggcaaacaggaggctattctgatggtatttttttttttccatttctattctggaaaactactgtcagagggaaggaacaccgtgtgctcctaacattcccagggtctgtgtggctttgtcacttgctcctgggagaggagcatgcataaatacacagcatatagatgtgttgctgttgcctttactactcactgctcttctgcagagaggggagcagtgagagcaaacctcagctaagtgctcactcctggccaggcattgacctagaactctagcaacatctcatttaatcctcacagcaaccctatgatgtagtattcttactatctccattatacagaggaggaaaatcaggtccagagaggtgacacatcatgtccaaagtctcagaggtagtaagaattagagccagacataagtcagacagctggactcatgatgtcccatctaccactactctaagaggcttattttgaagctgtcctttggagtgaagtttaaaacagaaggaaatacttttaaagatagtagagggtaaattctaactttgtcttcaaagtgctaggtatatcagtaggcttcacgttatcagtaaaactgctgcgaccacagatcatttaagtcagcttagagtccccatgggtcatgagccatcttcatgcctcagaaatatagtcaatgaagcactcataattttcaatgatgtcttaaagaatgaatggcacctaatgatgattgattgactgtcctctttaatattgctcaaaactttcagtcaagttgtttatctggtctctgacagataggtttaagaatctttgctcttgctgtgaatagagttatcagttgaaaggatgcctgatgcactagctttttaaaagcttgctccagatttcatctggtgactttggaaggtaggacacggatactgggctctagacttccaaggtgctcaagccttccccaacctccccaaatgggtaaaatcccccagttatatggtttttgggatcatgtatctcttctttctagtacttatcagagttgtaattctacatttatttctatggtactcaataatgtatttctcctctaatggtttataagctccatgagggcagggatatgtctgtctttgctcatcactgtatcctcaagcccaggacagtgcctggcatcagcactgggtaaagggttgctaaatgaataactagatgcaaaaatgccatcctcactttttacaagaaaactctaaatatttaaaacatgtatttttcaccagtaaaaatgaaatacacaatcagataaagaagacaaaatgacttttggggtacttcctctctctttcataatccatatctggaaagtttgactttcatgtgggctctggaaacaggaaggaatcagatgctgtttggtattaagctgctgaaggctccaggggagcccagtaacttatctaagaggaagtggggaatgcaatcagttgctttgaaggcagcacccaggaaatatctggccaggacagaggttcaagcaaatataattgtggtagatggtaaatatggcaacaggtgagtaattctttctggctttcattggggtgtgtcttttaagccaaattagaaatccagcaagaggatttggtatgcaccattataaacagagtccagctccagccaatgcagggagaaggctgcaacctccctttcagacccaaaaaaggacccaatgactccctgaggaacaagtagaccaaagggcagctctgaacacccttccttccccagccccaggtcaggccatgtctaaggcatactttagtctctagctgccaccatgttcttttggaggtgccatgtgaaggaagccaacaatgtccaacattcaaagttcatgtccccagaatttcctaatttttcaattgcctctgtaaattatttcagaacatgtcgctgttaaaattcttattttcattcccacatcctgatgtttagagagggaattaggcattaccagagctagatttgaactcactgacccaagtttcttcagcagaggatccaaaaggaaccaaaactttcatcaggactgttatgtgtatgaagacagaagagaagccttttggtacaaggtagcactcaagacaaggattcagtaaaataagtcacactcattttctcttgtaattcttttttttttttttttttttttttttttttgagacagagtcttgctctgtcacccaggctggagtgcagtggtgtgatctcggctcactgcaaactccagctcccgggttcacaccattctcctgcctcagcctcccaagtagctgggactacaggcacccgccaccacactctactaattttttgtatttttggtagagacagggtttcaccgtgtgagccagaatggtcttgatctcctgacctcgtgatccacccacctcggcctcccaaagtgctgggattacaggcatgagccaccgcacctggcctctcctttaattcttacaacatcctaggaagtaggtattctccgtatcttatggatgagaaaatagttacaaagctagtaagtaatggatccacgattcaagcctaattaaccctgcaaattattattattatttgagacagagtcttgctctgtcacccaggctggagtgcagtggtgtgatctcagctcactgcaacctccgccttccaggttcaagcgattctcctgcctcagcctcccgaatagctcggattactggggcgtgccaccatgcccggccaatttttgtatttttagtagagacggggtttcaccacgttggccaggctggtctcaaactcctgacctcaggtaatccgcccgccttggcctcccaaagtgctggattacaggtgtgagccactgcgcctggccttaacctgcaaattaaaggtgaattttcaaaagcaaggaatgaagagatttctttttggtaaggtcttatggggagtaataacaaaatacctggcataaaatcaaggatcctatatctagtcagattttttaaaaatagaaaataaagccaaatgtatttgactatactgcctatagataaattagattttatccagaaggcggtatggtgaagtgacttttgaaacccttcagctatttaatcctggctaaattacttaacatctctataagccttagtttccacatttgcattgttgtaaagactaagaaatcacctatgaaaagaataaacattagaaaaaaaacaaagagaagaaaaacaataacatgaatacatatcaatagtcatttctgaatacataaaatttccaaacttgtagcaagaaaattgcaaatgtaagtacttcatcagtgaaagaaataagtgctataatccaataaaaggcatttggccctgattgagagaaaaaaatctcccaaacaaccaaacatttttaaaaaatctaaccactggcaaaagtgatttttgaactccaaacctataatgaacagttcaaaacacatatagtcatgtctgaacatagatgaacaaaaatcttaaaaccttagcaaagtggaatacaacaaacgtgtcaaactcagtaaaataaacatcctcttgagtgagcagtggctggagggagaggaacaggagaaatccctaggcagcttccagagagttcttcaagcaggacattctgccagtggaggcgcagcctccggaagccagagccacgtcaggctagcaagcgctcaagggcttcttgtatactaccttgtatgtttgcttccagcgggtgtgtattttttttttctttttttggtttgactatttgtttttctaaggaaacctttggtttttcttcacatttttttccctttaatatcccaatttacttaaaatattccaattaccttaatacatgtaagtttattgtctttctttatccctttaattgcacttttatggggtattctaatttgtcatcttatcctattctccttttgaatcttacattttactttaaaaattacgtataccccattttattattatatttttactcctttttactccttatttattgtccttatattcaatctcaactgtaatacgtgtttttaacttttcaatcttattgagctctgttcttttaaactcttttacctgaattatctaagtaaacgaatcttgtgtttcttgtattttaaatcttatagtattcttttctagtcttgtcccaactggtttgacctccaatgccttgtacgctgccaggcccatgaaagacaggccataaatgttaggaaataaacagctctgcactggaccacagctggcccgcatgctggggaggaggcgcacaggcttctcccaccccttccctgcacctctgataaaccctcagggaaatcaccctgtgatcccttcaggctaacagaagaaaatctatatgaaaaagagaaggcagaaagctgaagtgataatgtttagaatccttagaagctggaattcccatctaaagacaaggcgatttaaaggtgtagacagtgattgggcttcagtgctgaacaaagacatctaaaactcaggactgataagacaaaatggacagaaaactccatgaagatgcaataaggagacctagctcaaaacattttttggactctggagctctgaaaaggggtattttctgccaagttatctatcctcagacaaaagtaaatgttttgacattcctgcaggctctgttaagttccccacctcgtgaacaaaggcctgcctagaggtgaggacctgtcagctgacactgcttatctgccttaaaacctcagtgcagtggccttctctaaacacagggcaagggtgctaactggagaagcctgcagttctctctcaagtgagaaatacctactgacagaaactgaaggtctggacatacagcaggtgtccaagactctaagaaagtaaatactacatgggttgaggaaatgacctattataaatggggtgaatatgcacccagagggcactgccactcaggcaatcaaaatattaactacttaggcttttttacatttttgagcttatcgaaagaatttcgatggtatagtgcctgagtcaggaagggggtcaatacacatgaggtgaatgagtgaatggacaaatgaataaatgaataaacaaattcatggcgtggatcaggggcaggcagtgtaaaaagctctatagaacaagaggcttaaggtctggccacaagcccaccatcaacctagcatggaatttcaagtaaatcaatttacttctcaagttcattttctgtagaaaaaaaccacattttgcttaacggagttgttgtgaagataaacataaaataaaaaagattccccccacagtattctgtatagtaagacattataaattgttatatgtcttactataaattttaccatgtaagattatatagacgtttaagagaatgataaatgaacccttgtacataccacctagcttaagaagtagatttctttgaagtccgctttgtgccttccctagttactcctcttccttctcggccaataatctctagtctgaatttttggttattaattcccttagtattttttatagcagaggtgtccaatctcttggcttccctgggccacactggaagaagaagaattgtcttgggctacacataaaatacattaacactaacgatagctgatgagctataaaaaaattgcaaaaacaacctcataatgtttcaagaaagtttacaaatttgtgttgggctgcattcaaaaccgtcctgggctgcatgtggcccatgggccgtgggttggacaagcttgctttatagtttcactacatatgtatataaccccaaacaaactatactttaggctgtttttgaactttatataaatagattcatgttacatgtgttttctgtaggcttaacactgacttaaaacttacacatgttgatacttttatctgtagttgataaattcactgccaatgctgtaatacctcactgtattattatactataatttagtgatctatttgactgtcagtggacatttagcatatttccagatttttgcaattacaaacaatgctgctatgacctttgttgcacgtatcccctgctgtatatgaacaatagtgcatttaggagtggcattcctggatctgtcataggtctgaatatgttcaactttactagggaatgccaaattgtcttcaaagtagttgcaccaattgatagtcccaggagcagtatatgcaagtgtctattgcatatatattcccagcaatgcttagaatgttgtcagattttaaaatttttgccaacctggctgctgagaaacgatacattattgtggtatttatctgcatctccttattacttatcaggtggtggaatgtttcatatatttatggtcattcatgtgcttcctcttttgtgaaacctgtttgtatttttgcccatttttctgttaggttctttgatttttctcttttattcatgagttcttcgttgattctctacattatttctctgtcggttggttgattctcaatactattcctctgttggttgcaaaaatgatttcccactttatgggttgtttgtccactatttttaggatgtcttttgatagaaagtcccctcatcttattgttttgctttttgaatgacttgagtattcttggtcctttgttctttcaaataaatcttataatcagcatctcagagtgcatgaacaatcctcttgggatttttattagaattgcattaaattaatcgtctggagagaatcattatctttatcaatttttcctttccatgtacatctatgtctccacatttattttggccttccttaatgtttttaataaagtttcagaattttttcataaagatattatttttgttagatttattcttaggtaccttacatttttggtttctactataaataatatttttaaataaatgagtatctgttagatactcagttggtatctaacagaaatgcagttgactttcatatgtgaattctgctatatttttctaccaatttgtataatttatctgcaaattctattgcattttctctgtagataatcatatctacatacatacataatgattgctttacttcttcctttctaatttttaaccttttacttcctttatttatagcatttcaccatcaaatatgatatttgttacagtctgctttggtgtttggcttttcttattgttttgttttgtgggtagcatttattgggttgagaaaattttcttggtgagagttttgtttcgaatgattgctgaaataaaacactttttgcatctattgagatgaacatatggctttttcccgttaatttgtcgatatgataaaatgcatctgtagattctctaatgttgagctaactttccattcctggtgtaaactcaactcaatgcagtatctttttgctatgttgtcggatttggtttattagtactttgcttaggatttttacatttatgtatatgggtaaaattaggtagtattttcttttattatacggtcctcatatgattttagtattacgttatgttaacctcacgaaataaattggaaaaagtattccctgcttttctaatcactcaatgagtatatataatgttggaatgatcttttcatgaaataatatataaagcctataaaatcttctgggcctaatggtttctttgggggaagattttaaactactgactcaatttcttcaatgtttataaaaacgtgcaggatttctttcttcatgagtcagactgttatatgtatttctctcagaattttaaatattttacctaatttctcaaatttattagtataaatgtatttatagcattcttatattctcaatattagttacatcattatttatgtattctccttttcatcctttatactgtttgtatgaccagtcttaccaggattttattttattgttcttttcatagaaccatatattggattattagtcctctttgatatcttcagtttctatttcattaatttctgtctttatatgcattattttcttccttgtctccttgggtttattctgtttttttacccgcaaatgtcttaagttcacctcttagcttatttagtaaaataaaagtcaaggccttctaaatttccattattatttcttccttgatccttgacttatttataattgtgacttttattttccaaatcatggcaatttttgagttattttgcttttggtttccgtctggttgtgatatattctgagaatgtgatatgatgccaattcctttcaacttttcagtctcgttttttggcctctatgtgtctattttttgtaaaaggtccatgtgtgtcagagaagaaaatatgttctgcagtggtggtactttttttcaatttttcttttcttaacttattgattgattgattgagatgttttcctctcattttatgtttctccctcagtagttaacggctatcataaaaataagatgtgtatatctaacttgacaaagtttaaatttaataaaaatgttaccctctccaaatcaatacaaggaacttagaatgatttaactatagtcacccccatcccaaatgaaatattgttacgtcatattttagttttatcttgattttgtaatcccttaaattgcacagtattgttctcattttataaagtcaattaatttaagatccacccacgtgtttaacattttctttgttcatcatagatttctgcatcttaagtctttattatttaccttttccctgaagtacatggatttaggtgattctttacctactagtaaattatctcaatttttgtttatctgaaaatgtctccaattgactctccttattgaaaggaagtgttgctaggtgtacaattctaagaggacagtgtatttcagccccccattttttttttttttttttttttgagactgagtctcgctctgtcgcccaggctggagtgcagtggagcgatctcggctcactgcaagctctgcctcccgggttcacgccattctcctgcctcagcctcccgagtatctgggactacaggcgcccgccaccacgcctggctaattttttgtatttctttttagtagagacggggtttcactgtgttagccaggatgttctcggtctcctgacctcgtgatccgtctgcctcggcctcccgaagtgctgggattacaggcgtgagccaccacgccaggcctatttcagtcctttaaagatgttattctggctttgatatttgctcttgaaaagtctcctgtactatgttgttcttttttggtaatctatcctttctctctgctgttttaaaggtcttctacttttttaaaaaaaataaaataaatatttttcagcttaactatgatgcatcaagttgtggctttctttttatttattctgcttgagattcattggaatctggatctgaagattggtatcttttatagattttggaaaattcttacccatattatgtccaagtactgtctatccctcaatcttttaaaaatatacttctggaattccaacaagcatatattaaagcttctcatgttttcttccatatgtctaaacctctctttcatagtttccatctttttgactttatatactgcatgcagtataattttttaactctattttccagtttgttactttgttcttatgatgtacttaaagcatcattttctttcatttctagagatgactaatatatcccaatttcacattttcatatatgcagataatcaaattttccccagcacattcgtgtcacaccaagttaatttacatatttattgaactattattctgggtctcttgattattaggaaagtcagttgaaatcacatagaaatataacatcccatgaaatgccctgcttcctgcttcttactccctgaatctcatagtcattataatctgcaggtaaagttgcaaggccaaatccttaggtgtagttgggaatatcccacaggtctaaaagtctgggcctaatgcttctctggcagaaattttcattgctttataaggttcttccaagtacagcctttgaatgacaaagtttaaaccctctagctatgccaccccttgctcctattttatcttcctcacaccattttgaagattatgatttttccattttgctgctactgaaagcaaacactagactagtggaagtttgggttgggagccagcccagtgctcactgtacatccatcctgggctcctatctagcctgttccacaggctgtgcttctatcaccagcaggatttgagggcctgggcccaacaataaacgaagtccacttggcctggagaggactactgctgtcaggtgacagctgcccctggctgggagaagaaacctgggctagactccatgccaggaaataaactcatggccatctgcattccctttcatgactcagccgttctttatgaaaggatttactgtgtgaggagtaggaggctagaagatctgaaagaagaaacagcaaaggggattactaagccattgaaacaaagatgaaaaaatagctttccctaggcaggctgctgctttgtagcgacaggaagagaattttccacttaaagaataattattatagagaaagttaatctttgtatacacaattcagataccacaaaaataaaataggaccaaataaccttattgggacctcagagataagcagtaatattttggctgataaatgctgagtttataacttagtcctattctagtttggtacagtgaaaaaaggacttaggtctggattcttattccatgctttctgtctttctatcttgatgccattgttattttggatttttcatcactctcagccaaaataatcttgatgcaaaagactgggcttaatatctaccagaatttaaaattcacatttttttaacccagcaataccacttataagattatatcctataaatatactggaatagcattaaaatatataataaaaatatcaaaagactgtgatatcaaaagaatggaaacaaactaaataaagatataataaaaatatcaaaatactgtgctatcaaaagaatggaaacaaactaaatattcaacagtaggtgactggttgtgaaaatgatgtatacattattatgtagccataaagagtctcagagatctatatggaataatctccacatttcagggggaaagatcatatattgaactttccaaatacaactgcaacaatatctctcatctcatgatgtgactttgacattcctcctatcaaaagatagggattaggtcccctcctcttaaatctgggaagcagaagtgacactgtctgatttccaaggctaagtcagaaaaggcaaggcagctttctctgtgttggccaaaaagactcatgactggagtccaaagtcactgtgtaagaggctgccatgctgtgaggaagccaaacacatggagagaccatgtgctctactaccgagtagatgatctactaccgatagatgctctgctcaatagtccttgtcttcaaatccgtccagtccagggaccagtcatgggagtgatgagccttcagatggctgcagcctcccagccttccagtcttttgagccaaggttgcagatatcatggaacctataaggttccagggaaaagtcacccctgctgtgccctttatgaatttccaaatcacagaattgatgattgtggtaaaacagttgtgcttttttgatactaagtttgaggtggcttcttgcacagatagtatgtttttaaagagttattcttcactgtttgctttttcataccatttcaatttttctattaccatgtacatacattattacattttccaagtctatataaaataaggacatttgctaggaaactatgatgccagagacaagcaggtctgccggcttccactagtaacacgactctgaaagcccaaatccccactgagcacatgtgaaaaagtccaaagaagacgaagaggatattccaggctttttagtttttaaaatcagatatcatactcccacaactatagtatgtcaacatgatacaaaccttatcagtatttttttcacaacaaattattaattgaaaaagaaaaccaccaccatgcaggatctaaaacggcattatttttttaatcatagattaaggtgcaggttgaatataaccttcacttcacatcttccaaatagtaagctagctacggtcttaaaatccatgtctagtttatccaaagaaggctttgggaggctaaatgagaacctaagatgtaaaaggttgtcactcttccctaaccatggcaaggtgcaagaaagcagcacaactttggaattcatagaggtgtcctgaagtctggtaataataggaaaaaaacccataactacccactttgcaaaactttgaagttaatagaaaaagtaggaggtaaacagtaacacaaaggatttattccaaataatatcagaaatatgcaaagaataacaaagcagagtgatctacatctttaactgtgttctacaacatttttaggtatttttaagtttctctatttcatttaattttaaacaacccttttaggaggagatgtaaccagaggcaactacttctctataaaaatcactcagcaactatatagtatacatgatacagaattttctatttccataatctctaaactggcactgtagatgatttacaaacatcctgagggacaatggcccttggtagacaccatagagaacattaatgttctggtaattttgtagaaaaattattctagtctgctgtactgcaaaacagtctcactacagagccacagggagccactgcacaggacaagaggagggggagatgggagtcacagagagcacagggagtcacagagagtcacagagcagggggacgtgggagtcacagagagatccttccctcgagggatcggtggtttgtcatggagttgattctgaaggccatcaaaaccttcctcatatcatgaagtttgtgaaaaccattgggaataattaatgttttatactcaaagaaagctgtcatttcttttaacaaggaatagaaactggggccaggaggcccctgaaaacagaggcatgatggaatgctggctgagggctcccgcaagtgatccacagccctctttgcctcagcctgcctggaaccaggacaaggacccagagcacgctactgagccggggctcagtcaacatctgtggaaagaatgactggcaaggaaggcccaaacttctccaggctccctgggcctatggatgcagacctgttaaaaagtgtcagctcctcagaaagcttggctttctccttcaccttctcacacaggacctctagtcctggcagaggctccctgaccccgtcacttcatgtgaactggttgtcttaatctctcctagttgctaagttgctctcttgccatagtacttctttgctagtggcagaaggatggggagtggggatatttctggttagtggagcaaaggcttcagtgtgtcacagaatgtggtctctaaggcccagacaactgtgtgggatctagcctaggtatcaatttgaaaagagctacctggttatactcagaattcccacctatgcccttcctgcctggaactctttgacaggaagacttttctcctgcaagctttctcagcactctgcacagcccatccacactctgcctctccgtcctcactccaccaagtcaccagtcatatctctgcagagctggcccctgagtgctgatagaactcgacttattccccaggagacacctcagccctggtgcgaatcatgagacctctcctccactgggcctgtctcatgagttcacagatgaggccagtggtgcctgaaccccaacacaagacagaaagtgcaagttattggatggatgagaatgtcagagaaagtcaacaggacccggtggcaaattttaatctgtttgctatcatagaaacttgggaagggttttaggtatctaaggaagaaaaaagctcttcccctgctgttggaggagagttattggaaagaaaccatcttcataccagtttctttccccatcctgctatatttctctctcccttctagtatgtggttaaacaaaattgggagcatactatatgtacagttttctatgctctagggagcacttgttcatataatttcaagaaagcttgaaaacattctttcattccactcccatatgttgaacatttaacttgttcccaatttttcatttttataaataatgcatggtgaatattcggttcataaatctttaactgcaactctggttattttcttagactagagctaaaaaaattagagtatgggccgggcacggtggctcaggcctgtaatcccagctctttgggaggccgaggtgggcggatcacctgaggtcgggagttgaagacaagcctgatcaacacggagaagcctcgtctctactaaaaatacaaaattagctgggcgtggtggtgcatgcctgtaatcccagctacttgggagtctgaggcaggagaatcgcttgaacctgggaggcagaggttatggtgagccgagatcatgccattgcactccagcctgggcaacaagagcgaaactccatctcaaaaaacaataaaaataaaataataataataataataataaaaagattatgagggcaaaggatactaacataactgaggctatttatttatattaaactacccttcagaaaagtaataacttatagtactaggaatacccaggcctgattccacatcttcaccaaccctgcataatatcattgttttaacattgctaattacttttaaacaacccatatacaagttgtacctcactgattctaataacgtattttccctcctctatcttaacatctctgaattcactggcactttgcaatacctggcatctgccaatcactttagaccagtcagtagatgccacttagttatctgtgatgagtgaacttggttgttcattctagttttaccattgaacaactactatccctcaagatttcagtcaaaaagctcttagggaccatttgaggaagcagtgttagccatggttgctaacacatcctggtaagatcaaagcagaggcagcattaaaatgtgcagtatgggtgtcagtggcttagaagaaaatcctagaaacaaaagcagagcacaatgcaatgctgcaaccccaagctcatgaaggcacagggaataacaccatgtgcaaagcacagacctctatgactcttgggaaaaaggtgattctggagagttggactctgcctgtgaagttttcggcaaatctcaatccctttatttcttttattattgtatgtgttcacaagagataaacatctatgtctcaacaactctaaaagagatattttgataagcataagataaaaattctaagtgataagaaataattatgccatagtttaacttgcggctttcctttctttttctacaatacataaaatcatggtatatcagacttgattaaatatcatattttaaaatatgagagtattttacaataatggaaactgaagtaattttcaaacgatacataatacttgcaacaaatcatgtagattttaccttaatctgtgggtaggtcttgccctcctaatatgttccttcctccttagagaagagttagaatagggcacatttcctggggactgcagctgctccaagaaccaagaccacagttccatttggtgtggagctctgtgaaattggttcacagtggccatggcccccagggtcctcaagcttatcccaggttcctcaaacattttgaaaagagctctaccctactgtttttctttaatctttcctctaccaacattacctcatctttctcaataaaaatctctcagaactattaaagtagaatacataaacagatccattttattaaacaaatattcatcaccccccattaccagggcccacgcttggcactggacatgaactaggatcacagaatgcttcctgctaactaagaactaaaagtctaatgggaaaaattacttattaatctcaaaaggaaaatactactatacactagagaagttggaaatacattaaccaagtgatcaaaattaacatcactagaaaggggcaaacagacgtcaaccttcagatgtgataccaaagacacgtgacttatacagtattccaaatggataaacaaaagctaatcatgaggaaacattggagaagcagtggaatattttataaatgacaggcctgtatttttttaagatcgatagtatcaaagagaaaggctgaaattaaatattaattcagattaaaggagactaaagagacagaatgacttaatgccataaatgattttagactggatcttgttttaaaaagaaaattctataaatgacattacaacaattcataaaatgatgacatgtagattgtagatgaaagtattgtatcagatctgggcattgtggctcatccctgtaatcctaacattttgggaggttgaggcgggaggatcatttgaggccagaagtttgagaccagcctgagcacatattgagaaccccacctccacaagttttctttaaattagccaggcttggtggtgcatgcttgtagtcacagttacttgggaggctaaggcaggaggatcccttgagccccagagttcaaggctgcagtgagctatgatcatgtcactgtactctagcctgggcaacagaattagatcctgtctctaaaaaatacattgcatcagtttaaacttcccgaatatgataactgaactacagatatgtaaaagaaaatattcttatacctaggaaaaatacactgaagtatttttagtagaggcatgaggtttgcaaactatctcaaataattaaaaaataatatgtataaaaacactcatatagagagaatgatagagcaaatataacaaaatgttggtatatgagagacctttgtgttattcttgcaacttttctgtaatgtttgaaattatttcaaaataaaaagtaaaacaatagataattcacatgaaagtcttctgtgtatacttatttgtaaggttgtagtacaattaaagagaactctgttcttaaagtaaaaaataagatctaatagacaagaagtatagacaaataagcctgcaaacttcagtgctatgagttctgacacattaatctccacatcctgagaaatgaacctgaacaaagtcaagatcagagaggcagttgtcagcattaaacatgatttgttaaatgtgaattaagaacaacaaaattttccttctgtttcaacatcctgaaattgcattttattaagagattgacattttcgtaatcaacataatttccttcaatcctttttggaaaagggtgaggtataagtacaattaatagatgcatgattcttaccttgtccctttctcagtatgtattatatttggtcaattatgccagaaagctcctaaatctagattgtaaatggcagctcttcagattatgtctacttattttatcctctgttttttcttgtcttattctccatatgaatcccccttacttcctctaaacctcaaaataacagtttttatgattctttcagattttaaacagagaattatgagtagatcatcttggggattatattcatattgttgacagaagacaataccacttttttccaaatcactgaatgcccagaacctggtagtaatggtccaagaagttaatggagacagagagagttaagacaaaatatttttgtttaaatttaaaatttgcaattattatggtattttaaaaatctgacttctcttcctgcctcttggtcataatttctatttattctacttttgcttgtgttctgtaggcatcacagatctcatgccaaggctctgcccagtgtagagagctaagtaacacgaaagcactgaacatcccaaagaaaagtccagtttccatacactcatcagttatgactatgtccatgctgtagattcctggaggtaccaatggagttgccagttgctgtcacttcatcaagggggaggatcctgcaaaatcttccactggatacagagaggtttccagcatggctctggggtctagattttttcacctaaaaatctacagggaccagccagtcatgcaggtgaataatgtggttgagagactacataccccgactcaaggtatggccattattctgccatttagaaattcaggcccagtaataccaaagtttccaattcttaaagagaaggcagaaatccagatttttataggaaatccttaaatattggcaatttaaaaagagcaggttcaatctggcccacaggcacctagtttaggatctctgctacaggttttaccaactgtgtctacaggtatttaccaactgtgtctcctcactaaagagtctggcagcctgggagagcttcgctatggaatcatcaaatgtctccaaatcttgaaaggcacagaggggcaaggagctaactgaactccaaagacatcatggtgatttagaggcaaataatatgttttctagaaatgatgagatttttttccccacctttcctcctaccagtcttcccttctgtcctctcaaagaatgaggtacacaggcctgagtgaaggacaatctcctagaaccatgaccaaagaacagtggctactgtgaggacagaaaggaaatatgacagagtaactacagatccaaactgagggccaccaaataccctgcttttgatcaacatctgggggaaagaacttcaaggtttctttgaactcagtcagcctttgctccaaaagtactggccacctttcacaacggcatcaatggaatctcctgtccagattttgggctgctgaaataaaggatcatcggctcctgggagatggatgacagccatagagtaggaagccaatagtgccctccagccagaggaagcaaatacaacaggccagtggggaggaaggcctgtttttaattctcagtggcatcatgctgtggctcagtgagggactctgaatggggaggaggccattacttgacatataattaccagtggcagcaatctaccaaagaggctaatggagatccaagggctatttcagctttttcaagaaacaattcaaagccttgtcagaataaaatccacatttcctctttctccttagtacatttccctacctagagtcaagcacgttaagacactgttcacagctgtaaagtgaatgctagctcgcaggtgccagccccgtggtttgctttgggagccgatttaatgaaagctggaattgggaccagtaaagctttcatttcagggccattctccaacatagttgtctgacaacttaactgggaaagataaattatccagagagagattactatgcacaacctcctttttctttccaactcactccagagtaattccaacctccagttaccttccaatctgtctgctgaaaaccttttccttgtttactgccatctgctacataggaaacccagacaacctccatcctcactactctgatttaaggagccagacagtaggtgcaaacccggcttccttgttccaatcggctgttatgcttcttcactatttaaacgtgtggtcagggagcattctcttagtaattcaaggggtcaccatctcaaactcttcctttgctctcaatgtcattgcgtagttatagtcagtaggcagctctctcggctgcctacttttagatggtgtaaaccctatatgtaaaacctacatgtgaggtgtaagtgggtgtcaatctgggcagttggttaatatgttcccagactgtgacataaaccaataataaatgtaactgaccagcagggtttggctggaaatgaaaatcttacacattctctgcactcgcactggcttttaccatagaatattttattataattcataattgtgtaatctccaagaaaactataagaaaataagggaaggaaaagggcagaaaaggaatgatttttctttgtcctttctcatgcctgttgaggatgacatttctccttttccccaaaaaagaataaagaaaaataggatatcaaataaaagagaatagagttttcccacaatctctcatgcatctagaccatcatggtccacaaccctgcatttctgctgcctccttctttaggatgatgagtaaaaatgatttttcaaatccactaatcttataagcctttttgtgcaaatgtctctctaagtatttaaaaacactgtaaaatattgtattagtaatacaaacacagaaaagaaactatttattcagagattttgatagtcaccaaatctaaagccaaccatgtgtgtgttattcccacagcatctaggattattagaggaaaaatatgttttcttttaaacaaaatgaaaacatgatgctggatcacatttccaaattctttttcttaaaagagagagaaaaaagattgaatctattttcataataagtatggatgactcttggaaacaatgaacctttgtttttactgaacttagcagtataatcaagaaactgtacattttcagtgtgtacatggaaattctaataaacataaaattcatcctcactgtgcatttcaaaggcagtctattcctatcatcaaaaaagcaaaataagaaaatggttcccacagaagagaatcccaatttttctggttcttgagaaaagcatgtgatctctgttttgatcctaactttgtaaccagataggccattgaggaacttggaggaggaaacaatcagttgtctttgaggatctcagttttatcataaaatgcaaataaataaagtggctattgatgtgaaaatctattacaataacttgtttaccttttcccaaatatttaccgagcagcttcctataaggcacctcagtgctagaacctggagattcaaaaagaagagggcgggccctcaagaagctgagcctagggggcagatccaaaaaagtaaacataattaagaatagttataagagtgttaagggaggccaggtgcggtggctcacgcctgtaatctcagcactttgggaggccaaggcgggtggatcatttgaggtcaggagttcaagaccagcttggccaccatggtgaaacctcatctgtactaaaaatacaaaaattagctgggtgtggtggtgcacgactgtaatcccagctactcaggaggctgacgcaggagaattacttgaacctggtagacagagattgcagcgagccaagactgtgccactgcactccagcctgggcgacagagtcagactccatctcaaaacaaacaaacaaacaaaacagcattgtgggagattcggtaaagcacacaataggtctcagcccagatttcaatacctgcaagaatctactcaaagaaggtgtggtctgttacaaaccttaaaaaataggcaagtggtgtggagaggtagtctgaatctaaaaaagagcatttataaaggtccagaggccagagagagttgtggccctgtggaaggcagttcaacatgattgcagcatgagggaagaatggggaaggacggggcgggagaaactggcagaacccttgtatcttgaagggccttgcatgccattccaaggtatacggattttaccctcaaaggtctttgaaggtttgggagtaatatggccaagttttacctaaagaaaggtcatgtagcttccagtgtgtataatggatgaattggtgggagggggggtaaaacagaggggcagagcaatccattaggaaatgggagatggcggtgacttgaactaaggaagtggcagaacagataggaaaaagtgaaaaaaatctagaggattaagtaggaacaactgacaaaaactgattaataacttgatatggatgatgggggagaggtccatgtttctgttttgggcaaatgcttgcatggcggtgggaatataggagacagagctggttgagaaaaggaatgagaaagtggagagatcagtctgagatataagttagaggaatctctggaccattcacatgaaaatgtcaggagatctctaggtcttgagctggagagacaccatcagggagagaatagagagttgggagtcataggcatacatttggtaactgaagctacaggaacggaccagactacttgaggtgaggttttccaacgaaaagaaagccaaatctagatcccaggggaacaccacttttaagaaacatgtattgagaaatgagtaagccaaagggaagacagcaaggtaagaagaaaattaggaaggtggaaccatggatctgagcgaaggcactgttataaaaaaggaaactggtccacatgattgaatgcagcagaaaggggactgaagagaaagtgaagtcaaagtgacactggatttaatgagggggattactcattaaatggtgatcttggcaaggaaactttcagtggagtggtgagtgtggaaacttgattatggaaaccagatgagaaatgaatgcaagtgagaatgctaaactggcaaatgtcgaccattctctcaagaagtttgactctaagtccttgaaggctggcactgtgcctcattctctgttgtatcctgaggtataatatcaacaagtaataaataaatatctgttgaattaattctaaacaagggaagaagatgaggcaaaggctactgggaggatgggtcaaggaaaaggatgagattgagagtaaaaatgagaagtttactttagacaggatgaaatctctcttccagaagaacaggagtagaagaggtcacaaaattgaaataattttcatccactagctttagttttattgatgaattcagaagcaaggtgatctactgaaaatgtccatggaaatgatgaagtaagtagatctagaagagtaaatagcaagctttgcaagggaaacaaaaagatcagtgggcagctgagggcccacttgagggtggagggattcaccctgtgtgacaaaattaacacagacatggggctgggggatgaacagtcctcagaactagagactgcaggaggatggatctgggattgggctttttctagtgggtaaaaaaaaaaagatgccagaggaagggaatctcagatatttgcaattggtccacgctagaaggaactgaagaccaaaggaaactttggtagcaagtaaagtatcaagagggtcttaaagaagatcagatcagattgtagggaacatggcagaatgagagctgaaggtttgttatagagggatattctatgtgaatgtaaggtaaatacacatctatcctgttgcttttaggtctggctaccatgaccaggtgctctaaccaacgttgccaacctcatctcattgcccccaggctctcagaacagtgccttgttcctcaacccactgtgcttcttttgtgatgctgggcttcccaaggggagaaatgcagtattttactcactctgagagtccaattcccgccattagagacattcttgatatctgtagtgaatgaataaatgaaagaatgtctccgcatgtttgcacatcttctaatttggtgaaatgtagactgttgtgctcactctccctgtgtaggtacctatggagtattctaagttctgagatcccacgcaacagatccctggccctctgccatgatgttcttctgttgaaagttagggaagatgctctagaaggaactgtggggctgatgtgaaggagaggtgatgctttagtgccagatgacaagccagggagttcacagaacaccttgtggtgtagagaatttggtaaattgagtaaaaagctatctacgtgaaactataaggagtccctaagtcccagctgtagatgccatagatgtggcaaactattaaatattagatattctaattcactgtaatttattgacagtcactattagctttagtgaatatgctgaagaagttaaaatgtcaaaggtgatgttataaaaatgaattcttactccaggcatcaaactgtcatgggtggctttatttatagacacatagtggtttctgaggccatacacagttaataaaatgtgacagaatgagtttttcatgcactataacccttagttattaaatttatctcagagtcaaaatgatttagaatttttcactttgattataaattatcagtcactaaaatttttatcattcactgaattacaccaaagattcagtaaaaattatatagcaaatctggagtgggacttctcatgctaagaattgtctaagtcaatgcggcaaaagcagccatatggaatgtttgcaaagcattttattgtgggaaataaatgtgggtgttaaaatactatgtataactacaaatttaggcatgctaattttatcagcagcgagatttcagtgttaaggctaaacttcattaattcagaaagcactaacatagaactttaaaagaacagctggtgtgtgaggtaataaaaagtaaaaacaagttttcaaaaggaatatttctaccactcaagtggcattgggtggggcagcaggcaggtgctgtgttttaaagctaaagacctaggcaggattgaatctagcttttgtggggctggaagcttatataacctgggggagcccattttaagaagaaggatacaaaattcaaaatgtaaaattaaatttcaaaagtgaattttttatataaaaatatataaagtaactatttgttcaaaatgagaaaagaaattataatatttttaaaagctgagtaatgccacaagcattcaaaactcagaaaaatattttattagttaactgcctgacatattgctgttaatttacttccttatattgttgtttatatactctcaacctcttcatatagcaaatatctatatctttttgtatagaaagaaaagcaatataatttagtcttccctcaaccaaagttgattgaaacttggttttactaacagtttagaaaagtttcaagccatttcactgtgttgatgacagtgttatgtgccatttcaaatggaaccgccaaactttgtcaggctacatgcatttgatctgttagaacacagtctaacctaaggtgctgtaatgtataaaatgttatgtacttggacatactctctgttcatagtactgccacaagtttgtgctcttcaaacacagcaatcctgatatcttctaattcatgtgatttttatagcaaaaaagaaatgcatctgatgtacttataattatattaaattgtattcacttcattatcaagtatgtttctggcagttttgttttgacaaggcatagagagaattaagtcattcacttgaaatttttcatgtctgatgattggaagtattttcccgagacaagtttcaattgttgtttctcctccggccctcaattacttttgataccagccagacggcagagcctttggtcctttcccacgtgtcaagtgaaccacaagagtaataacctacatatggaagtaactataagccgcattattccaccgactgcaaactaaatgcatccccaagttaacttcccctcaaccagatcacagatacgtccagggccactccagtgccacccaaaacaagaagtatgatagaggggaagttggctaagtggtcttagccaattgcttataaaatatttcttttcacagattttaccaaaacaaatgtgaatacattgtgatgggcccctggagcaggcagactaaagtgcaagcttcattagcatcacagttaaccacttctgggcctgggcaggtcactgttttgtcctaagcatggcactccggaaaaatcttaatttgtctgaacttcagtttccccttagtgagatgaggctactactactactatgtgtttcacagggctgttgtgagctcggaatgagttaattcatgggaaccattatcataatgcttggtaaacagtaaatgtttaataaatattagctttcattattaagcaaaagatgttataaattgcaggatactacataacaaattggttagaagaataattcatataccaacaaacaataaagacattaagcagacacaattgtcatgttagttaaagctaatttcctattttattattaccctaaataactatatatatttgaaaacaacaaaactactttttaaaaattatatctgaccaaaagctcgaggctgcagtgggctacgatcatgccactgcacttcagcctgggcagcacagtgaggccctgtttcaaaaagaaaaaaaaaattatatctgagagatttaacttgtacagatggaataccacctcttcccatctcactatatttgaaatggggttggggtggggtaggtgatttgttgccctatagtattttaggaggaagaagaatgtttcttttctagtattaattgttctaactggtgtgttatatttcctttcctaggaagcacataaagaattccattcccagaaatcaaggtttcaaaacatcttcagaagcaaagtaaacaaaatggaaaacaaatcttaacaataattttattcataggaaattttttcattgctaataaaatctaggaacactataaacttttttcagactatacaaattctttttttaccttgaaaatctaaatatttattaagtaataggtaatactgcacaaaatatctaagtgagaaagcatgaggtattttagagtcaaatttgacacagaagcctctacataaatgaatatacaatctttcaaagtcataaattagtatgctgcaagattctccagacagcagggatcagaataaactgagaaggaagaaatatttcctgccagtagcaagcagtaaaaatgccaaatgcagggaaggaggggaagcgttttaaaaatcaaatggggttcatcatgggaccatacatctgcctaaagcaaaccagattataattcgtgttttattagagattagacttgcaaacatcttgagtttcaacacttgaatttgaacggctgaggacctttctcatggtccctaaaaatgtgcctctcctttcaaaaagaaacaaatcattgctttctattccgatttttggcttctcaatagcaactcacttcttggttgtactctatgggaggcacaataaataccattgacttaaggaatcgaagtccactgaggtgaaaagcagtacttgtgagggctcaggtaggagacagaaaaaatcctggcagttatctcatttttcatgaagaaaccaggctgagctgtgccaagcagacagctatgagctcactggtttgaaataattacgcattgagacttttcctcaggacagagctaatgggtttatgcacgaaacatagctcaaatattgatttacggggtttctcattttaaatcagtaatgagtaccctttacctatacttgggcctgacaaagttctctgttatgttaactgatgaactagattaaatagaaaataaatattcaactaaagcagattgttcttaatacacatttttatgtttggtggcctcattcctattttaggagatgcagaaatcaaagcctcaaagaatcaaaaatgatagaagagcttttcagaggaataacactccattgttgagactcagaacttaagtacaaactgaagcaaacccaaaacaaattgctctgtttagcccagtgccaatctgagaagcgctctttttattcaagatgagatgtgctgtgacgtcaaccaaggaaacagaaacatcaaaagtggacagtattcaaatgatttctgtgggaagatgcagagcaggatccaaaacactgatctatatatttctgcatatgtttgctccatgcctaaagaaacaaggagaagcataagggaacagcaaaaaattcacctaaaacgcagtgatgcatgctgtaaatttagcaggtccttccaaaactcctaacctgtgctgtaagtaagaaaagagataaatgcagatctattggtgtccagcactcgcctggtttttagacttattggatggcagtgtagaaagtcttcatttattgtctaagtggtatgttttgtctaattttgttattttcaaataaagcattttttcatatatactgcccctgcccccgaatcctattagtaatgacactgccattgatgacagaagagccaagaaaaagttgaaaatattccactgtgaaataaggatgcagaggatgttaaggtagcagatttgctaatataataaacaagagttaacagagcaaataatatttcattccactaactggtagatgttgaataatatagttaaatggattggtaagaattaaaatgaaaaaatactatatactgttgttgatgatattgaaaactgaccatatttctctcaagaagctcaaagaatcgcatgctattctgaaggcaaatctgacctaagtccaaaaagactcagccatacaaaccttctttgttgttttcccctttctccattcctcccctcctcaacatcttgacaagatggctctttctcatcattcaggccttggggctcaaatagcaccttctcaaaaagcctttctctgaacacattatatacagcgtactctcctatcagagctctaccccattattctggtttactttctccttaacacatcttttgaaatcatcttttttgttcatttatttgtgtatcatctgtctttcccagtgcaccataaactctgtgagagcagggtctacatctgtaccaccagcatctcaaacagtaacatttattatgttcttagattgtatgggtcaagcccttatgacattcttgcttggagtctctcatgaggttgtacttagatgcagtgctggctgttggttgcaagccttagtttctctctatgtgggcctctgcttgggactgtttggatgttctcatggcatgggggctggcattccccagagcaagcaatccatagcagaaactgaagtgccgtttataatctggcctgagaagtcacaggatctcacttctgcctatcctgtcaagtcacatgattcagcatggcacgagactataggagtgaataccaggaggcaaggatcactgggtccatcgggagaggttggtgctgttacagttcactgtttttaaaaagcaagcctttgaggttccaaaaccttgtatttttatacactacttcaacatttaaaggacttgaaaaaactcattaaagctttctacttttctaagacatttgaagaaagtatgaatttctttttagtgacttatatggtttgaatgtgtcccccaaagttcatgtgttggaaacttgatccccaatgtggtaacgttgggaggtgggacattcaagaggtaagtgggacttgagctctgccctcatgagtggactactattgttattgaatgagggggtttgttatcatgagagcgagttccttataaaaggacaagtttggcctctcttgttctctctcaccctttcttgccctaccaccatagaatgatgtagcaaaaaggccgtcgccagatgccagcccctcaattttggactcccagcctccagaaccatgagccagtgaattctgttcattataaattattacccagtctgtggtattctattatagcagcacaaaacagactaagacagtgacagaataaatgaaaagaataataaaatgactactgcccccttcactatgtatttaataacaagttactggttttgttttactatctatttagttgagaatgtgcagcactcaagctctttgaatgtcaaagtgggattaatgccaagtgcagacaaagctgggaggagtttgaacaagtatttggaagcaagtccccagacaggatttgcagcccatgtctcttttgagacaatgacatatgcaattcttctaccaaaaatgatctcacttgttaacagttgattgttcaggggtctggaaaggatactgtattattctggcagccagagtaaacttggggcaggctgtagccatgtgtaacccttatcgtcttagggctcaaaaactaaggaaggcaaatatatttgtaaagttgctgaagacaagagttatctgtctggattttttaagtcataatcattctgtacaaggtgaaaggaagaacaccttctcccaattatttcagataagacagttgaatttctactacaatgactaaaactaattacgtgaataaataaatagatcaatccatcaataaattaactaaggagcctgaagaaagtattaatttctttttagtgactcctctggcttgaatgtgtcctccaaagttcatgtgttggaaacttgatccccaatgtgagaagccttaagatttacctagaaaaatgcctgtttggaaacacagaaagaaaataattagaagggagaaaatggagccaaacaaacgatgttagtacaagtaggagtgaaatttaaataaaaatgagaactctaaattcactccaaaaaatcaattcaggagaaattatttcagaaggtaaaacacagagtatggttcttctgctcctttgacatcaaaataataagggaaactgttgctttctggctcaaagctatagaacacaaaggcaatttgttatctaatacttgacaactgatatatagcttaggggaagcaacactaaatctcagatactctattacaaagaagagagagaaaagcttcaaaatctgttttgcctcagggcagaaatcgtttcaccctcagtccattaaatcacattgactatgatatcaaagtgaaaactcattagggcattttatgctttcatgcttgagccctagtgttaccaatgcacccaagagaaaccttccttaagaaactcaaaacagctggcaccacatttcagggaaacaaggcagctggcctacagctggagagtatcagctgaatagccaagactggagagggatgagggagtcagccaaagagcagtattttctcgagataattctgatctagcagaaggatgtgcttttttatttattagttatagcttggaaagggaagcgtttgattttagaaactaaacccctagtgtaagtcaaagagttactaaggggaagactccttgaaaaagaaagtttttgccttcttgattttgacttttctgtagcatataaactcaaactcaggagacaagtgattttcagtctcccatatctctacttcctttgacttttgttttgctcctaaagtgtcagcaaggagggaggtagccccaaccagcttcatgttacaaggacctttcatggcactcatgcttttggcctctgaaggcattgccaatgtttagtatttctatataatgacactactgtgaagtaaagcctttccataggaggagctatcacttcagtgtgataatccactagcttggtgagacttgaattccaactggcaggttcttctaacctccaaagtgcaaatgcaggctgctttccttacacagcagactgagcaaaaaacaccagtaacttttgcaaataacaaacacacatatcgtttcccatcacaatggcaaatgtcaaactgctgtttttgctttttccaaaagtgcgtgaggtggggggggggggcggtgccggaagcattctagggaagacttgcacttacttattttgcatatatgataaaattaaatctaaccaaatacctgcaacacgtacacttatgctgcaaatattccactcctagtggagtcaacagcaatagatttcctagttttcagacctggaactatctcctctgacatagttctgacataattctctgggctttttttcttctcatcacagcctttttttgcttctgttgttcatgaaaaaagatagcattttcactcaggttagagggcaaataagtttttacaatttttatatagatatgaatcatcagtctaatcaccaaggatttgagacatggataagtcaaaactacagaagaagtcaaatctaagtaaaaataaaggaaaaaagctcaaaatgccatcttaaataatgtggcaatagcgtgagttgtttcatttttcatggcattagtggtggaacttcaaatacatagcatgtggtggctagaaaagtcttgaaagattagcctatgcaaccctcattgtacaggtaggagggcaaggcaaggcaaagaattcaagaaaatttgaaaatacagtggtacatgacatagacaatgcaaaagagcagttaagaaatcagatattactggtactggaatgctctgtatggaatgttgctgaatacctttcagcttttttctttttctttttcttttttttttttgacagagtgttactctgtcgcccaggctggagtgcagtggcatgatctcggctcactgcaaccttcatctcctgggttcaagtgattctcctgcctcagcctcccgagtagctgagattacaggtgcccatcaccacacccggctaatttttgtattttagtagagatggggtttcaccatgttggtcagattggtctcaaactcttgaccttggtgttctgcctgccttggcctcccaaagttctgggtttacaggcgtgagccaccacacccagcctcagcttttttttttttttttttctgagcagagataaaaattaggctccgttctctaaacatacaagtatcaggcaacacagagacagagatacagctcaagggtttgttggatgattggaccaagctgacctgttatcaaaactggcttctacatatccaacatactgacaatccatgcatagacaactgatagttctactactgctgttattttgataagatgcatgggaaaatgaggtcttgggcctcacaagaagattatcagtagcaaagtctggccaatgggcttggaggttccatgctttccagagggacacttaataatctgcctctcatagggcaaggagagttcagcaaatattagggagttactgccctttccactttagacaaacaccagcagttcccctttagttcaatggtattcgcacaggcgttatgaaagctgttaagattcagaaccattgtcagaggacttggcagaatgtaacctaatcttttctgactgagagacagaaaactggcccaaaagtggggctataaccttcagtcacctgctggcattgctgccatctgatgcctaagaaatgaggatccagtgtgtctttgatgcccgtcaaagctttgaagctgggtcaagaccaggggacaaaggcagcactgtttatgcaaatctggaaacaaaagaagctaatctccaaagccatcagaagtaacatcagaaattcaatacccagagaggattagaggccctagaccagtatgaaataggaaacctaaaagcaaagctgggcaacacaccaaaacacatactgtaggaaggaatcctgagctggccagagcctggctagatgtgctcagaagtcttgatatatgcagctcccttagtcaagaggcaaccatctgtgtgccaaaggaaggacctcctgggcagctgctgcttctctacctggtgcacacagctccttcataagaaggtctaatatatgccattgcaaggctagctctcatgttgccactttccttgggagttcagtcatcatcaagcacgtgccttcccaaggagacaacactcttagcaaacacctttcgcacagtataaaacaggataaaataccacgagcttcctagaaaaggattttttaaagccatcccccagagatctaaagttgggctgagggtccaggaagcatcgattatgcagttatgtgaacattcttcagatatggttatccccatgaagaggaaagtgttaggtcaggaaaggactcagagaacatctcatctagagatttttaagcaagactgcatattaccaccctttgggaagttttcaaaatacgtcaattgccctggatcatcaaatgattccaataagtggctgcatttgaaaagcacaattttagcacatttcccttatgttacaggagaaactaagtgacttgctcaaagcagcctagcatgagcaatgcttccaagacctttcacaggacaacacagatagcgtatttgcacactagggaaaaatgaaagacgctgcttttggctagaggaaactgtcctggagaccccactgccaccagcctcacttcatctccaggtgattgttattttcttggtgggatgtgctaagctgtggtatgcagttcacatttttgagaaggataaaagatacaaaaataaagtggatgcataaacttaagaactttattgtagaatttttgccctgtcaccaaaagagcacaagaaaatagggtatggaaccatataagacttaacaactgagttgcaatcttccccacaggaggctgctgtacatgcagttataataatgctgctatatcaacttcttaaaaaatatttgttgtgcagcagcaacaaactcagaacaatcctctgtatagcagaacagaactgtgtgaatttctaaaaagccatattttgagttcatagctagtgaagacaccagggttagggactttgtaatatcatgtaattaaggctgaactgccagctactaaaaacaggctaatttagtagactgtttacatttgtcacaaatgaggggaggaatttttaatggtatgccaacgggaaaaatctaagaaaattaaatacaagaaacaaagaaaccaagattagggtatataaggactgaagtggctcaaatgaattctacttagtttaaagaaatgcactggtttgatttccctgtactctaagatgttcattagtaggtattttttcttctgcaatactaaaggcttaatgaactcattgtgtaagatacactgaagaaagaatgtgagggagtgtcgttttatactgagccccagtgcaaggagcttcatacagtgggtaaaacatttggggcattgtcttttaaaaaatctttttaaaaaaatagtcactattagatggagatggaacatatgtgcttgacttaataataataacaaaaaaacacaaatgatgcatgcctggctgggtttctcctatgtaatcctgtacattactacttctcttaataagaaaaccccttggtctttttgatggcttaagcatctggaatctgaagtttagaatattccagagtatgccaactttccaaactctgaaaatcccatgatctgtactttaagtgcatacatagccttctaggagctcatcttctgcagttcccaaaccaagaagaagtgcatccaaatcacttatgtacatgcttaacacaccaattcctaggaccccgctgtggaccatctgatgaatgtgactgaaatgggccccagaaatccatgtatctaacaaatgctccaggtattgtgatgcaactggcctctgaacctgtatttgggaaacactagttgaatccagcagccttacactaaagggttggcagaacaatggtaaggaccatgtccactcatggacaatgaactagaccaatggggacaagtcacttttaggccacctcaattactaatttcaacatgattacctggatttatccacatagacaatcagtgatggtggaataaataaaaggatgtaacattttaaaaatccattgttttagaaatccatagtttgtcttgctaaataaaaagcttacaatggaaaccaacgtacccaataaattttattaaaatctaacaagattgaggaaaggcagagaagaggcttgtacttttctaaaatattttcgtatgctggctgtttcaagccttacatgccaattccacaaaatccatttgcaacacaagagatggtctgactgtctgaatactctcccgcccaacctgtttctagcacaaggaaagcagtggcgtggaagctgcatataagcttactgttcaatggtgcagtgatgacatgaaaaatcctgattccacttggcagcaactttccactatcttggcgggtgtaaaccataatcattgtggtgtgtggtgctgagacaggattatggggctggctggcaaccaagaaactaaaaaacagtctattagtccagcaagggactccgtgtcgggaatgctatggccccaaatgtctacaaccacacttttcacaactatcccaagaatttaagttctactgttagtctctagaaaattctacctttcccaagactctaaaatgcagcagtttctcacttaatatggctttcagggagaacaccaatcaatgtacctccacagactctcctgtcttagagttatgtctctctcttgtgagaatgagatacttgccttcaccactgccctccccatctccaaaacatatacaatcactctcagaaagaaaagggactggaaagaaacagtcctacttccctcttggcagcaattgtatgcactttgggcttggcagtccaaatggggaaagctctatgtaaggaacctcctctctgcagcctgatgtatccctcaataggtcttgaagtgattcaacctggaaggtaatgaactattccaataaagccaatgtgtgaatgaaatcaggtactcatgaaaatgcttcagctcagcagcttgtcccagactcatcttctaccatactcttgggggtatacagcccaagatcactattctaagatcattatttatgttattatttgtgtttctgaaagacatatcttctaagatgtcttcaaacattaatcagaaaacactggagggaaggagattattttgcattatgtttgcagaggaacaaaatcttatcagttaaaccaacaagtcaggggacaggccttagcttgctgaatttgacaaacaactaaaataataattgttgcttcaattaagtgaaacacgttacaaagtcagccctagcaagatgtcatggagctattattcaaagtctaactctgaaaggatttctgtatggtgctcctagagaggaaaagaaacgccctgcagccaaatctgaggtttaattcatgcaagagacttggctaatgccacctaccacaaatgctgcattttcacggatctgaactacagaaagttccagcaaattaattacagccactctatttatattctacctgacttttcaattattacctataatgagatttttatttttatgaacattaatgcacagctttcctaccagaggagtagagagctaagggaaaagtaatacaatcctgatccttttaccactaggtcactcgctggcagcttgccaagcctgctggttccccaaagtagttactgcttgggtcctagggttccttcagcagcctgaggtgggagcaaagctcaccacccaaatgtcaacatgggtcaggcaagtcaagtcaaagaaagacagcggggactaactgcaagtgcacacagtgtgggtctgatggggactgggctgcctggacaaaatccaggggacagcagctactcagctccaacaatagttgctgtgtatgaatccaggcctggcaaggtcaggtgctggttacatggcatgttttgtctgtgaaaagttaccaagttatacatttatgatatatgaacttttggataaatattacacctcatcaaaaagttttttttattagggccagaccttctagaggccagagagacaaggacaagagagcaggacgggtgttatcagagaggccttcagagtacctgcctggaacaggtgttatatgaagctggcttttattgtgccacccagggcatggctgtagataggctggcagtgtttaaagaacatgggatagagagatggattttaaaatatcacacttatccagaactggatatgtaaaacactcatatttgggttaaaatgaaaaggatatatgtatatgtatagaaagtttctagaaaaatatgaaagaaagtgttaatattggtcactggcaggtggtatagagtagatgggagatttactttttgtgatattcccaatcatactttttttattactttcccatttaaaaaagtcagaagagcaaattcttaaaataactgaagtactattaaaaatccataaagaccctaagggattcaaatttttaaaaactaacaatttttgatatgctaacaacatatcaattaaatgcaattaaatgaacaagtcactcttttgaaataaaaatgtcaaaacatagaatacatacgttttgtaattcctgatgaataatagctataatttaaacacatatggtaaaagttcttcatgatatggtaactggggaataggtgtagtggccataccataggctaatgattttctttcagactttactgtatgttgttatgctatgtcaagaaatatgcagaaacaagccttattattgtcctactatagtcctatataagccttataatggtcctactatactgtgccatagacttggagacggtgccacacagcaatatgacccaagtgcacgtttaagtgttggaaaaagaaccaagagacaaccagcagccttctcagttacaaggcattcattgttcattcctatgaccaccagaaacagacaagcaaaaggaacctaagaagcacatgcttatgtatttggagtcacaaagaaactccctggcctaatcacttggataaaggagctaaaaacagatctgagaaaaccaaactctgcttaaaatactccccatgctcctttaaaccaagaaggatattcattataaaataatcagcattaaaacagctacacaggattaaaaatctagaaatcagttatctcattccataatcaccatgggaatctcttaactgccctgtgctttagatgcctcatcatggaactcaatataataaaaccagggcaacttaggcattcttactaattctgtagttaagctgtcataactggaacaacaggattggtgtcatttattagtcacttcagtttttacccagaggaaatattctgagctccaatcatattttgaaattggaggttgcagggaggattgataatttcttcaatcatttggaatgaagctgaatttaggggacaaccaaatctaagactactgattaaaaagcctgaaaaatggaatctctattttaccaatatgaactgaaaatgtagccaatacgtgtatgattagtgccaccttaatcatttgccactaataatacttgagaaatttctttctactgttatgtagctatgatcacagcaagtgacctgcatatttatgtacaacccacattttagtcataatctgtccctatgaaatataccaaaacagattagagttcactaaaaagtgcctgaactaagtgatgaaattatcaagacagcggaagagaaccactaagacccttgcatcattcaagtggaaatgacaattcttatttgaaagaaacactagcgttcttatcttcccaagttgggtcaaccgacagaagcaaaaactagaactaattggtcttttcacaatcttaagcagaccatctgtactcggtctgcaacattagctgcctgggtcacatcctggctccaccatgcattagcctagtgacctcaggcaagttatttatattctctgtgcctcggtttccttctgtgtaaagtgatagagtagaatgtaatggcatctcccacctagggttgttgtctggagtaaatcagttttgataccaaagtgtctagaacagtgcctccatgaatgtatccttccttccttccttccttccttccttccttccttccttccttccttagttctttatttttcccttcccttaccttttcctttttcttttcttttgagacagggtctcgctgtgttgcccaggaagaagcacagtggctcaatctcggcttgctgcaacctccacctcctaggttcaagcaatccacccacagtctcccaagtagctgggactataggtgcatgccatcgtgcctggatgatttttacatttcttgtagagatggagtttcaccatgttgcccaggctggtcttgaactccttggcttaagaaatctgcccacctcggccccccaaagtgctaggattacaggcatgagccactgcatccagataaatgttagtttcctatactaatattttttgttgttgttggaaagaagaaactaaacaaatttccatttgaagattttttaaaatcttgattttgaaaggtaaaggtaaaggagataggagaaaaaggaaaagattcaaaagaaatagcaactatcattgttagtagcatttatgtaaaagacactgtgcataccttatatcatttacttgtaacaataactctttgagacaggtgttactattagttatttgaagataaggcagctatgtcttagaggtttactgatgtgcccacaatcacacagaagatttatgctctagtctatctgaccctaagcttgtatatttcttcctccaactctggttgatgccctccacgctaaactaccagattgggaaaatgaggaaaggaggaaaaaggtgaggaaaacagactaacagacagaaggggcctaaggcatcatctgctttttcagccataaaccgaaacttctatctgtagggataacatacaacatttaatatcaagagtgtaatgataaaatatgacatcattcttaccactggtgctgaaaaatgtcactgatactagtttggaacagtttataaacacaaagtatattagtatttctagttaaacaattatgaaaatgctactgattggacattaaaatgtggagataaattcaagataatccccaaacaatgcagaaataaagtagtatgcaaaatgttaggaccatcccccagctcatcactgtttatgtttatgtcaacagaagctcctctctttatttaaaaatccataaagcggttcccaatttagtatgttacttttcaaaactctgccaaacaaaatgcccaaatctttctgtaattacatagcagttactgccttgtgcctgcacagactctgtgaatcccaactgtcttcccacaagcaacagcaggctctccaaaagaaaaacttaatgtttcatttggggcaaatgtttttccctgcgccatgcttcggttttcactgtcatggtacttggccccactctccctaatcataggtttaaggaggatgaggtcagccttccctctgttgctaaggctacttgctcatggttccactgaattaaggagaacccactgaagtacactaccacttgtcacaatgcctcacagttcccttcatctcagcatattcccaattccctaaaacttagtgcaggttttaggacacatgaaatagatatcttccttaggtccttatcacaggattgtgatatttgaaggaaaacaattagcttggtggattttgagatcagacaggtaaatgtaaaaagctttcctttttgcttatacaaagtatctctaaaatataaattttcctttgttcagactaatctgaataaacttgatgctgactgagataactgcagacattcttcaacaacagtatcttccaggtcaatttgatgatactcatttcatctgtatgtgcagtgcagatctggtccagaacttaaagtgagaaaaattatcacataacaggggagtctgaatgtgatcaataagccaggtctctcactgacccatctgggacagaaatcagatgctcctctagcctgtgagtggatgaatgagaagagtgagtctgcacagagtgagttattgtggtcagattcagaggaagctgaattctgtgtggctctgtattcactgcggttctattttacaaagttctgggtagctcacagccatttttgacatcagcatgtgctggctttgcagaatggatactaatcagtttggcatcttggaatgttgcatagagcttgggaatgagaaactagaggcaagcaatcggtagaagcacctcaaatctgtaacatcctaaactgaggtaccacctcccatcagagtgttatatctcataagcttcccagccaaatattcccctagggccagaccagaagtcagcacttccaaagagattctatggtacaatacaatctgtttggagacttgcagtcattagacctgccacccacttgaactccctgagagaaaactctggttgatgccctattatctttttttttttttttgcttgttttttgccttgctgatccctttttctagagccatccttctttcccaggttttagttgatttttactcttccttcaaaactgagttcaaactaagtgtccactcatcaagaagacatccatatccatacaactgccccaatctgatttataaatcatttggttcttccccaaaccctttaaaagccattcagatcaccttacactgcccagtaaaatgaatcatatttatctgtaaaaaaacacacatatctaaatacactttttttcagccctgatctggctggttcttattttaaaaaatgcattagaagaatatgcttgtacagcctctctgtacctcagttctctcacctgtaaagtggtataataacagtgcatatctgatagggtcattttgaagcttaaaccagaaaatgaatgtgaagttcttagaagaaccacgagctcttattattatgtgtggaatttataaataaatgtaattttgagtaagtcaatcactttaaacacatttcttcttctgggaaatagagataattttatttcttcacagaatggcagtaagaatcaaatgagttaacagtgcatggaagttatttccaaaggttctttacagctcctttgtgagctgaaaagaactatttagaaactgggatttgtattattgttacctaaagaattacacaatgttttaaagacagaaccaaaatttttcaaagaagagtcttcaatgactgacgcaagcatggccttgcacttcttgcttaacctgccaatgctggacataaaagacaacagatttcaaaggtctatgcagaactggaattctctcatctaagtaagacaccagtgtccataccatctggaacttacagggaacttaggatgtacattgatgctggttgatcctaattatattgcaaaatctatggaattcaagagccataaagaatttttgaaatcatttattccaactccctcgttttattgatgaggcaactgatgcctatggatcccaagcaaccagccccaaatcacatatcaaactagtaataaacaactcaagtctcctaatttgtagattataggcttatgtaaattttgtttatatcatgtttcctgcctttttagggtggccttgggttcaaattccagtttcaccatttattaattctgtcactttaagtgacttactgaactgatgcaagtctgtctctttctttgcaaaataaacatcatagcatcctcttaaaagtttactgtatgataaaaagaggtaatgtctctaaatcaggtagcaaagcatgtgcctgacacctgcttcaccactcaccaacttcttatggtaaatactgtaacgttttaaaaaactaaatcatgcataaagatcaaaaccatattttaaaatatctcttaaaaaaaacacaacaactaaggtaactgatatgtgtgaatttcttttggtaccgaagtggttaaaaaaaaatccttccttctggtttaaagcctggctgtcccagtgctctctttccacataatatgcccttctccgccaggcggtcacgtatggcagggtatatagtaaagcagtgtacagcacagagctgtactatatcacatgtttgctttcgcacctttgcacctctcccaccaggtactctgaggctgccaattctagctgctgcttttactcctcttcctctctttgcccaaccgctgctttaaggatgtgtctcgcctgagaacagctccctttatcaacacaagacagaaattgctccagagtgacctgggctctgtcttcctcagggggccagagtcttcttgtccgagtacctacctgacagcacatctcccctggccagcatccacctccttgtcctccacaacccactcagcggctaacctggccaccaactaacttctcgccctcggatcctcgcgtttataaaaggtgcgagacgaccaagttctacaaggtggggcgggcaggcacccgcacttatcccctggccctccccgcagcagacacagggaccaggtccaagcttctttcctccggggacaaaacttggctgtttatctttcccagggcatcttcgtctctccccgggacgtggaaccccgatgcaccggcagggacagcccggagcgctcgcaggagaccaggcccacggtggtgccatggttgggcacactccgcgggctccgcccaatctccacccctaggtccaggtccccctaggagagctaggagcacatttccagcctggagcaggagcccggcaccggaaagtcagagcagcgcactgcggcgccccagccactgcggagcccctggccaaccgcagttacgttccatctgtcgtatctacatgggaatacggcgacaggcaccctatcccctcacgtcagggctagcagtatgaggtggggaaagaggaaacctcgagagttaaaagcgagggaactgaaagtccccttgaggggtgtcccccatgccccttgtgggacaaagccccaattcgcaggctaccctccagagctccagcggtccggttctccccatcagcaccctctgcgcacactgacccgcgcgtccctccgcagcctgaccgcccgatccgccagccaccggcgcgggcagcgagggggtgtgtgcgccagattttccgcgtgcccccccgcccctccagcggctccctcgccctgcagctgctgctccgggcgctgtccgcgctgggcaggccgcccccgcgtcccgccgcggcggcccggggcccgtgcgcgctcaccagatggccatcctgctcttggggtagtccagccgctccaggcagccgaggaagtgcggcagcgtgtgcgccgcgttgcgggcgaggaccgccacgagcaccgtggggctctgcaggggcgactccgggaaaaccaccggctcctctccgtcgtcctccgagtcccgctcggcgacgaagcgcgctcggcagccttcgcggagcagggctgaggagaggagcagtagcgaccaggcgagggtggcagcagggcgcgcagccatgttccgggccgaggcgggcggcggggaagtcctggcgcgagcgcccggctgggctgcctgagggcggcggcggctgccggggagcaaggggctgcgaggggcggccgggggatgcggcttgccgcggccggccggctcacacactggcctcggcggctgcggttcccaggaccctcccgccgccgctgcaccgcccaggccccagtgcgggtgcgcagcgtacctgcagccgctggcgctcccctgcgcctcgggctcgcagacagtagtggccgaggggctgtgtgccctgagtcctgaggaaagttcctctagtccaggttccgctcgtacagctgaggtctgtggccttccctagagccgcgagttgtggccctgtctgccaatgagcctgtgagtgtgtgtgtgtgtgtgtgtgtgtgtgtgtgtgtgtgtacataacggtacaaccccaagaaaatttattctgcttttgcaaaccgcagactgaagcccttcacagtgatgcaatgtatccagttttcataatgcacctattgactgagtagagttctaaaatgaaaagtctccccaactattcacgattatgacaaacacttgtttaaccaccgcaaaggcagcatgtcgcattttcttatatactcaacttctgaaattcattcttgactgagtagacacctaataacacaaagtttgaagacttggagaattttggagccagatcagaccccgcaaaataaaagaaagcccttgggagacactgtcctgaagcctcactctactgtgaacccagtaagcctcctcacaggagggctgtgaaagaataaattcacttagctggttttctttttccgtaataagccaatatgatagagtaacaaagagggaaaattcgcgcatgttggagagcagagaagagataaggaagaaaagaaggggtgaaggaagaacacaattagcacataaaatgaaactgctggcatacactgctaaaggagatttactttttttttttttttttttttgagacagggcctcactctgttgccggggctggagtgcagaggcacgatcacaattcactgcagcctcgacctcctgggctcaagcaatcctcccacctcagcctcccgagtagctgggaccacaggtgtccatcaccacgcctagctaatttttttttttttttttttttttgtagagacgggttttcaccattttgcccaggctggtctggaactcctgggctcaagtgatctgcccaactcggcctcccaaagtgttacgattacaggcatcagccaccatgctcggctggatatttagttttgaagatatattgtgtagcctttgatagataagtatggagggtgttttggtgccagtgcacattcatgatctccaatcccaactcaccctcaggtctgtcccatagtctttttattagttgttatcaatccttctcagcaactattagaagtcttccctactgtcttttgaagtatatcacctccttcatccagctcccccaacaccactgtctccaactagcatccctaccaagacctttcttacttgcaggtgcctcctcacgacagggtctttgatcacagactagaaagggagaggtctccctttctagcccatgatttttctctatcattccactctctactgaatcttcaactgatctctatcaactcctttctctcaagctaaatacttggtcagtcttctcttatccgttaaaaaaaaaagaaagaaaagctttaaaaaaaagtcctgtgtcttcttctagtcatccctttgcttgaccaagctccttggaagagagatctatacttgtattctccacttcttcatctcccatctttcccaccacagtgcagtaaggcgtcagccctccccactgttctgcaaaaccaacagatggcctcagcattggcagattcagtaaactcttccgttctcaccttcctggacttcgattacataatctcccatcctagatctcctctgatactacttgtctctgagccaagccccttcactgtgtgcctccctatagtgtgctagtcttcccactccatatggtctcctgtggttatatcctcaaaatctatgtcttctgctctaatctcttctctaatcttcatatttttttatcgaatggcctacagacatttccttcccctccatccattttcaggaattgttcccactttcaaggggctcacagtcttgtagggaagactgagagttaaacatctgttagaagtactgtaacagatgtaccagctacagtgaagggatagaggaagatgtggtcatttccacaagggaggtagtgatgggactgttagaaaggtccagacaatctccatgttgttctgtctttcttgtttccctttcttgaactatgtcccactcatctttcaatactaaaatccgcactccttagccaaacttggtttgatagttatcatttgttcactttactgcaaacagagggagtttaaagctaggcaaccacatttctgtcttattttccttctgttactgatatggtctgcctatgtcctcacccaaatctcacatcgaattatagctcccataatccccacgtgtcgtgggacgtaattgaatcatgggggcaggtttttcccatgctagtctcgtgatagtgaataagcctcacaagatctgatggttttataaagggcagttcccctgcacatgctcccttgcctgccgccatgtaaggtgtgtctttgctcctcctttgccttctgccatgattgtgaggcctccccagctatgtggaactgtgagtccactaaacttctttttctttataaattacccaatctcagctatgtctttattcacagcgtgaggacagactaatacagttacctaaagtcaacagcttatctgagtctattttttcaaagaaaggtgaagcatctaaacctgtatggtctctaatgacattataatgaaatcggctccatggagttctcttaaaataactacaacctgctctgctctgtagatgaaatcaagggtttcccagccacataacctacaaaacacctatttaaaacttttaattgagtgctcatttagtgactgagaatattaaggtaataacagggtatgcaacagtagaagatcattgtaaatatggttgggaggcagtggaggggaagcctgggaaaaattaagtccccatcttactaacagatttgtttcataagttcttcagaaatcagtaatgtgaatttggatgtttcccccccgcataggattgatgttataagacagttaatttgaaaaaaaaaactaatttaaaaataaaagccaattatattttaaaatattcattgcttataatgctctttccatggaaaatcggctgaatggaaagtcagggttgtacacacatatctctttgtctccactgccagtagactgttccaattgattctacataaagttagaagtaagcactttctctcatatcccctccccatactgttccagcacaggggacttccatctgggacaacaaaacctcttggactgtcacccttagtgcaatgtggtggggacagggcctatgaggtggccagaggacttcttgcaggaaagcttctcaagatgtctgtggctccagcagcccagaagaggaggaaataaatgcctctggggcagctgtgataggcttgaaagagcaactgacacttggagctgaattttcatttcactggtgtcacttattctctttgtgaccttggaaacttgacctctttgaacatcaattccttcctaggtaaaaaagttttaaatgcttgcctcattttttcattcaacaaacatttatgaaattgctaaatgccaatcatttgagtgttgaatatttgaatgcttctcccttggaaaaacagggagaaagtggccagcccctcgtaagtcctgctgggccatagttggcagaaagagtctcttggctgaattatccaggcttctttcttctgtactgaaatatctttctttcactacctggtttgttttactcgcttttctgatccatcctaaaatcctacaatgtaaaatgtacttgaattgacaattctgccaatttcaacatgaaaatccttgagagaggagcattagatgatatctttttaattcaatcagatttttaaatcttatcacctaaactgaaatggcctataagaagttttgataaagggaactgaatgggatcctaatttgaagcatgggtctctttggtgacaaagcaagttttatggatttctgatacgtaggcccgaggactctgggtcctaggaagggaattaatattaagggagaaaaagagcagtgactgaggtgggaaaggctaaaattaaactacgtcagtgtcaaagttttgtctatgctctggctgcatccaagagctatagaatagtcactacggaggaatgttttccaattcaaaacaagtttatacaaatgtaaactacacttctacgtctcatttaagaatagatgcatcccttaaattatattaactcattccttcaaacacttgctcaatgcctactctgtgccaagatatagttgctggaaatgcatgaataaataagatgtgtcatataaatgcacaaatgctataagtcattttatgtcttatgatggaaaaaggagcataagtaaggaagtggggaagtggagatagctaggaaatgtttaattaaagagatgtctttgaattgagcattgaaaaataagtagcatgcatggacaggaagaattaatatttttaaaatggccatactacccaaagcaatttacagattcaatgctattcctaaactaccattgagatttttcacagaactagaaaaaaactattttaaaattcatatggaacaaaaaagaggctaaatagtcaaggcaatcctaagcaaaaagaaaaaagctgaaggcatcacgctacccaacttcaaactatactacagggctagagtaaccaaaacagcatgatcctagtacaaaaacagacacatagaccaatggaacagaacagagaacccagaaataagactgcacacctacagctacctgatctttgacaaacctgacaataacaagcaatggggaaaggattctctattcaataaatggtgctggtataatcggctagccatacacagaagcttgaaactggaccctttccttacaccagatacaaaaattgactcaagatggcttataaatgtaaatgtaaaacccaaaactctaaaaaccctagaatacaaccttggcaatatcattcaggacatgagcactggcaacgatttcatgaagaagatgtgaaaaacaattgcaacaaaaacaaaaattgacaaatgggatctaattaactgagctcctgcatagcaaaagaaactatcaatagagtaatcagacaacttacagaatgggagaaaaattttgcaaactatgcatctgacaagggtctaatatccagtatctaaaaggaacttaagcaaatttacaagagggaaaaaccaaacaactccattaaaaagtgggcaaaggacacgaacagatacttttcaaaagaaggtatagatgtggacaacaatcatatgaaggaaagctcaacatcattgattattggagaagttcaagtaaaaaccacagcgaagaagaggaggaaataaatgcctctggggcagctgtgataggctgagaattataggataaccacaatgagataccatctcacaccatcggaatggctactaaaaagtcaagaaataacatgctggcaaggttgtggagaaaaaaaaaacgcttatacactgttggtgggagtgtaaattagttgaaccattgtagaagacagtgtggcaattcctcaaagtcctaaagaccatcgatcaggtaatcccattactggttatatacccaaaggaatataaatcattctatcataaagacacatgcacgtgtatgttcattgcagcactactcacaataatgaagacatggaatcaacctaaatgcccatcaatgatagactgggtaaacaaaatgtggtgcatacacatcatagaatactatgcagccataaaaaagaatgagataatgtcttttacagggacatggatggagctggatgccattatccttaagcaaaccaatgcaggaacagaaaaccaaataccacatgttctcacttataagtgggaactaaatgatgagaacacatggacacatagaggggaacaacacaaactggggcgtattggagcatggaaggtgggaggagagagaggatcaggaaaaataagtaatgggtactaggttaaatacctgggtaatgaaatactctgtatcaaaaacccccatgaaacaagtttacctatgtaacaaatctgcacatgtactgctgaacttaaaagctgaaaaaaatataatttgattcgaaatataagaaaagaaaaatgagtagcatggactaagaaaaggaagacagaaggggaaagagatgggaattccaggtagatggaactgcaggagcaaggaatgaaacagtatgacacacttgagagatacaatgaacagggcatggctgggagataggatgggaagtagtaacagagaaagctagaaaattatacggttttatacaattttatatataatcatttctttaaaatgggcaaaggactttgaataaacatttctccaaagaagatatacaaatggccataagcacatgaaaagtttctcaacatcactaatccttaggaaatgcaattcaaaactataagatttatcacttcacactcattaggatggctactagaaaaacacagaaaataacaaatgttggcaagggtgtagaaaaattggaacattgtgcactgttggtgggaatgtaaaatggtacagctgctgtggaaaacagtatgacagttcaagaaattaaaaatataattaccatataatctaacacttctacttctagctatatacccaaacaaattgaaagcaaagtctcaaagagatatttgtgcacccatgttcacagtggcattattcacaatagctaaaatatggaagcaaaccaggtgcctattgattagtgaatggaaaagcaaaatgtggtatatacatacagtggaatagtattcagtctcaagaagggaggaaattctgacatatgctacaacatgttaactttgagggcattatgctaagtgaaataagccaatttttaaaggcaaatattgtatgattcaacttatataaggtagttagtcaaaattacagagacaaaatagaatggtggttgccaaggggatgggggtaggggaaatggggagttattgtttaatgggtatatgtttcagttttaaagataaaagagtcatggagatggatatgagtaatagttgcacaacattatgaatgtatttaataccacttaaaatagtaaattttttgttatatgtattttaccacaataagaaaataagaaaaagtcaatccatgtgatttattaacaaacttgaaaaatcatatgatcatctcaagaaatgcagagaaagcatttatgaatccaacatgaattcctcataaaaattctcagtatataggaatagaagggaacttcctcaacgtaataaacagcatctacaaaaagcccccagctaacatcatccttaatggtgaaagactgagtgttcctcctgtgatcagaaacaagataagaatgtcagatctcattacgtctgtttaatgttgtactggatgttttagatggggaggagaagaaggaaggaaagaaggaagaaaggacagagagagggagaaggagagaggaatagaagaaagcagggagggacatttaagcaaggtaaataagccgtaagatatattttaacatgaatgtggagtgttgtattagcccttctaggccaaaggctctaaaattcaatgatttattaaagtctattttactatagaactttaaaaaatgttgaaaatgggggaaaaaaagaaaaaaatcactcatgatccactactccaccacaaccattaacattttggggtaattttaatatggcatttttaatttgcacattttcaatgtgggtttgtactcagtcctcttcagtgagactcaatatccatgttgatagcagatgttgactaaatatctagagatagacatgggatattttttggaccatggattgcttttgatgtcttttcatatttacaaagccaggcattatttaaggttgcatatatgcatctgtttacttatagaaattgcctaacttactatcactttgtactctagatattagaaaaattttaataaaaatatttaataaacatgaaatataaactaacagatataatccataaactaatacattaatttaaatactactaataaaatggatatccatatacccagcacccaccttgagaaacagaacatgaccattaactctgaagccctgagtcccttcttgtcacaatgctttgttccattccccagagataagtactagactgaattttgtgttaatcagtctcttcattttgtttagaactttacctcctgtgatggttaattttacgggtcaacttcactacactagggtgcccagtttcttggtcaaaccagtctagatattgctgtgagatatttttcaaatgtgattaatatttaaatcagtagactttgagtaaagcagattacgcttcataatgtgggttgccatcccatctgttgaaggccttaaaagaatgggattctccatgaaaaaaggaattctgactctggattgcccttggactcaagactgcaaaataagctctttcctgggtctccaacttgccagcctgccttccacagatttcaggttttcaagcccccacaatcacatgagccaattccttaaaatcaatctcattctctctttttggttctgttctctggagaactctggtacatctcctaaatgtgtgttagttttgcctgcatttgaatttttcttcaaataccatacaattcacctatttaaagtacacaatgcaaaggtttttagtgtattcatagttatgcaacacgatcacaatcaattttagtacatttttatcaccacaaaaagaaacctatactcattagtgatcaatccttatgtctcccagctcgtgctactctctcactaatctactttctgtctctatagatttacctactttagacattacacataaatggaattctacaatatgtgaccccttgtgattggcttctttcacttactatgttttcaaggtccattgatgttgtagcatgagtactttattcctttttaatgctgaataatattccactgtatgaacatactactttatattttcatcagctgagggacatttgggttgtttccacttctgggctattataaatacagctgctatattagaattttaaacaaatcaaatatcttatatacgcttctataactaacattttgactatacattaggtttttagtttttatgagattcattcaagttgttgattgaaactctatgtgtgttttaaataattactttttgaaaactgtactcaacccactaaccactaacataactaaaataactagtgtatttcacaaccactaacaggtcctggcacttcatttaaaaatattgctctagaatatatacctgggattagaattgttggatcataggatttgtgcatcttccctttggtctacttttctgccaactcttggcttttgttgctaatctgataggtgtattatggtatcttcttgcctcaatttacattttctcactcaatcaatgttgctgaacatcaagttatgtttgctggccttttatgtctttttttctgtttactttcttttttttaacctaaggagtgttttgttttgtttcctaattgatttttaggagttctgtatatattctgggtatcttttctttcaattgtgtgttacagatgtcattttccttccactctcttagtgttggaaattcttaactgagatacagttaaatttaccaaattttttccatattgtcaggcctctgagcccaagctaagccatcatattccccgtgacctgcacatatacatccagatggcctgaaataactaaagaatcacaaaagaagtgaagatggcctcttcctgccttaactgatgacattaccttgtgaaattccttctcctggctcatcctggctcaaaagctcccccactgagcaccttgtgacccccccctccccgacccctgcccgccagagaacaaccccctttgactgtaattttcctttacctacccaaatcctataaaacggctccacccctatttcccttcgctgactctattttcagactcagcccacctgcacccaggtggaataaacagccttgttgctcacacaaagcctgtttggtggtgtcttcacagggacatgagtgaagcatatggtttgtgctttttgtgtcttaagaaatcactcttaaacttggggtcataaaatattcttttatattttctcctagagatttaaaagtgtttgcctataccgtgtagccaatcaccccttctctccttcccttcttgcatctgcccacatgtgtatgggtctgttgcctggctccctattttgcttcattggttttacctatccatgtgccaatatcacatacttgtaattagagatctttgtaagaatttaaattttgtttaaaaccttatctttataagatatttatatttcagaactttaacttcgtaagttctctcccttttgttcacaaaaagggtcttggttatttttggccctttatgcccacatttcagaatcagtttatcaggtattaagaaaatactttttgggattttaattggaattgatagaatctgtaaataactttggaggaaattgccatctttacaatattgaatcattctctttcttgaatctttctctgttcttgaaacacagagaataggaaattgtgtgttttgtgtacaaaaaaaggaacaagatatatgtgaacctccttacaaccaatgaatgaaaagctgatccagaatgctaggctacatttttcagcttggaatcactgtctcatacaatactgtgtaaaagcttttcttcttcttttttaaattttctttccacactagagattcacatcacaatttagtgttcgcatttcctcgagactcttactgaattaatatgtctctggctagacattacagatttttgtaggaataaaatgatctggctcaggatatcattgggaaatgagttcagcaagtgccagattacaatgaatttgattaaatccaatatactcaggggggatttcattcgttgtttcttatctagcttttttttctcactactttggttctctaatagagtgaactattgaagcatttacaaaatgagaaatcctccaggataccagacactgaaactctcctctgttctctagtggatttcactctagattgtcacaataggtattttgattctgtactttaaatactgggttgtctaagtgttcccaaatcctttgtgttcattcttagccattcacaatcaccaagacctatttaaaaatttacattaacagggaagctaacagacactcccttttcattcttcaactcttttgaaaagcacgtaatactcattcttgaatgtatcatgctttttctaagcaacagtatttaatctatttgccaaaggatggcatttatctgttgcttttttggtttatggttctttccatacccccaattattttttcttgaacataagctgaaattcttcccctgcagatgtttgaggctggttcatatagtccctaatcccattggatatccttactgatttataaaagtttccctctactcagattagcatcaaaatactcttaatgcttttaaaaatgccatcatatgaactgatttggatctttaggagtcagagagatttattcacttccaatcacttgaattcgtgtcagtgtttcatgcttcaatgacccaattaatttcagtgccattttcttctttcgggcttagcagctgctttgtggtggcaaaggttcattcaaatgtaatgtatttgagggcaacatatgaatcttcatgtgtggctttacatttcattcaataatagatgcccttcttttccctgtgtatgatgtgttatttcttttgatgcattcaagcttttctctttatttttttgactttcaatagttttattacaatgtagacttctttgtgtttattttagttgctatgtatttagcattttgtactagtaaatgtgtttttcatcaaatttggggaaattctggccaccactctttcttcaaaaattttttctgtccctttttttttctacttctgttgtttacatgcatgttggattgtctgacatgtagcaaatctctgttggtctactcactttttaaagataatttttctctttgttgtttacttttaataatttctattgctctatcttcaagttccctactttttcttttgtaattttttttggctgttaaattcacccagtgaattttttatttctaaaattataattttcaattttcagaatttccatttggttttaaaaatctttttttttctttttctttgctgagattttctatttgtctcctgagattttcattcattgaaaacatgttttacttcattgaggatagttataatagtcactttaaaatccttatctgtcagtttcaatatctgattcatctcagggttgatctctagagtatgcgatccatttccttgaatttcatatgtcagatagttttggatagtactctggactttgtgagtgttaagtggagagtctggattctattattcttctctgatgagtgttatttcctttgtattagtaggtaattttcccggctagattttaactgaaaactctctcccttttggagacagctctggtctcagttcagatcttttgtttttaactgagctgctgtgattctgttttgggtggttcaggatctctcagagatgtgggttgacagtttggggatccactctctgactccttccttgggatttcttaatctcttcagaattcaaaattttctgtcttcacttttctgcttccccagacaagaataactgataagttttatacatgcatccctggtactgctgagcctgacttctggactgcactttgccccaagctaaatgccaaagagaggagaattttcttgtggagttcttgatcttcaagcaagcttgcccttcctaccagtctgctgttcacattccagtatattcagctttttgtattgtgtccaagtgtagttcctgatcttcaagcaagcttgcccttcctaccagtccactattcacattccagtatattcagctttttgcattgtgtccaaattgttttctgctgggggatggtccactagggtcttagtctatcatggttgaaaacagaagttatgtcctgcctgggactttggattttgagtcacccttgtcctggtcaatgcgatagcctcctaaccagtctctgtttgtgtccttgctccctccagtctatcctcaacatatcagtcagagtgatcctatgaaaacgtccaggagcctccaatagcttcccatttcactcacagtaaattaaaaaatacttaaaatgtgctactctgcctgtttgaaactcctcatccttggcttccagatcacatgcttatgctagtttgtatcctacctttctgaacactcgttcagcaactcgtgtttcctctaatcctgaaacgtgggtccaccctgaaagtatggttctactttaaagttctatgtcagggcactgagtaaggcctttcccgtccccagcaatcagaaaccaggaccccactgctgaaggcaaagaggacgtatgtatcccccaactttctcagagagttatcggcagcactgacttaaagaggattaagagcttcagggcgcaggctactctttaatatttttcacgttagaatttgctcagatttgaataaacgcagagcgaaactagagagcgttcgcgcaggttctagctaccttggtcagaaggaggggctgatgcaactttcctcccagtttctgagccctctcgcactgcagctgcgagcctcggggaagcggaacccacaggcgcgcgcgccgctgcttctggccgggcgcgggtcgtggtgcaccacgggagcgccgcaccggccggcatggaggagcgcggcgattccgagccgacccccggctgcagcggcctgggtccgggcggtgttcgcggctttggcgacggcggtggagctccttcgtgggcccctgaggacgcctggatgggcactcaccctaaggtcaggaggcgcgagaggagcagggcgccgtccaggcccctaacccaggcagaacactcccaggcagctctctttctttcttcctcagtgggagactgaggacgcgcgccaccctcaccgagggggaccggtgtgcacaactgccagcctcaggcagcatcggttttgtttgtttaaacaagttgcactatctcaatcccccagccaaagccattttggaactgagagccagacagtaactccgcccctctcaagccggagatccctaataagcgctccactagttttgctgtctaggtaaatcccctttgggggataaatttatttaatcctcacggtaaccatgcaagacaatttgtgggcgatggataagatctaggggtccatagtgataaagatttaagcacagtcacgtttacacttagccttgggcccagaatgcatctttattttgaaaaggtgcagattcctaatatttcagatttcttcgaaagtttgaataggttcttgctcaaagcagagctactcacattttgcgtgtatttttctagattagcagcaggcgagatcaagatagtcctctgcttacttctgcttgagacattactgccttgtacaagtacggttccaagcagtgaatagacagtgaatggagatgtgggttttgtaagaatctcaaaaactagtctctacggtactttaacagaattgcactcttctgctagagagcaataattcataatcatctaaaaacagccaagaaaaaatttgaaggtataagtttgaagagttaacctttttcagcttctcttgcttaattttatcttcctactctgtccccttcatcctcccaaaaggtgagaaaaagaaacaatagcatggaaatattatttagtgcccttttagggaaacaatagcatggagaggcagcatattggttaggcgcatgaactcaaaatcagactcagtttaaatcctgattctgtcacttatcaaccttgtgatttgggacaagttgcttgatcttattatgccttagtttcctcacctgaaaaatggggatattaatagtccatacttacttatacggttgttacaggattaaattaatgaatatttgtaagccattcaacatacagaaagcactatataagtacttaataagcgaaacaccagtaacaactttttaagactttatctagatttggtggtgttattcagtttatatacttgtagattgttttctttttcaagttaatggctgtatacaccttgaccatcaaatctccccttttgatttctcttcttgaaggatcaaattaatttttaaaagaaaaagaacaagtaataaaataatagggggtatttgtttttccaatttcacctttctgttaatttaaaaattatgtagtttcatccagtaaaatggtaccagatttattatccccaaacacacttttattttattattctcctgcttagaaatcctcagtgtttccatactgataaaatcacatgtttagcttgaccaccaaagccttgtaacctggctcaaaattatgttttgggtgttattttcaaaacatgtttgaagtcgacaactaattaacccctgtcctcctgaacctgtacagttacagtgaagctgatgggagaatgtgactttagacctgtccccatgcaggtctgctaataattcaactcagcattagccctgcatatccacctagtcgctggcatagctgggcagcctcagaattctcctgcaggtgtaggcccctgaaaagtattccccttatgctgaccagtagtctgaaagaagcagctttctctagttccttgtcaattccttttaaaaaatctactcttaaagtgagaaagagtgggtagagaggctaggactgatactctagcagattctctccatatacaaataagaggctagggaaatacacagtacccactaacatgtcccatcacaagttttattaaaaaggtttctctattgctggcagataggtttctttacaggcccttgaatgtatgtggcttaatcccacctttgtgtaattacctgcagtattactctacttctccacttacttaaatcataatgttcttcagtgctcaacttgtatcccatcccacctctgctataaatctttcaccagtccctctgagtagagctcttctgacctgctgtgtcatgttttttattccatttacatggtttttaatcacttacagtcatatattgttatttgcctaacaattttaagtgtgcatgtatttaacaattgcaagttctttagagacagagataagatcttatattgccttttaacttccactatacctagaagaattttatagattatatatgcttgatgaccacttgatgattggaagaaaatattaaataattttttcttctcaatttgacaattatattttaattttcagtatctagaaatgatggaattagatataggagatgccacccaagtttatgtagcgttcttggtttacctggacctcatggaaagtaagttgtttgtttatattgttttgttattgggactgtggtagagatttggggggttggattgggatatagcattcttaacataataagcaatcttttatgcatttgctgttaattttgcaatttatttatttacattgggaattactgagtaacagaagctactagaaaagcaaagacaggaggtagtgttacgagtgatatttgctcagctgagtattaggtagaagtttggagtttttattttttgtatttaataaacattattgtccattcaatgatgctctttcaggcaaaagctggcatgaagtaaactgtgtaggattaccagaactccagctcatctgccttgttggtactgagatagaaggggaggggttacagactgtggtgcctacccccatcactgcttccctcagccataacaggtgagcaggtgattttggtctaagttcctttcccgagtaaagcagtaggaaacattaaacatagtgatgtaatacttttaatgaaatttgggatacagggttcatagctttactcttggctatttgaggaataagttaaatatgagtgttgtattcggccattcttgcattgctataaagaaatacctgagactgagtaatttcttaaaaaaaaaagaagaggtttaagtggctcatagttctgaaggctttacagtaagcatggtgctggcatctactcggcttctagggaggcctcaggaagcttataatcatggaggaagttcgtgaagcaagagcaggcacatcatatggcaaaagcaggagtgagagagagtgttgagggggaggttccacacacttttaaatgaccagatctcacgagaactcattgtcctgaagacagcactcagccatgaaggatttacccctataacccaaacatctcccaccaggccccacctccaacattggggattacagttcaacatgggatttgggcaggaacaaatatacaaagtatatcaagcattcaacaagtatttatttagcacttactctatggtcagtactttttcagagacagtatgtatggtagaaatatttatattcttggtaaggaagcaagaccattacatatgaaataacagctgttataagatgtaccatgtaatacaaattatactttatatagcagttggtgaaaagcatgattaacatgcaagctgaaatcaaattttcatgtagctttttttaaaagctttaaaaaagagactttttttaggacctttttttaaaaagcttaggtacacagcattggattaaacatgtctttgtttcatgacatactctcattattagttcatgcttggtttttatttatttacttagttatttttaataatgtaataagtatctctgtacccatcacccaaagcaaaactagattcttgataataactaacatctaatcttataagtcccttccttaacgtgctttcactgacctgaggtaactcattctgaattccatgtacattgggaatttttaaattttagatgtttttaactttaattaaaaaatcttatcttttaaggctgaccttatacacttaatattatattactaaaattcatccattcttgtgcattttttgagctgccacataacattccattgtgtgattataccaccatttttacatccactccctcgatgatggagtgttgctaatgtttaactttaggagataatttcaaactattttcaaagtggttgcctcaatttacttttcacctgcagtgtaaataagatcctttggagctgtattgtctctcacatttagtattgtcagacttttaaatttttgccaatggaatggattattcttattttggtcttaatttacatttcccttattactcataatactgaatatttctttatatatgtattatttataagaaatatctgttcatatcttttgcctgttgggttgtttttagttttctcattgacttgtatgaattctttatatattcttgacctaatagtttttttattgtgttttccagtttttaagtctgtctttcactgtcttaagatgtctttcaatgagtaacagttcttaatttgaatataatcatatttatccatcttttataatcaacgtctttgtgtctagtttaagaaatattttctatctaacggtctaaaaaatacttatattttcactaagagttctattgttcttgtttttaatggtgtgagaggcggttagggataccattgtcatgtggataaccactttttctacctccatttactgaatagtccctcctttcctcactatctgacatatcacttctgctactttccaaagttccaaacatgcattaatttgtttctgggttctctattatattccattagccagtttatctgtccttttgccaataccatatctcttaatcgcttgcttggtaagaagtcttggtatctggttagcaagcctcccttatgcatttcttctttagaagctgtagcaggcagcttctaagatggcttctcctaattctggtattcactcccttatgtaactctcttcccttgagtgtgacctggactcagtgacttctttctaatgaataaaatttggcaaaaatgataggaatgtaacttctaagattaggttacaaaagactgtggcttctatcttgggcactctctcttgcttactataaaggaagccagctgccacgtgagctgtcctacagaaagtctgaaaatagaaaagagatgacaattattgatggagcaagattcttgagagatgaggaaggatggattcaagaggatagtggaggagagtaatattgagcatgtaaaggggtgctgtaaacctctgagagtggggtatgggaagaatgaacaaatgaaaacacagctctatttgggtggcatataagtagggaaaagagcagagcctcttaaattccagcatgaataccgttgatgaatacttaacattttttctagctgactatgactgaatacatagcagtctagtagaaagagccccagactataaagtcttaagacctgggttctagtcttgggactgacacttaacattttgtttgatgtttagcaacacacctaatttctctgggtttcagtttcctcgtcttattttgttgttgagggatttagattaccagtacatgcaagatcccttctaaattaaagctgctgtaactggttattttcattgtgcatatttcataaagccatattaaactaaatttgcagatttctatgaagtattttttgtatttattattcataatgagaattgttttttaatatgtcagtctattcatatgcttctttgagaagctccttactgttttctctgtgtttgagaattacaaatagttgttagcattgacatcagatttaatcgctagtactttccggtttttactagcatgatttccaagccatcctatatccaagagtcttaattcattcctcagaactcattacttctgtcttttaattactgtaacaaatattgtcctagctagtattaatgttatattatttgtttggacaaggagctactatttgaaattaacctgcatttattcctaaaaaataaaattaatgaaagcaatagcctattttaatcaaaatcatttcataagtctagaagtacaaatttgtttccattgttaatttctagtattttccaggtggtaattaatgcttttctagcttgaatggctaaagcttgttttcttcttcaagtagaattagttggaatgataacttggtaagccattttgatgctgttgcatttaataactgagagagcttaaatctttatgtcttgtttttatataaatattcttaactatattatacagtagaatactaatatagaatgtagcacaaatgaggcctgatacatactagatttatatgccttttagtgcataacattttctcaactcaaactatgcaaataactttttaacaaatggaaatgtgtgggtgtatatgtgtgtatgtgtgatttcattattcagtctttaacagggcagtcttttaggtagtaggcatacttttatctatttttacttttagtgtattttataatataaaatgttatatatctaacagtaatgctgcaattccagcctttcatagttaatgtgggaatttttctgtgttagtaacacagagaagaaaatgattgatgttgagtctctgataaccttgtatagcaaagaaattcattgggacatgtcctaaaagtatttggtgggaagatgtgagggcaactcaccatgaaagaaaaaatactttttatttaagagggaaaacagcttttacttattcagtgataaaacatctacataaattaacgattctgttttcacttttaaatattattatttgtcagataatattgcttgggctttttggtcttaacaattatttattgagtgactcttatgtgtcaggcaatgatctaggtgctggggataccatgataacaaatactttcatgacatcctcatgaaagtagtattctagcactgaatattcgcttagaaaatacttttttttttttttttggtaattgttggatggaattttaaaaaacagaattgccctttgttcagatatttaattgaatgtgtgatttgggactgccttcacttattttgtagctagataattgaataacaagtattatggagtactgataagtagtttaacagggatatgtacaaaattatgtcaaaacccagaggaaggacaggaaaagtctctttagccagtaagagaccatggtttagtagggtaactgcaagtaattaagcatgattgcctacctagcatggtgtctagtcagagtaggtgtctagtaatattccttaaggcagcaaatgaatgaatgaatgaatgaataaaatttcagagaaaagagggaaaggatggaaaattagatgggaaagtttatttagattatgaaggccatcattgtttttacttttttgctattactaatggtattctaatgaatagccttgtgagtacctccttgtactcatgtatgagagttttcctaagaatagctgggacatgtatacctttataccttctttttttttgagatggattctggctctgtcactcaggctggagtgcagtggcacaatctcggcacactgcagtctccgcctcccgggttcaagtgattctcctgcttcagcgttctaagtagctgggattacaggcatgcactaccatgcccaactaattttttgtgttttagtagagacaggtttttgccttattggctaggctggtctcgaactcctgacctcaagttatctgcccgccttggcctcccaaaattctggcattacaggtgtgagccactaggcctggcctatcccttcatctctactggttattgctaaattgttttcaaaaggattattaccagtttacacttgcacttgcaatgtgtaagttttcacagactgggagaagatttataacatgtgcataactgacaggttaatttagaattagcttctgtgatttcagaaaaaaaatcccaatgggaaacatgggcaaagaatatgaacaggcaactcacagaagaggaactcaaatgctcaaatatgtttgtaaatgaaggaattacaaatataaaatgtgtttgtgttgtcttaactttgaagaagacttgcagacagtttgtttttattttttgacagaaataaggtactgtttaatggggaacttttgaacagaactacagctagcacttagagagtctctgaacagtttaggaaaaggagctccctctcgacatgcaaaggaaaatgtctcttcactaaggttcaaggcttggcgaacaatgaaggccagattttagatccacttgtgccaggcaccgttgtgcaaagcacaatctgcatatctgtacatgatgccctgcccctgaagcatgtctgtggagtcttaggtttccacaaagaacactatgaaaattactgctaaatgggtggtgtcattgaagggctttaagcaaggaagtgagactattgtttattctatgtggttttaagaatactttgcatttgcagagaatgttacagaatttcaaagtatttcaaaatatttttacaagtagactttcattaaatcagcaccaaaatccctagtggtatacggggtgtttgttttatcctaactttacatacaaaaagctgaggttaaaagtatattttcatttgtacccccactttttccaaaagataataaaagattaagtgagctgtaccacggtctcagttagcctcacagctattagagtttctcttgctttattggtttttaaaaagattttattgtaaatgaaactagatacggaaaaccacacaataccaatgtataaattaatgagttataaggcaaacgtctagaactcttgtaattataactaagtcaagaaatagaacttttctaggcaccccacaaacttttcaatgtgccccatcccaatcataatctttcttcccccccaaaatagccattattctttcttttatagtaataatgggctttggcccatatattgttcccaggacctcttagtgctaatttgtcttttgactctcactcaagaaagaatgttggaatatcactggtgagactgataatattatcaggaatattagttttatatttaaaaataccctgccaactttactactctattgttagaaacaaattacttgccacatactatacaaccaacctcagcataccagttgtaaatcaccattttagactgtgcgtcttagctgcttgaatatagtgctttaaaaaatgctttgtagtcctcaaaaaaccttaaataacatttttattagtaggagagttgggtagcatacacagctgtagagccagaggagttggcagtttgctggagctacaatttcttattatttacaaagagcatatagcacataaggcctgataactgtctcttttattgaaggagacaaattttataatctgttgtttgtaaaactgaaccaaactctgtcatttacatagttaactacaacttagttataaagtatttccctagtgatgacaaatagtcccactgtttcagtcaccacttgactgttatgtggcagagtggcatgtatatttatatggtttattatttattttatggtgtatatgtattttctgcctccttaaaaagtaattgttctaaggagtgtttaatgttatatctgtgtgctattctaagaatgcctgaacagtttttagtgtctgcttcccacttactttcccaggctttagacctggtggttttgtttacatactttctggcaagagtgtcgacagattccattacagggtgaatgtgtatttgaatgactgtgagtgaatgcattactttgagcacaagtacgttttgtgtttagcattttctgtaaagcagttatatatgatatgtgatcacagttaaaacactttgtcatatttttcaagtttcagaaggtcttgtgtgtaatagtccttatgaaaatattgatttaatgttatttcctgatctgtaatgggggaataaaattgataaagtgcccatttctgattatctagtgggaaaattttgctgatggagtatgaagtaattaattgctagtgtttcttgtttctctcatctaaaaatacttcctaaagctaatgtaaaataatttttagtttgcattataatgccatattaagttgtatatttgcatggtatccatatggacagtactctagattgtttctttgctaaattgaatctaaggaatacatgaagcaactttggtaaatgactgtagaggtacagtttgctcagacaaagcaatggtataaaatcatattcatagatacacagagatgaaagagatctgatggatttaaagatgagacaacaagaggaatactaactaaaactagtgacctatctttttcagtgctaagattgcaaatgaagtcaaatttatgttcagatagcctgattagcttcactttggaccaccttgggtccattggtatttattgagtaccctaaatggtaaaagtatactatactgaaattaggataatagtattacaattttctgtaatagtagtagtactacaggtagttgcaaatgggaaaatatcttaagtgacttatacagggactcaaattataagggaacaaaatggttttctagtctttaactactggtagggttttttttgtttgtttttttttccccctcatagacccaatgtcacctcccaattctaatgtaaattttgtttcttcagtaagatacaagaggtgggaaaaccttagttgacatattttaaactcatctgtggttatatgtaaattaaaaaaaagctgagcgaagtgaaatgtcttatacaattataaaatccaggcacagttaagatacagctttctgaaactattaatctccttttctttccccaaaggattgtagttccttccttagtaatacgtgaatcattcatcctttcaaacctgactaaattgtaaatggttctttcttctcagtgtcagagaagaatagtggatgggagaatggagcctctcccatcaccattttgttcccctaggacctcaaatagtggcatttcttttgttgttattgtttcgtggcagttggtaacctttctaaattgaatacactcagccatcttatctgagacaaaaatatttcaaaagttcttcttggcatctgcatattacttgggaagtttagaaaaaagatgtaaacattccatataccaaattgctcctttgcaagcttagctaccatgaagctaaaagtctaagagcttttaaaagttggtttgaataaaattattttggcaagagtattgtacaattaaaggaatttatgccttaagagaagtgaaaataattctgtgcacattagaaatgaatgtcagagccaaagttaggattcctagcctgtggtgatttgcttaatctgatgcttagcttattaatgcatatcatatcctatttccctcaatgttgttttcaaaagaatgtactctcttttcctcatacattgaatccgatgaattttagttattttttctttgtcagaattaatttttcccaatatagcttttaaagactgccaatagtaatttttcttttttaaaggacatgattaaagaacattttattagctgtttgtattatcacagcagtaacccagataatataaatggacgaattatttatttttaaatccattgcctttgtgttttcatggggagaagaaaaaacctaatattttaaaaccccgagatgtgtagggaaaattaaaaatttatttattgttcttacccatcactaaaaatgttataaatgtatttgattttactttttatttaaatataattaatacaaacataattatatactacctagaggcaaaatttggttttaggatagaataaaaaggtaaattacaaattattccagtattttctaagttgcttatttatttattggctgcctgggctcatcgggtgcaaaatattatggactttgcctacaagatgctaacagtctggagctgagatggacagtcatttacatctagtgtgataaacgtaatgacagatatgtacagggtactgaggaagaccacagagggaggagacctaactttgactggtgggataaagagacaagagagtctgggaaaacttactggaggacaagatgtttgaaatatgcaagaacaaggaacaaggatgggaatggatgccctggttaaagtaataacatgagcaaggtattgagggctgagagggcctgaaatttgccaatagttcattatgactgggtatgtagtaatggcagagagagtacctgcctgcagttggtgagaaagccctagattggtgtggcatgggtggagaaggagtgagtatgtgtgatacaagagatatgggaatgatgggaaaaggaggggaggaaaggagagacagacatagaaaaaatatgaaaaaacaaacaaacaaacaaacagctctcctcctgggaagtaacagttcaggagaagcaacctcttaaggattaaggaagtcaaaggtaagagaaagttaaatcaagagttttgccactacaaaatctgtaggaaatcctgaaacaaaggtgggaaaattatttgagtcagaatattaggaattgtaatgcttgtttctgttttctgtaatggataccaattacaatgtgcaaatctgtaaggatatagatgtttagctattaatgcaagaacctaatttggggatttgaggaggttaagtaactagggtttagtcatctgagcttttctcttcattatactcactccctaagcggccttatctggttctaaggttttaaatatcatcgatatactgatgactcccaaatttttatctccatcccaacctcttccatgaacctcagactcatatatgtaagtgcctacttgacatctccgctgtgatctaaaaaaggcatctcaaattagcatgtccaaaaagaaatcttgatttgctcctatactttctccttctgtcgttttctttttgtcaataaatggcaactctattcattctgaagctcagaccaaaaaccttagagtcattttaaaatgtatacacacacacacacacacacactttattttttagaccaattttagatttacagaaaaaattgagcagatagtacagagatttcccatctaagtcccagtccagcatagtgtttcccctattattaacatctttgtgttagtatggtacatttgttacaattaaccaatattcatacattattagtattattaactgaaatttgtcatttacactagggtttattctttttgcacaattctgtggattttgacaaatgcataatgtcatgtattcatcatcacatacagaatagtttcagtgccataaacataccctatgcttcatttattcatccctttcttcacccccaaacacatccctggctgctactgaactttttactttctgtgttgttttgccttttccagaatggcatatagctggaattatacagtatgtagcctttcagattggctttcactcagcaatatgtatccctgctagcatggcattttgggttttagctaccctagtgggcacacaatggcatctcattgttcttttaacttcttgcaatttcctgatgacatatgatgttgagcatcttttcatatgcttatttgccacctgtatatctcctttggtgaggtgtctgttcagattttttgcccatttttaaattgggttttctttttgataagtttcaagacttctgtgtatattttgaatgcaagtcctttatcagatatgtgttttacaaatattttctcccagtccatggcttatattttcattatcttaacattgtattttgcagaacagaagttttaaattttaatagaatctgatataatttttttcctggatcatgcttttggtattttatctaaaaactcatcaccaaatccaaggcatcctattttgtcttctagaagttttatagttttgcattttacattaaggtctgtgatccatttttagttaatttttatgaaggatataaggtcagtgtttagattgattttttccaggtgaatatccagttactctaacaccatttgttgaaaagatgtttatttcttcatcaaattgcctttttttttttggtcaaagatcaattgactatttatgtgagtcaattctgagctctctattctattccattgacctattcatctattccttaaccaataccacatgatcttgattactatagctttacaataggtcttttttttttctttatgtgatttttttgagacagggtctcactctgttgcccaagttggagtggagtggcacgatctcggctcactgcaacccggtccgcctcctgggttcaagcaattctcatgcctcagcctcttgagtagctgggactacaggcgcataccaccacacctggctaatttttgcatttttaatagagacagggtttcaccatgttggctaggctggtctcaaactcctaacctcaagtgatccgcctgccttagcctcttaaagtgctggggttacaggtgtgagccactgtgcccggcttgtaataggccttaaagtcagataaaatcagtcctctcactttgttctttaacactttgttggatattctgactcttttgcctttccatatcaattttacaatcagcttgtcaatatctacaaaacaacgtgctgggattttgaatgggattgcacttgtagatcacattgagaagaattggtatccaggaacatggactatctctccatttgtttagatctcctatgatttctttcatcagagttttacagttttcctcacatagatcctataaatattttgttagatttatacctaaatatttatcttttatgatgctgatgtaaatggtgttttgtttttaatttcaaattccaattgtttattgctgatatataggaatacagtggacttttgtatattatccttgtatcctgtaaccttgctataatctcttagtttttattcttccattttctcatacccccaaattaatttatcagtaaaccctgtcaattccttaaaattacatccagaatctgtccatttcttaccacttacactacaactgttaccactctggcttaagctgctattatctcacctcctggacctactaagtggtcctcctttaaaacacttgatatattaatgctactcaacatatttcatatttggttttctttgattatctactgtctgttttcctccactagaaagtaagttccctgaaagtgagaacttggttttgtttattggtatatccctggggtctaacctggtacctggtacatggtgctaagtaagtatttgttgaaagattgggtaagctatcttaggctactgtgttcctgcagcagagacttcctaattaataccttaaagaacataagaatatactataagcaaccttttaagaatttccaaaaaattagaatgtctgcaaaatctgccaggcacagtggctcacgcctgtaatcccagcactttgggaggctgaggtgggcggatcacctgaggtcaggagtttgataccagcctggccaacatggcaaaaccccgtctctactaaaaatacaaaaaattagctggatgtggtggtgtgtgcctgtagtcccagctacttgggaggcctagtgaggcaagagaattgcttgaacccaggaggtggaggttgcagtgagccaaggtcacaccactgtgctccagtctgggtgacagagcgagactctctctctcaaaaaaaaaaaaaaaaaatatatatatatatatatatatatatatatgtacatatgtatgtatctgcaaaatccatccacttgcaggatttatcaccattttccacgctttgcattgtaacctgccaatgttatgaatagcctctttactttttagttgaattttttttcatttatattctctctgccctttcacccctctttttccctagtgccttgggaaaaggacttatattaattctggagtagagggttactagaactagttctttctttggaacatctctgaagatattcttagttatgagatttgatcctcaaatgctacatactttcttgaaggaccgtccattattatttccctgtaattgaaaaatatttccactttctgaaagcataatccttattacaaattcatttaatgaccactattttatttgagtcctaaagtctcataattgcaaaatgacttctgtcatttggcttctctgcatattaggatgtgtgtcctcaccttccctctgctagaaatctgctgctggtgaaacccccaattctggcagcttcttttaactgatacagcatttttttttctcttacccttaaacaaaagcttgcagttcattacagaatgacttcccactggggtggatagcttcattgttcagtaaacccccttggaattttagctgccttgattttttactaggaaggcattggcatgaatttcaaggaggtggtctgttatccctgaaacttttctttgggactgagcctgtggatgaataaggcttctttggtgcctctgacaccaacttaattttgcattatgtttcagagttgcattatggcatgtcattccattatatcataatgaggcaaatcaaggaattattcccttttactaataaggctatagcatatattatttggccacattgaagaggataggagatactttctatgggttgaaattaatactacttttaacccatgatacattctatttcaatagcatttgaagttaaaagtaatgcggtcttcaacttcttgtcctctgtgtaaatctccagagattacttagtatctgtttcagaatcattacagaaaaatcaatgctaagatttatggaaagcatttaaatagcttggactaaaggtattagccaaatagtgttaactgtgtatttgcttcaggcttgttttcaagttagctatatgaagctctggaatcactttttttcagtacacagagctcctctatgaacagttatgagaaataaaaacctgttgtgagcatcaaattttgttgctgttattaaatagctattattattgatacatatttttctttaggtgggatttttccctttagatataactgagtttaaaacttgaaactgttagtattaatacataggttatatttttcataggttgatttctatccaatatgaactataaagaattttatcgtttattgttgtagatttgtgtgatgaaacatacaatatttccagtatcttcacaatatttttccaaagaactgagctattaaaatttatacatataaggaaacattctgtcatttctaaagtgagatttcaaaccataagcttgttagaaattaagtgagattatagtattctggtgatacttaaatgttcttgggatctttacaatcatatgtggttttttaagaacttaagaatcttttgttactgctattattaatagattgggaaaatataatctgttgactaaaaggcaaaataaacatttttaagattttatgcagtatcctataatggaaacaaacaagaaaggtcttgttcttgtttgttgaggaaaagatgatggctttgctttaaacatacttgaaaaatcgactagaagagatcctgaacaagaaactgtaagacttctggaatgtaccttgagtaacagaggcagataaactattttattctgttactagtgagaagattcactggtaattcacaatcaccgccccctccaaccaaataccataaacaaggcctcagaaatgggaacttccatttcatttttgacagtgatttctctcaactctgaaaacaaaaccccttttacaactctgagttagttttcaaatgttagggtttcctgcatgggtatttggggtaagtatgaaaatgttttgctgcttaaatcaaagaactctggaaacagatataaattgagaatggaaaaagagtagtgaataagatggaaatttctattctaaatttcactatatgggctacaattcccatatagttttccttagtgaacaccaccccccaacacacacatacaaacacaccttctgatttaaataacattatatcttcagaaatggaaaatgtgttaaagttgtgttaacaggcttccttcttgtctgtgtcccattctcatcacagtctaccagttagggatgtttagagaaatttatcttgtggcattgaagtggctttatgtgcattatatattgggttttatgtatattgcatactgtgaagtaatcatgatacatgctgacaacaaaagatgtagataagttaaaattttagttgatccattgtctgtttcttctttgccatctttgtagaaaaaaattaattcaagatggacagcctataaaaatgtatctttttctattattattaatttagatattggcgtgccacttttgaagaaggaaaatacttagctacattaaaagatttgcattgaagaagcaattgtgatatgctgccttttatcacagtgtgacttcccatcagtgctgagtaatgaagtttctgattaatatctatcgttgctttatcagaatatctttctctaaagtaaatcattcttgtgaataagaatctagctagttgtaatgcagttcagcataggtggaaataattttttaaggactaagtcaatttctgggattcagactgtttcagaaaagaaacattttctgtatttccactaatggcacagtgtaccttagtatgtttgggttagtattcagttttagcaataatcatggaggcaggggtatctataaatattatatcccaatttgcaaggtagcaaagttgtatatatactacataatatgaccacttgacagtttatgaagtcttttcatatatgccatttaattgattcatataataatcttatgtgtaaacataaaggtgtactactatcttcatttcaagtatccttgaaaagactttctccattgaattgcctttgtacctttgtcaaaaatcaactgaccagccttatagcacgttaagaagtaacttatatgatgttattaacacaaaggatgggggaaggaatgaagctatattggagtaaacaatgacaccagacagttatgtgaagaaatgaagaataccaggaatattaaatatgtgaatgtaaaagaccctaatatattttcctttctcctcttaactttataaaaagaaaattatttaaagtaataattacaacactatattactgggtttaaatatataaacatatatgacaataatagcataaaggtggaggaaaggaataaagctctattggagcaatttctatattttttagaatcaagttagtattaagctgagagaaattgtgataaactaagacgcaatagtaatctctagagtcatcactacgaaactcaagaaactatagtaaaaaaaaatacattaattaaaatggtgtactagaaaatacctatttaatagaaaagaaggtgataaaggagggtgagaggaagtaaaaagacatgtgatatatagaaaacaaatagctaaatggcaggcatgaatccaaccataccaatgttaattttaaatttgaataaacactcaaaagggcagagattgtcagattggatataaaaacaagatccaactatatgctatctacaaaagatacacttcagattcagagacaacaattttggaaaactgtcaactatttctataccattctctttcctttccttctgtgattccaattatgtgtaatgttgaacttatttgatactataccagaagactctgatgttattttttaaaattattttttctctttttacttcagtttggtttcttgtgacctgttttcaagttttctagtgctttcttctgtcacatctcatctaattgagtgaccgcaactcctaagtatattgtgactttattttcaggataagggagatcttgaaggcatctcgaaagttgcaaggtgatccagatttgccgatgtcttttactttggccatagtggagtctgattctacaatagtctattataaacttactgatggatttatgctgccagaccctcaggtcagttttgaggtaactgacagcaagaagtacaaaaagaggaaaattatgacgtgattttaagtgtgactcaagtcagtcacagaactgccacttcctttgccatagggaaaattcaagaaaaaaagtcttgattttcagacgtcagaaaattggttatattttgttcaaagtagcatgttcctagttatttttgcaaaaaaaaaattgatttccttactctttggagaatttcatggttttccaaagtattttatgaagtcatcatgcatttaattatttagtgagtagctgaggtggaatgtaaaggctaataatagttgtaagtaaaaaaacgcttatttaagaaatgttaaattggttgacattttgacaggaacattttaataagataaatgtgctatatgtgatttctttacatactttgttggtataatttggataattacattaaatatctttctaattttgcttttggattacattgtttatcggagaaaagtccatcctgatcttttttttttccagaatatttctcttagaagatgacatccatgtttcctgatgcttgttttattcatacaagattggatttgagacccatcagactgcttcatcttttatctcagaaatagggttgacgtacatagtgagggttgacttccccattccataaggttttcattctgaagagtaaaacttccccaggtagaagactttctccttcttaaaaaatatagggtgatttctttaaaactttgttatctagagacagtttaattacagttatatacaggtttatgcctaggatgtattcagatgggtgggacctgtgtgctgcttttgtcatcccacactcaaagttgtctctttgtttcttgctgccactgccagctcattgttgagactgccatttctttctcttactcagctctccccagtgccttttggccactgcagctaccgtagaatggcattttatatgtaccttgtcacccacttctgtttactttttcctctccagtaaaaagtaaaagatttctttcaattggtcttcccattgcagttactgttatttctcttttttggttaactttaaatcaaaactcaaaatatgttcatccagagtgtgtcttaagtaacttacgtgtcttaagtaacagggaccagagacatgttacctacaagagttctgggctatccttttcattcttatcacatatcatagcttgaatattacaacagtgtgggagagaatcaaccgtaaaaatgtcttcattaattagacccagttattccacttttgttaatgtctctcaaattgtacaaagtataaaaaattatatgcacaaagatgttccaagtgacattacttttagtagcccaaattataaaccactttaaagtttggggtaaagattggcaaactttttctataaagggccagaaagtaactattttaggtttttaaacctactgtctctgtcataacttgtcaacactgctgtatgaagcacaaaagcagccatagacaatacataaacaatacgggcgtggctttgttccagtaaaactttgtttacaaatgtggtgccatagtttgtcatccctgggtctaggaaatagtcaataaacagatatatacaaatgatacataatgtacttattaaaaattagtaatgaatattattaaaaacatgaaaatattaccttaagtaaaaattgcaagacggaaaagtgtataagtgggtgtaatcatggctgaaataacagaccaagcatatgataaaaagataacaaagtaaatcaaattactaactggttatagtgggataggaggcagaaaatggatgactttgtcttttctcaatgtttttatttgtattttataataaaaatgttttaaaattaaaaggtgtcttgaaatctgtattagttatctatcattgcaaaataatattaccacaaatgtagcaacttaaaacagcacacatttattatcttatagtttttgtgggcaagggacccgggcacagattagttgggtcctccatgaggctacagtcaaggtgttgggcagggctccagtctcatctgagacttgactggggaagggtcagctttttcacccacatggttattagtagccttcaatttcttgagagtgctcaatgcttatatgccattggcaggaggccaccctcagctctttgccacgtgggccttctcaatataactggttgcttcctcaaagccagcaaaggagagtctcagcaagatggaccttataatccttatataatgtaatcacatacatcccatcacctttgccgtattctgttgattggaagcaggtcataggtcctgcctacacactagggtttcatggctgattaggaaacaacaataacaagaatggaaaaatgatgaaaattaggaacatcacaaaatagtataaagcatcattcttcatctgtagtcattcctgactccttcctttgatggtatttgaatttcacttttattcttggtgggaggtctccataactccttcaggctccctctgcttccccagaggacatgaagatggacctattcagaacaatatgtgtttgggtgactctagtggaaaatttgcaggtctaagaatcctcaaacagtttatgataaattcttagggtctcttgatttcttaagtctctcgtttgattcattttgaggtctttcattataattctagaaaaatagcattttcagaaagaagtgtaaggataatgtcagatttgtgtgtcggatctgttgaccagtgggctcctatataactacaaaaccagaagtgtcttttggggttggctgtgaaaggcgctttcccaactctttaaactaggattgaatcctgctgtatgtcttgggatgtttactctatttcagaatgttccctgtgtacttcaccaaagttgttctgtccaaagccagccagacacatcctaacatgaataatggcccagaactttttggaaagggaggccacccagctgtgtatgtctcattttaatgaaaaactagataaagtgatttaagtaattttgtaagtgagtttacatttgtctccctgttagactgggctccttaagaacagaacaagaaatgtattttttaatacatctctgtatcttgcctctttgcacagtaactcacatatagtaaaccctcagtaaatacttggcaaatgaatgaatgctgattatagccgtgtctgattatataatggcttattttttccctcaaggcaaactaaaacaattcatttggacaccagagggcactgctagataaccacagcattttcagactctactaagagtagattagctggagaagtggtactcttgaaaatttattttcaatctgtaggaaatagcataaataaaaatataaataagttttacgtactcacatcccctttttctttctggcatgcctctaaaattatactgacattaaatatgtgacttgattcatgctttgcttaaaatgtagatctatatttagaaataaaagcctgtttagggtaggggtagatggggtgggttttatatatatatatatatatttttttttttcttagccatatgaaagtatgcattttagtttttcattctaaaagcctaatttatcctgaaatgaatttcaggatcacatcacatagcaataaaccccagctctggaacactcactattctggctaagtgctggtggtaaaagatatacattgctgctttaatataagcaggtattccttgttgtattgcaattctctttattctgttttggggatattgtgttttttacaaattgaaggtttgtggcaaccctgcctcaagcaagattgtcgatgccatttttccaacatgatcatttcatgtctttctgtcatattttggtaattcttgcgatattttaaactttttttattattatatctgatatggtgatctgtttttcagggatatttgatgttactattgtaattgttttggtgtgccacaaattgtgcccatataagacagcaaactcagttgataaatgttatgtgtgttctgactgccctaccaaccaggatttctgccatttctctcccttacttctggcctccctattccctgagaaacagcaatattgaaattaggccaattaataaccctacaatggcctctatgtgttcaagtaaaaggtagtgtagtacatctgtcactttaaatcaaaagctagaaacgattacacttagtgagaaaaacatgtcaaaagatgagatgggccaaaaactaggcctcttgtgccaaacagtcaagttgtgaatgcaaatgaaaagttatggaaagaaatgaaaagtgctactccagtgaacacatgaataagaaagtgaaacagccttattgttgatatggagaaagtttgagtggtctgcagagaagatcaaaccagctacaacattcccttaagccaaaacctaatccagagcaaggccctaactctcttttcaattctatgaaggctgagagaggtgacaaaactgcagaagaaaagtttgaagctagcagagcttggttcatgaggtttaaggaaagaagctgtcttcataacttaaaagtgcaaagtgatgcagcaaatcctgatgtagaagctgcagtaaattatcaaaaaatctagctaagatagttgatgaaggtggctatattaaataacaggctttaaatgtagacagacggccttatattggaagaaaatgccatctaggactttcatggctagaaagaagccaatgtctggcttcaaagcttcaaaggatgggctaattctcttgtctggggctaatgcagctgatgactaaattaaagccaatgttcatttaccattctgaaaatcctggagtccttaagaattacgcccaatctactctacttatactctataagtggaacaatgatgcctggatgaaagcacatctgtttacagcatggtttactgaatattttaagcctacgattgagacctactgctcagaaaaaaagatttctttcaaaatattactgttcattgacaatgcacctggtcacccaagagccctcatggacatatacaaggagattaatgttgctttcatgcttgtgaacacattatccattcagtaaggtcaaggagtgattttgactttgaagtcttattgcttaagaaatacattttgtaaggctgtagctgccatagatagttactcctgttatggatctgggcaaagtagactgacaaccttccagaaaaggacttgccattctagatgccattaagaatatttgtgattcatgggaagaggtaaaaatgtttgaaggatgttgattccaacccttgtggatgactttgagcattcaagactttagtggaggaagttaactgcagatgtggtagaaatagcaagagaattagaattggaagtgaagcttgaagatgtaaatggattgttataatttcatgagacaacctgaacatatgaggagttgtttcttatggatgagcaaagagtggtttcttgagatggaatctacttcttgtgcagatgctatgaacactgttgaaatgacaaaatatttagaaaattacataaacttaataaagcagcagcagagtttgagaagattgattccaattttgaatattttactgtgggtaaaatgctatcaagtagcatcagagtctacagagaaatcttttgtgaaaggaggagtcaatgattttggcaaatttcattgtatgttattttaagactttgccacagccaccgcaaccttcagcaaccaccactctgatcagttagcacccattaacatcaaggcaagactctccaccagcaaaaagattattacttgctgaagcctcagatgatcattagcctctttcacaataaagtattttaaaattaaggtgtgtgcattgttttttagacatgatgccatatactacatgttcgtgtaaatgcaagttttataggcactaggaaaccaaaaaaattgtatgacttgttttattgcaatatttactttattgcagtggtctggaactgacccttcaatatctccaaggtatgccggtataaacttttctgtaaaagaggtgccctctttagctggggcatgaaagagggaaatggcatgtgaggatttctctctggtgccgcctttgcctttcttttctggagtctctaatcagtgtgccctctgtgctggggaagctcagtggaatactaagctaggtcctatggctccagactaagtatttgcttctcctggctgagactctttagaagaatatgttactaaacaccatagatctcttgtaaagaacatgaaggaagaggtactttggaattcaaatttacaattagaatagaagagtaatctgcaaagttcacgtagtcagcatttttatttttattttttattttttactaaaacagcttttcccttttataagcctggaaccaaatgacttaaccaaaacttcatggtgtttcatctctttctgagtatttctgttctgaattcctctctgaggtcactttttccattgcagcccctagcagaaggcctcttcactgctgcagcacagtggttcctgccaaagtttgtagttcttctatacagaagctctttattcatctgccatattttaccttgagtgtttacatgtgcagaataatgtgctatcctctgagcaattaatagtacaatttcccttctttctggccaataaccgttccttaccaccccctaatcctcttaatgatctttggataagaactgcttgtactcactaaggaaagtggatggaaaaatcaaatgtctagtaggtgggtgtgctattataatgtttaaatgattttgaaaattttcccaaagccaatttaagcaaaatcagagattggccttttaggtttctgggtactaaggggaagtaataagaagtattttattaaaggttatttatcagtttatcttcagacattaactggtatcttagctaggacaaccattacaaaataccacagcctgggtgccataaacaacagaaatttatctccttacagttctggatgctgggagttccaaattaaggtgctagcagacttttaagggctcttttcctggctttcagatggcagccttctggctgtgtcctcacatggcctttcctctgtggggcatggcgagattgagaaaaaaggagagagagagagggtcagagcacgtgcaagtgcatgctgtctggcggcatcttttcatcttcttataagaacaccagcgccatcagattagggccccatccttatgacatcattaactttaattacctccctaaaggccttatccccaattccagtcacattgtgggataggatttcaatatatgaatttgaagggtacataatgcagtccatataaactgggctccttctctgtgctcagatactgtggtaagtctagggatacaaagattggtgagacatgacctctaccctcaaggaattcagacaggcaattacaactctctttagccaaaattctaaacacctgttgttagtgtgaattgagaaatacttgtcttgcagtgtataaagtttgtgtagtttacttaagggtgaaggggtttaacaacttatgataaatagttttcaaacgatcatcatatgtgtattatttgtcccaaagtactcagcattggatcatatgcaaagaaaaagtgcacagtgaacctctaaggagcttattgtctcccttgaaaggagaaaatctaggtacaaaataattcaagagcattacaaggacaacattatatataaatgcaaagttataatcatgttgtactttattcactactaagtgcttcagaaccctatatcttgatgctcacaacagagctgatgttacttacatgttattaactttttatcctcataagatagagaaattagggcacaagtggttaagtaatagctccaggtagtagcaagcaagtggagtgggtaatgcagattagatccaggtctcctgatacctagcactgtattgttttcagaatattatgttgcctttttcttgtatgatgcagagaaatatattagtgtgtgccaaagtctttgggaggaaaaaattattcagtcctggagggagttaggaagtgatttttggatcaattacattatcctctgatacttgaacaaatgtatcaaaatgtcaagctgtttgtgggtaattctgaaaaacatattcataagcaatatatttacagagttttattccagaggataaacacattcatgctcatgcttttatgttggcaaacctaaaacaatatttaatagtaaataaagaagaactcagaaagtttctctgcttgttgacactaaattttgtgctggtacaaacagaaaatccagaaacttataaatgatcattgcacctcaatgaagaagaccattgcacctcaatgatcttgcaccccaagtattcctcagatctgcctgccagtgcttggaatcctaacataattctgtttcttaatcatgaatcaataatccaatttaatttgacaaacattttgttagcaccttcatgggtaagacatcgtgctaagatctggtggaaagacaattccaaatatgttattattagattcaataggtcaaattaatcagcttaactgttacaagaatttctaaatgtttattctcaatttctatacttacatcattgcagagcagcaatagtttgtggattgatacctgtgtatgaactacactttgagtggcatgtgttaaaagctttgatgaggaatgagagcctgaaccccaataatagcctgggcatattagtcagggtgggctggattattatgcagcaacagccagcgagttcatttaacaagtgtttattgcttgctcactttacatgcccattgactgaaacgacccattgcatgccctttactctggaaatcagagtgacagggcctccaccatctgaaatgctgtcagttccagctgcaggaggcagttccagctgcagtgttgcttactgcaattaggaagcagcccatgttactcctgtccacgtttcactagccaaaggaagccacgtgcctggccatgatctacctcaagaaagaggggaagtgcaaatctgtcatgttcctggattgaggaaaaggaatattcagaaagcagcacttccaggtaatagaaaggagaggagagagccggcaggtagatttaacaactggatagctgcgtgaacagagaaggagctggagttaaacctcaaactattgagtcccgtcactttaatgggagtgagtttcgggttgttttgggaagacagtgagaggacattgcaagaaggaaagggcactaagtaccaccaggttgggaaacaggccacctagaggactttttcccacttcatggctcgggttctggagatcagaaagaagatcttgtatggatcagaaacctagggtcattggggactttattcttcccgttcttctgatgcaccagattgttacacagactatgttgtcctggccttttctttacttcctaagaatggaaaaaagaaagcagttgtgcctatagcatagaagatttagtggaactctgcgagaatatttctgaaggaagctggttaaacatggatgcgtgggtgaggctgggtttatgaagagcctggtggcaactcttctgggatggatagttgtttatgtgggatagtgaacatggagtgtttgtatagatctaggacactttcagggtgcattagcatctgacagagagagagctgggggacagacatcagtccttagggtttctcatcagtcacacaggtagtggctgaattgggcatcatcctgcagtgcctgaggtccatctgggtctctcatgactttttctcttgagcacttggaaaatatttggtctggtcctgaactccagggacatgttggggaactttcaggctgttttgggtcctctccatctagatacactttcccagccatatgtgcttctctgctgtcttcatagcatgttgaagaaagatcctaagagtctgagatatgtggagtatgtggagctttacctgggcctggaggcagcagtagggggtatagggtaggagtgggtgctggccatattccctttcatttcctttatttcctttggagcgtctattgtctctcctctgcaccagcaacttttggggtcagagcggagggcacggaccacaggtgtctgctccatgaccagttcaaggttctaactcttccacttttgctactttttatccccaacaggttttttcccctaggtttattttgtcttaggggtaggaaaaactgatgccgaccatttccagatcaattttccttctaaacatattgtttttgccaagattttagattttggaattcaaaagccaagaatttgctctttttgttctgtagcataatcctgttcctgaggcagtgtgccaagaaagcctgtatgggaaaaagttcacagggaacaagaattactgaaaagggaaaatatatcagttaatatatcaaaaattatccagttacattcacaaacagaaggtgttaattgtcattaaaattcatattgatactcacaagacctatttaattttctgagggtacattttatcttatctatcagcttacatcccacctaatgataatgcagtatttgatacagagtagaagctcaatagaagtcttatttgattgcattcaaatattcataaatggactactacccaccccatccaattcctgccattccagtggcagggcaaggaccagctgcttttctgccctgtccactttgtacagaaagcagagcttcatgtacctcaggctgtgagacaaatcaccatcccatgcgattttcttttgtaagcatgcttatgctacaagatcccttatattttgatcccttgccttagagttctgagaaatcaaaataaggatttataaacaaaatatatctgcctgataagtttacttattatttgattacacatcctttcctatgccaaacctatgcatttatttattcaacattttttggggaaatgaaggcatgtaaacactgctaaatttggaaactctacttagaaatggtaattcctctcacataattatacaattattgtggattgtacttctgttgatgaccacagatggggatgctgtggttttgaatattgggtgaaaaattggtcatctcttctcccatcccaagtgagatcattagaaaacttggttcctataaatataaccaagaatgttgcttttttctggattgtacattctctattgtttagatataaatgaatagaattcatccactttggaccataatgttccactcccacaaaatgaaaggagttggtgcagatactatctgtgatcccctctagctctttattttggtgatcctataattgaaagattttgccacatagatctttccttctcaccctcacgctcatcaccctcttccacctctacccctgttaaaaacaacaacaacatattcctcccatcatgggccttattaatccaccattagaattgtgctcctttgaatttttgaggcccaagagacttgcaaggcagagttttgacttcagaaaaccaacagtgacatgggacagttgtgtaatctccctgagtctcagtttctcatctgtaaaatgaaggacaaagtgtgtccttccagggttgtgttttcctcacacattgaaatggttatgtgaggataaatgaagcccagcatacaataatctatcaatgatccttccctttgcagcctccaaactcttcccattgatgtgcaggttgccaccttgggagagaatacatgataactagctgagagccagtcctccaaggagtaggacctagatgtttagcagggtatgaagaaggtagtcttagtccattttgttgtttgatattctgttattctaactatcacaccccatcccacctatgatggttttaagatattatccataaatccttttgattattatccataaatccttttgattattatccataaatccttttgatttatggataatatcttaaaaccatcacaggtgggatggggtgtgatagttaaagagcattttaattttctgttattctgtaacagaatatcagagactgggtaatttataatgaacagaaatttattagctcacatttcttgacactgggaagcttaagatcaagggtccagcatctggcaagggcctgcttgctttatcttatggcagaaggcagaagggaaagagagatcaagaggagtcaaattagccctttataatggcaccaatcctgcccatgagggtggagccctcatggtctaatcacctcttaaatatcccacctgttaatactactacaatggcaattaaatttcaacatgggtctggaggggacaaacattcaaaccacggcaaaggtaaaggaaaagatggggggacaattttaccctttgaaaaatttctcaggcctgatcttgctgctgctgttgctgctgctaatggtgatggtgatgataacactttttttttttggtctcactttgggggatcctttaggtttagataaattgcataggaataagataaacaccagctatgcagtgggagacttatatcaaataagggaaatttccactgcagggaagctgtactggggcaattcattaggactgaaaagaagttaaacttagcacagcacaaaagcacattgaaaagttctctctaaaagagaagggggaatgttcagggtgcatttaagtcatgggatatggcaaggagccttctgttgatggtggggattaggtctcttgaaggaatgaataaattaaaaaacatgaaataataactagcaatttgtagttgtataagcatgcctatattacagtgggggatataaggaccttattttgttcccttctatattcccagaagttagaacagtgtctgatacatagtgggtgttccacaaatatttgtggaagaaaataaacaaatgaatacacataaaataatgtcaagtgatgacaaatgctatgaagaacataaagcagggtatggggatagagtgtgacaggaatgcaattttagttagggtgaccaagaatggcttttctctgcaggtgacatttgagcagagaccagaatgcagtgagggtgggagtcatgcaaataactagaggaccagccttgcgggcaaagggaacagcaagtgcaaatgtcctgagtttagaccatgatgggatctgaaattttgcatttctaacaagttgtctgatgatgtcagtgcagctggtccatggaccacattttgagtagtaagggtatagactagagtttgacccaggagtcagtactagtcaagttcagtactagtcaagtcagtactagtcaaggaactgagtagttctgtctgagaactgagtagtactgactagtcaagtcaggactagtcaaggaactgagaggtgaggtcattgcatgagaaaagaggaatgcaaaactgtatatgaaatatattcttatctatacaaaatgtatgcaaagagggacatgaacaatatcaacagtgttttcctcagtggggttgcacttcagattatttaaattctcttctttttagattattccaaagcttctgccatgtgtatttatcacttttatattcagaaaaaaacatttttggaaagttcaaaacagaaaatatgtgtttagttaagacacaaagttcaaaatgtattaaaatatttctaaattttaaaaaaatgttatggacacatgggaattggttggggtttctgatgaaaggcttcataaaggagatgactttgaatcaaatcttgacatctaagtaggcaaaactaagttagagttcttagcagcttctcttctctcttcctgttcttgggtggaagttggggtggggaagatatagggtatggatggtatattagtaatctattgctgtgtgacaaattatcccaaagctcagctacttaaaacaatagtttttgtggttcagaaatttgggagcagctttttggctcagggtctctcatgaggtttccatgaagatattagctagggcttccattatctgaaggcttgactggggctggaggatccacttccaagatagctcactcacatggctgttggcaggagaaggccttgctttcttgccatgtggatctctctacaggacaccttgggtctcctcatgatactacagctggcttcactcagagcgaatgaccagagtgagagagagggagagcaagagagagtgagagagagctagagagagcacgagagagagaagatccaacacctttgatgacctaatcctggagcacacacactgatgcttctgctttattctgttcattagaagcaagttgccaagtctagtccatactagggggaggtgtattcaagtttaccttttgaaaggggggagtatcaaaaggatttatggataatatcttaaaaccatcacaggtgggatggggtgtgatagttaaggccattttaattttcacttaaaagggactgtataaaattctagatactatggattactgtaggaaactgtcagtcatttagcatgcctggtgtttagcaggatggagggtagaaaggtatgatgaggaaaacatctagaacataatgcaagccacatatgtaatttaaaattttctagtagccacactaaaagatgttaaaaagaaaatacataattttaataatatgcttttagctctatatatgcaaatattttcatttcaatgcataaccaatataaaaattattaacgagatattttagactcttttttctttttactatctctttgaaatctggtgtgtgtttcatacttatagcatcctttggtttggactagcacaatttcaagtgctcaggagccacatgtggacagtgcaggtctagagaactaggccagaagctaagaataggtcaccaagaaccataatctgtatccattgtccaaacagagggcccagtaaagggtttaagctgaagggcaccatgatcagactcctggtttagaagtcactctcactgttctatgtgtagaacgtggagggttggagcaggcaagcccagacataagcacataatcaggagactttcagaacatcccatgtgagagcttgaatgaggttagttacactaaagatggagaggagccgatgtatgaaagatagaaaggaggtggtttgtagtaggtcccatgaccatttggatgtgagaaagtagatgtaataagatagagacacttagaatgattccaaggcttctggcttgggtcattgtgaggaaaattgtaagaaaaggaaatacaggagttaaaacatggttcactttgcggggataacaaggtaagattacagctatatatttggaaaagttttggttgagatagtatcggagatggaggagaagaaatctagtggacagtggatggataaatctggagcttaggggagacctaagctcctggtggaaccaccacaaggcttcgtaattttatgatattgctatgaaaatgccaggcactgtggaaagttccagttttctcttgttgtagaggcagaatcagctgaggaagaaagaccggagccacctcaggaagaggcctctgagctgtgggcaccagccagggaggtctgcttccctggcccagaatgaccggctatttagcagcgagggaggggccatgagagccacactgcggagttatcttagcggtaggagctccctgggcaggctgtgaaggccagagctcactgaggggagtaggaaggggaaggagtgtctggataaagcatcggacgttaaaaacgcctagattctgaggagtctgttgatggcatggactttggtctttttgttgaaaacctcttttgtaatatgttcaataagtggaattctttgctgccaaaaaatggggaggaggaagaggaaaaggagaaggaaggaaggaagagaaagaaagaagaaaagaattcctgccttgggatttgactatttcacatgttgtctccatctcagaaaatacgtatccttgtcagtgaagaaaaaaatgttttttgtatttttttttttttggtagagatcgagtttcaccatattgaccaggctgctctcgaactgaatgacttatatgagtacacatgtcatgtttaattgtgtttttctacttacatttcctattgtaaccttcagtgctcatctgggttgttttctgtttgtttgtttgcttgcttgtttttattctctaagaaacagtataatggctaagaccctatttgttgactaatcctatttctggaaggttagcagacctatgtgagatattgagacccttccctcttttacgcacctaaagtgaagtgtgtctgcccactgcctcttccttaatagggtgatgccttaatgcaagggttgcaaactaaagtgcctgccacagccaggtagataatacactggagtgatgtgagtgtacacagcaaatgagcttggccaaagggagcagctgttgtgaagctccagcagattcttgtgaagtggcaacatgggcgtacttgccagatattcttacttttgtgtgtgaaattttttggtgaagtttccccacttttaacttcacaaaatatcaattttatttaaacactgcagattaaacaaaatatgttggtgggttcttatcaacccacagtccaccagtctttgatatcaatctaaatctttatatatgtatgcatgtcatgtttcattgtgtttttctattacatttcctactgtaaccgtcaatgctcttctgggttgtgttttgttttcttacttgtttgtttttattctctaagaaaaaatacaatggctaaggccctatttgttggctaatcccacttctggaaggtgagcagacctatgtgaggtattgagacccttcccccttttaggcacctaaaacagcagaccatatggaaaatggcatattcccctggcagattcagggccacagtgtttgagagactatcggagatggaggagaagagtggagtgaccctggtgcaactggccacattttggtggtgactcctctaataagtgccaggttacttaaagtagatctcatatttaataataaatgaaatatcaaaatcattcatgagggtactagatagcatgcggaaaaaacagtcattatttccagtgctcaaagttaaacattaaaaaaaaaatcaaatgcaagaaggaagtaggtgagggagaaaataggaggaaaatgtatggaattcaatgggtttcatgtgcatttcccttggatgttattgagctctaggtcaggtttgtagaagagaagcgatgcttccccatcatgctccccagtcctccaccctccaccctatcctgtggggcagagttgctatagattgatgacactctaggacactggaccatgtttgccagtagaatggttgctgcccactaaaaggtcatgcataatgtccacacaaagacctgtacatgaggtttataacagctttattcataacagtcagactagaaataacctgaatattcatcaatgggtaaatgtataaacaaacagtagtaatctttacaatgggatactactcagcaataaaaagaacaagctactgacatacaccacaacatgggtgactcacaaaacactctgctgaatgagggaagtcaaaacccaaagcatttatgctatatgaatttatatgaaacttgagaaaaggcaaatttaatctataatgacaaaatagatctatggttttttgaggcttgggatggagggtatgtaacacaaaagggcatgaaggaattcaggcaaaagatgatggaaatgatctatatgttgattgtggtggtgtttccatgtctggttatagttttgaaactcatcaaacttaggcttaaaatgggtgcatattctttcatgtaaattatacctcagtagagttgatataaacaaaaaggtcacgtacaaagatgtattatctcctgtccctctttcatgtgtgctatagaagcagtctaaagacctaactctcttttcttctcctttcttcctccatgtggcctgaatggggagaaagccagggctctcttgcttaggatgtgcccagccaaaattttgctcttatcttgtctgatcaagcattttcatctatttggatttctgtcttcatttatggcagatgaggtgtggtgaaatgttgaagttgagtttgggcttatggggagaaaaggtgttccatctctgatcctccaggcttgctcaggtgtcccagcccagcttacaagggctgtgcactgtgggtaggggactgacttcagctgagaataggacacttgcttttcttttcttgaccaattttctgtagtatacagctccctcagggacatattggagagggagggctgaggtttacaaaatgatttggatattcctaagacccttgattaattctgtctaaacactgtaattatttctaagtcttccatagacatacttttaccaaaggcctcatcacctttacggaaacgtcatcctctagtctcagtaccactctggctggtcggatacttacttttcaaaatacagcttgagtcattgtcctgaatccttcctaccctccagtctcaaagcacatgtatctcttgttccatgatccaaaagaaggagaaggggcttaagtgtgatgcaagtctgggttcacatcttgacctgctgcttactgagtgggtgacttagagcaagtcacttatcctctctgagccccagaatatatatttttatatatatggtatagtatagtacagtatatatagtcaccaaggctcagaaattgatatatatatatttagtattttttaatttctaaaatagtgatgataattcctacttttcaggattgttgtatatattatataatatagttagtgtatacaatttgcacaacaaagatgcataatatattttagctattattattattagctgtagtggcagagacagcccctgcctctccttgcatgtaggtgtgtacatataacatggagacagtggaatgtaagagctgtgtgtcactcctggggtaaagattttagaaaaggacaggacttccctactgtctctttccatttctgttggctggaagcagaaaacaaagagcccctaggaaatggtgaagccacaagatctatggagcctggagtccttaaattactacctgggagacagctacctgtcacccaggaacacctgcaatgggctgttttataaggaagaaacaaacttattttgggttaggtccctaaaattctgggttttgtttattatagctgttagtgttaattgtcctggtaaatttagaaattggcactttgaagtggaggttaatgtaagaaaaacctaagatatgttgcatcgactcagcagttggatggtgggtggcacagacactgatatcaaaggctgggaagatggagacctgtggaagagatggcagagcatttggtaaatctgttgctggtgattatttaaaaggcatgcccagtgcctgacaagtctttatctccaggggagaggctggctattacttattgtattcagcaaggtataaccagacagatgtgctctgctaagaactcgtttgcatgagtgcagaaattaaacagtctagacagagtccagaaatctgatgtttcacaggattggaaaagcattattgttctcaacccatagaaggtatcactgaaaaaggctttgagcaacataggtccatttaaaaaatctcaatttaatagataccatgctagcatctacagactaggaaataagtagggactgttctctgccttcaaggagtttataacttagtagaaaagagaaaaatgtgtacaaataactgcagtggaagacagttaatgattgaaacatacattgctataaataatgcaagaatcacagcattctagggtagcccagaataggggctctcaaaaggactggggagcttggaccttggtttctcatcaaaccctgaaacccatgaatgaatgaataaacctcaattgtttcccaaactcattttcatcttcctgaaacactagagttcaaatttggtctctggggtagtagctgatcctctgggcattgaggagctccctcaggccagcccatgactttcctatcagtgttcttctctgcctttacaagtagttcagactgagacttgtatgggttccctactgagggcctcatttctgtaacagaagagggctctgacatccttatttttcttcaactgccctgagatgatgagatgccccagacctgaaagcaccgttgtgtttgctgagactgcttgtttttattgtctcttgtgttttaaatagtcattctttgggcaaagaatgagaacttgcagctccttattgtttcctggcatgaacctagtacctttttaacttgcttttattgcctctttggctgtgtggagcatttatctaaatatagactggtacaacactatgaacaggactggaataagataaaattttctttccgatcaattctgttacatcttcttgtgaacactaggtactgttcttttctcagagtggcaagagtaggcagcaaaaagagatgatattgagttgcaaagcttttctaagtggaagtcaatcactgccaggccttttaaagtcacgaggcccaggtactgagtgctctggacactggatctgcctatggccttaggcaaaccacataatcatggtcagcaacatacactgccccttggaggcagggtggtggagtggaaggggcacaggctttgacagaacccaattggatctaatgccctgccacttattttggggtgaccttgggtaagttccttattctcatttctaaaagggggcaatactaataaaatctatctcttagggctcttgtgaggattaaatgtgatgaatatatgtaacttactcagcacattttcaagaaatagcagctattatttttttgtaggtaggtactttgtggcattaatatatcaaatgcaaccatatctttaattttatttccaggaggaataatccatatatatttattaaagatattaacaaaaagcagctctcaccttcttgtgaatcagatccaaatcccttaacgtcttcattgattcaggtgagaggatttcattactgcaggagtgcactatagtaattagagcagagtctctggtctcagggttcaaaacttggtatgtgatattgagccaattgcttaagttcactgggccacaatccttgatctgcgacttcaaattgaaactatttataggctttacttgcttaatataaatctttctattttgggtgcagaaatattgggtttgattctaagggaccaccccagaccttggtgggtgttctgtaatatctgtcatatgcaccctgttgcctttattaattctgcattctgagttgcaaaactcatctggtttccagagatttggggatctatgatataccctcatagggtcgctgagctatagtcacttcatgccccccctccgaatcttattagctattattatcatcttggaatggttttttgatgtggcggttattctcccattttacatatgaggaaaataagacccagaaaagttaaatcaccacatagctcatatgtgatatggtcagaatacaagcaaggcatttctgacatcagatcccatgcattctgttgaattcattctgttgaattcccaggaccctgtacatgccctggcagggccagcctcaattaagattccacctggagagattagagtctacagttaagaaaacacaatcaactgggactgtcctcttcaggcatctcacaagcagaccagttctggtgtgggctcctcaccctcctttagcggctgtgcagaggatggaagggtgggtcccggaaggctcccacagggtctgccaaccacatggcttgagaagggagctggcctgcacaccgtcctttgctgatttctcctaagggatgtgagcagagcattgacagggtctgtgatacaccctttagcataattctgtgccatagcaggaacagtctattttgtgaaaagctcaggatgaaggctgtctctctcactactgttttgatgttcactgacaaacccacctaccatcaaatgattcccaccacactgcctgccatggtgcctgaaatttgtgctataagccatcagtctccagagactaccaataaaatgtctggacagtagggtaggggatgagggaaggataagaggtgggtcaccatcactgaagagtctgggtgaactggggtactagctcccaggctggaggtggcctctgacagacatggcctctgaggagtgtagcaccaaacacggacccaaaagcacccctcagaaaaggaaagggatgaaggggtcatttgcctgttttacacatttatccagatcaggacctggaagggaagacctccttcactgttgctgagactgcgagctcttggaagacggtgactgtctttttgtctctctctctccccagaactcagcagagtaacccatgacttgtttgactgaacagagtgcccatgggttcagtgctctgctctagtctccacctgccagtttccttctgacactgctatgagcaacccccatatttatgcagatgagtgctccataactccacttctcttcaataagaagaaagagcaacaccgctaacaacttattgttggtggtgagactttgggcaaattaatgagctctctgtttattcattgataaaatgtagagaatgcccctggcttcccacacttgtggtgaggactcagtaaggttcttgtggactgattgtgtccctctctaaattccccaattcacacactgaagctctaatctccagtgtgattgtttttggagttaggccctatatggaggtaatcaaattaacagaggtcatgagagtggggccttaatccaacaggactaatattcttataaaatggggaagaaacaggataccagagatctctatctctctcccccttctctctctctctctctctctctctctctctctctctgtgtctctctctctttcccagttgtacacagaagaaagcccatatgaggacacagcaagaaggtggctgtcttcaagccaagaagagaggcctcatcagagatggaatgttcctgcacttcggtctggatttctagtgtccagaactgtgagaaaataaatttctgttgtttaagccacctggtctgtggtattttgttatgacaggcctagcaaactaacgtaaaatgctttggtacagcagcaggcacaaggtagagattcattaattgtaataataccatataaataattattgataatggcactatcaataattgccattgttattgcttctaataaaacacccacccttctgggggagagaggaagaattttggaaactccagtaacaaacagtctgcaaatccactttgagcttctgatgagaaattgagggcactcgaaagaaataaatcacattcactgaaattttctgatcctatttctgtacatatgtcatgataatttgtgtcaagtaatatgacagcatctttcctctgagggacttaatgtgcttatgccaactacttatccatcaggcaaatgtttacattctgaggatgaactaagggaatgtcttagatagctgggagcctgaggctaggactgtgcactgaggggcactaataaaatcagataatcaaatttcttccaccttctctgtggtttaggctgtgcagtctggaagcaggccaggtggttggttttaggaatcacagggttgagcttacagtacaagacagattttacttcaagtctaagttagccttgactaatgattgttccatcacttttagatgtccagctaactcacttacaggcacatcaggaagagggacctctcaagactgttttctcaccaaaactctgaggttctggtttcataactgtattagtccattttcacgctgctgataaagacatagccaagactggacaatttacaaaagaaagaggtttaattggacttaccgttccacatggctggggaagcctcacaatcatggtggaaggcaaggaggagcaagtcacatcttatatggatggcagcaggcaaaaagtgagagagtttgtgcaggaaaactcccccttataataaccatcagctctcgtgagactatcatgataacagcacgagaaagacctgcccccatgattcagttacctcccactaggtccctcccacaacacgtgggaattcaagatgagatttgggtggggacacagccaaaccatattaataacattcacattctttctggacacccaatcaagccctccacatggacctgtgggctgcagactcttgcagacagatcagggaggagggcagaaaaggcctctcagcaactgcagttctttgtgcctgcatttccaattcagatgaatgcattagaaatggtcctaaaatgtatttgaaaaaaacagaaccatctaagatcattggtcagagctccaaatggtttataaagagggggaacaatatgctgacttctgaaaaatgggaagggggttacattggcttgattgaaaccagttgaaggaggttttttgtgtttttcccccaagtttttcttgactaatgattgttcaggtctttaaatcagtgttgtccaactgtccccaaagactacataaggcacagttgaaatctgtattgtcccttgctgttactgcctctccgctgcccttaactcacaggatgaggtattataggttatagaatcccttgctttttattcctttatcacagatggatgaagtgctcaaatctgaatcattaaaccgacttcttttgtacctctcagactgttcactgatttaacgttgttttaatgtattcattagattcaaacatttactgaacactcaccatgtgccaggccctcttaaaggcacgggagatgctaaggcaaatgagacacagatcctgcctccaagggctccagtgtagtggaagggcagagaaatagttactaacatatggcaatggaggagggcaaggaatggagaaaggctttaaagggtgcaccagggacctggaggtgaccttccaggagggaagaaaaagacaggagcattaggagggagaaaatttaattgggaaaaagaagcagccagcaggttgttttgagagaatcaatcttttgctgtatggctgaaggcagctggtgatgttggtattgatgaattgcatgacataattatttggcacagaaagaaaaaaagaagggaagaaaggaaagaaagaaggggagggagggaggaagtcaccttctatacttgagaaaatatcatcaatgaatccatctgcttctgttccataattccaaccccttctctcaggaggagctgagagattggtctattagaggttctctttggcttccataaaatctaacaaaaataccccaccaagtttattgctctccttgtttctcggaagactggagaatggacttgccttggaccaaaccctcgagtgcactgacttaggaaaggcaatggaaatagatgtcttttgttacaagggtgatattaagattgataaaattaaatatatattattatctggtttgaacatatagttaattagcatgtagctttgaatttgttatgttggtggccaaacctgttagaaacaggttggaatgctattctaattgcctgattctaaaagtaggtttccagagatgggtcctagcatatagctacacaaatgtagtactgcccacaaggaaaatggaggtgaggggcaggagaaagatgtagtagctactgaattaaagctcagtttaaggactacttttcaaatgaattgggggccagtagtaaagtgcgtatggtggccaactgaaccagaggaaggggaacggggggcaagaattcttcctgagagcacctgtgcccttccagagctgtgttcttctgaattttctcctctcctttcagtaattaattgggcttaattaataggatttggttgattttatctgcaaatctcttttgtacatatctgaagacctaaacagtggtggtaaaaaaattgactcaaactttttcagtccagagaccagatgactgaaatcatgtcttactcatctttgcaacctgagcacccagagtagatactccatatgttcattatgtaaattaataagcttcttcactgtacctcattttaccctagaaaacctatttcttcaacaaatgtttactaattatctacttttgccgggtgctgagtcaggcactagggatatgagtgggcaagagagaaaagacccttcctcctggagtttgctgcccataaggaaagacaataattaaattaagcattacaagaaattatgatatcatcacaatatggcaagtgaatgctaatagagccaataccaaggggccacatttgttggagaggtggctcaagggacacctccttgtgcaagtgactcaaattaagttagcactctcagctctagtggtgctgataatctatctggagaaaaaaagaatatcatgcatgcaaaagtaagaaagagtacagtgtaggacactctaggttcagtgttagattatggattatagagggtagaaaggggtgatatcaaaaagggtttatgtaggctcagaagtttgcaggaggaaggagcacttggactgtccttggaagatgggtagaagagtggaatagaacaagggaggaaagacagaaataagaatcccacacaacgggggaagtgaagcctcaatgggtagtggcaggagacaggctgaaatcatgcaagacctggtaagtcagtggaaatgaaagtgtaagtgcagttctattatcattattattcttaataatgtgataaaagctactgtacaccaagtcctagtctgggttaggtgctgggtagaaaatgttaaacaaaaggtctacaattcattcttttttgctaccaaagggaagtccatgggaaagaaggaaggaaggtaacttaatcaaatcttcacatgaacatactaatgacaggcctccagataaacacattaatgatatttgctagtgcagggtccttatctatagaattctttttaaaggaggtacctgatctgcctgggttgctcatttgtaacaaatctgaatctatgcctgtattgggtatgggttctgagaaaaggtcaggtcaattatataactatctaagtataatatgaagatatttattgatggttcttttctgtgtaggtgatgtgccacatacatggcttgaagatcttctgtgttaatctggggaagaatatcttgatgtggcatggaaggactcaggacactgcatgggtcctaagccactccctgcttcatttgtaattgcttgttttattgaaattattagcaaagtgtgatactgggtaagatctctattatgtgaatccactttgataatctgatctttttgtgttatgttaggtactttacttaatatattgtctcacatcaaccctacaaggtaagtgcccagagaaatgagttaatgtgtctaatatcacagtgaggaagcagcagactcctaatttaaacccaggtcaaactctgtgctcttcccgctactccatatcacccactgatatggtttgcctctgtgtccccacccaaatctcattttgagttgtaattcccagtgttggaggagtgaactgatgggaggtgattggatcatgggggcagatttcccccttgctgttctcatgacagtgagtgagttcccacaagatctgatggggtttaaaagtgtgtgtgtggcacttccccctttgctgtctctctctctctccttctcctccatgttaagatctgcttgcttcctcttagccttctgccatgattgtaagtttcctgaggcctcccagtcatgcttcctgttaaaactgcagaactgagtctgttaaacctcttttcttcataaattacccagtttcaggtagttctagagcagtgtgagaatgagctaatacacccactttaaaaaacatgtataaaacagaatagagccttgggccccaggaaggccctaaggaccatcaagacccacacaagccctttgaggaccacttaccgaaagaacagctttaatgagaaaaggctttctggtataaaacttggccgggtgtggtggcttatgcctgtaatcccagcactgtgggaggccgagatgggcagatcacctgaggtcaggatttcgagaacaccctggacaacacggtgaaaccaagtctccacaaaaaattacaaaaattagctgggtgtggtggtgcgtgcctgtagttctagctacttgggagactgaggcaggagaatcacttgaaccctggaggcagaggttgcagtgagtagagatcacaccactgcactccagcctgggtgacagagcgagacactgtctcaaaaacaaaatcaaaaacttgatttatgtgagacccaaaaggtagttcttttgtcacattttccatggaaattcattttcaccagaggcaaatgcttatatctccactgggagtctgcaactcatagagtttgtgtactatcaggggaataataatacattctttgaatgcagagagaatagccaaaagactgcacttgatcagaatcagatgatatgaattgaagtttctaattctatttttagccctaaagcaagctgagccttgtgggaaggtttaccaatccctgatgggtgggatcagccatatttcacaggggcttccattttataaggatatttgtatgcattcattcatggctctgagtttttttacatggtcctttgcaaagcattaagatcagcttcttgtcagggaacttgaggatccatgaaaaaagtaaataaataaaaaacaaaaactagtatgtgagcatgaggaaggaggtaggtcatgctaaggaatacatctcttcttttctgcaaatataagtggtttaattctagttgccttgggttaaggagtcccattcctcggggacagctgcctagcacagtgccttagttcctgtttaaagtgccacaggacatgtatagctgagatgtgacagattgcccctgcctggacctctctctcagggctgccagcatctttaatggacagatggagctgtcttccctttcttggctgtggctgtctgatcaactttggagatagcagtcaaacttctagttaataaaagtgcttaataagtattcaaattgtaatatccccagaaagatggttaccttggtagaaaaaccttctgataaaagagtaccagaatctctatttcaagaatcaaagtggctgggcatggtggctcacgcctgtaatcctaggattttgggaggctgaggcgggtggaccacatggtcaagagatcgagaccattctggctaacatggtgaaaccccatctctactaaaaatacaaaaattagctgtgagtggtagcacacacctgtagtcccagctactcgggaggctgaggcaggagaatcactcaaactcaggaggcagaggttgcagtgagctgagatcgcgccactgcactccagcctggctatagagcaagactccatttcaaacaaacaaacataaaaagaaagcagacacacatagacttgatatctatccctaccaatagcttgagggacactttaacttgtgtctttacaagaaaagtaaaaagcttagctgtggattacgaaacctatagagctgagttgagaaaaacaaggttctggtgtagaccttgggtttctctttggaccgcctgatccttttcttagcctatgctgttggtatccttctccagtctccaccggatagtgcttgcttgcttctgggcccttatcatcttcagagtcctccatctttgtttatactcttacccaatattccctttatatacaacctctctccattacaaaggagaatctgattctctccaatacatggcaaaatactggctatttacttcattactatcagcttatttcctgatgatcctgtgtcttctcaaacccagtgctagatgttcttttttggttttgcaccctgctctttgtattctttcttttgcctatcatacagtgaagaaaaagggaagtaaacacctttgtcttttggaggcaagaataaactccagctgaatatagactcctggcaatgcatcacaaagctatttctgtactaccatagtctgtctactgtaatgatcttggctacaagtaaacacaatacccaactaaaagtggctgaaacaatgaggggtctattttctgagggtggttaatacagcacaaaagttgctacaattcttgatgaattgatctgttctcctttagtttctcaccgtgggtgaagatggccgcctaagccatctttggccgaacattatgtcttcacacaactacatccaaaggaagacagggaaagagtccatcccattagagtgctctttctcttttttaaaaaatagggaggaaaagttttctaagaatataccccctagcagattttttcttaggtaccacgggccaggagagggccctgtgcctgtgctctaccttcagtgaagctgggaaaagtgatgaagttgggaaaagtgagtgattggcttctatggtggaagtggactttatgtgtaaagaaggaagaggagaaaagctgtggggtagtcaaccacagccattgaataccttcctgaagtgcagcagtccaggaatagattatatttaatcatttcacattgccatcacatggaccacacctacagttaatatggagtcgtagaagaaaaagagacctcaagagttcacctctactcctctgtggatagatggttggctaccacaagctttcttttttaattgtaaaatatacataacaaaatgtaaaattttatccatttttatgtgtacagttcagtggcattgcatacatttatattgttgtgaaaccatcaccttcattcatcttcagaactagtttctcttcccaaaattaaactctgtatccattaaagaatggatacagatcccactgtcctctcctcccagcccctggcaaccaccagggctactttcagtctctgtgaatttgactgctctagatatctcatataagtacaatcatatactatctgttcatctagcttaatttaaagatatttggtcacccctcttaaagtgcccttcatcttcctccaccttctcttcctcctctcctcttctcaaaatcctttccatccttcaatgctcaacaccaagattttcagttcctccagcccatgaggctctctccctattctggactcagagtgttctgtgtacttgactttcccactttcttgaccttatgtacactgtcttatgccgtatcttgagttattatcttttacttttaacttttattttaggttcagaggtacatgtgaaggtttattacataggtaaactcatggcatgggggtttgttgtatagattatttcatcacccaggtattaagcccagtaccaaatagttatcttttctgctccactccctcctccccctctccaccttcaagtagaccccagtgtctgttgtttccttatttgtgttcataacttctcatcatttagcttccacttgtaagtgagaacatgtggtattggtgactttctagtcctgcattagtttgctaaggataatagcctccggttctatccatgttcccgcaaaagacatgatctcattattttttttatggctgcatagtattccatggtgtatatgttccacattttcattatacagtctgtcattgaagggcatttaggtggattccatttagatctttgctatcgtgaataatgctgcaatgaacattcgcgtgcatatgtctttatggtagaatgatttatattcctctgggtatatacccagtaatgggattgctagaaaatggtagttctgcttttagctctttgaggaatcaccatactgccttctacaatggttgaactgatttacacttccaccaacagtgtataagtgttccattttctccgcaatcttgcctgcatctgttatttgttgactttttagtaataaccattctgactggtgtaagatagtatctcattgtgtttttgatttgcatttctttaatgatcagtgatattgagcttttttcatatgcttgttggttgcatgtatgtcttattttgaaaagtgtctgttcatgttctttgcccactttttaatggggttgtttgtttttctcttgtaaatttaagttatagatgctggatgttagacctttatcagatgcatagtttgcaaatattttctctcattctgtaggttgtgtgtttactctgttgatagtttcttttggtgtgccgaagctcttaagtttaattagatcccacttgtcaatttttgcttttgttgtgattgctttctgtgtctttgtcataaaatgtttgcccaatcctgtgttcaagatggtattgcctaggttgtattccagtgtttttatagttttgggttttacatttaaatatttatttcatcttgagttaatttttgtatatgatgtaaggaagaggtccagcttcagtcttgtgcgtatggctagctagttatcccagcaccacttactgaatagggagtcttttctccattgcttgctcttgtcagctttgttgaagatcagatggtcataggtgtgcagccttttttctgccctcactattctattccattagtctatgctcctgtttttgtatgagtaccatgctgttttggttactgcagtcctatagcaatagtttgaagtcaggtaatgtgatgcctccagctttgttctttttgtttaggattgccttgggtattagggctcttttttggttccatatgaattttaaaatagttttttctagttctgtgaagaatgtcattggcagattgatagaaatagtattgaatctgtacattgcttcgggcagtatggccattttaatgatattgattcttcccatccatgagcatgggatattattccatttgtttgtgtcttctctgatttcttggaacaatgttttataattctcattgtagagatcttttaccttcctggttagctgtatttctaggtattttattctttttgtggcaattgtgaatgggattgcctttctgatttggctcttgtcttggctattgttggtgtatagaaatgccagtgatttttgtacactgactttgtatcctgaaactttactgaagttgtttgtcagctgaaggagattttaggctgagactgtggggtttctagatacagaatcatgtcatctgcagagatagtttggcttcctctcctcttatttagataccctttatttctttctccttcctgattgctctggccagaacttctaataccatgttaaatgggagcagtgagagatggcatccttttcttgtgctagtttttaagggtgaatgcttccagcttttgcctattgagtataatattgattgtgggtttgtcatagatggctcttattattttgaggcatgtttcttcaatacctagcttatagagagtttttaacacgagagggtgttgaattttatcaaaaaccttttcggcatctgttgagataatcatgtggttttgtctttagttctactgtttatgtgatgaatcacacttattgatttgtgtatgtcgaaccaacttcacatccctgggatgaagccaacttgattagcttttttttgatgggctgctggattggaccaaatggatcttatagacctctacagaactctccaccccaaaacaacagaatatatacattcttataatcaccaaatagcacatactccaaaattgaccacataattggacataaaaaatcctcagcatatgcaaaaaagaaaaaactgaaaccataccaaaagcactcttagaccacagtgcaataaaaatagaagtcaagatgaaggaaatcgctcaaatatgtgcaatgacatggaaattaagcaacatgctcctgaatgacttttggataaataatgaaactaaggcagaagtcaagttctttgaaattaatgagaacaaagatataacataccggtatctccaggacacacctaaagcagtgttaagagggaaattcatagcaataaatgccacatcaaaagattagaaatatctcaaattagcaacctaataatcacaactgaaagaactagagaagcaagaacaaatcaatcccagagctagcagaagacaagaaatcaccaaaatcggagctgaactgaaggaaattgagacaccaaaagccatttaaaagatcaatgaatccatgagttgttttttggaaaaaacattaatagtataaataggccactagctagactaattaagaagaaaaaggagaagatccaaataaacacaattaaaggtgacaaaggcaatgttaccgctgaccccgcagaagtaaaaatgaccatcagaaactactacaaacacctctgtgcacataaactagaaaagctagaagaggtaaataaattcctggacacatacaccctcccaagattaaaccaagaagaaattgattgtctgaacagaccaataatgagctctgaaattgaatcagtaataaataacctaccaacaacaacaaaagcccaggacctgatgatttcacagccaaattctaccagatgtacaaagaagagctggtaccattcttacagaaattattccaaaaaattgaggagcagggactccttcctaactcattctgaggccagcatcatccggataccaaaacttggcagagatacaacaaaaaagaaaccttcaggccgatatccttgatgaacattgatgcaaaaatcctcaacaaaattcttacaaaccaaatccaacagcacatcaaaggagttattgtattacctatcctttgtgagtacgtcttatctttccaactagattgggacctcttggagagcatagactatatgcatcttacttttctttctgtcctccaaaacccaagccttctacacaacggtcactcagtaaataggtgtcaggttccattctttctttaggaaatctgcataaattacctttataacgaagatgttttgtcttaagtatgatcatgctctttggggtcaaaacttaagtcattttgtttcttctttgatcttccctaagatggagaacaaatgttcagtgtcctccttaaacctgtaaatatactagaggtaggttaatgtgtcactttagctttcagttttctggattaagccaagataatggggcagaaccattatacttacacaacaccttttcctgagaaattcttaatacttcctttacattaagatcaggtttttccatggtcacaagtcagcataagtttgagaatccagggaagattatctcttctgtagaaaaagtcttgagcctctggcaagcttttattttttacaaagactcacttggaggctgcttaatatctactgaaaccctgatgactgacatacacacatacccaatgcacactctatccaaggattgtaattttgtatatttaaaattttaaatttaacaaggggtagatgtggcttagtctttcagtattgctgattaagtgactaaagattttagcaactaggaatttgtaatgatgaaatattgttctgttaatactagcaaatttaactaaagcaattctaaggaatggtgattatggatatattctaacccactttacccttttcaaaatgtagtgaaaggcatgaaactcaaactgctagggagggcacgaagaagttggggctgcaggctgtatgcttttgtaaacacgtccagctccctgctctgatgatgtgtctgcagggtcatttggaggagttgatatgagggagcagatgaatcttctcacttaaaatatcctgtaacgtcaagaaaatctatttgaaccccagaaagtttataagctagttggatgtgttaattaatattggcttgttgaactggcttgttgaggggtgtcaggaacccttctttccttatgaagaaccatagaaacaacacaatggggccaggcatggtggctcacatctgtaatcccagcactttgggaggccgaggcgggtggatcacctttggtcaggagttcgagaccagtctggccaacatggtgaaaacccatctctactaaaaatacaaaaaaattagctaggcgtggtggtgagtgcctgtaatcccagctacttgggagactgaggcaggagaatcactcgaaccccgggaggtggaggttgcagtgagccgagatcgcgccattgcactccagcctgggcaacaaaagagaaactccatctcaaaaaaaaaaaaaaaaaaaaaaagaaaggaaaaaagaaataacacattggttgggtgaatggaggattacacccaaggcacctgggagggaaactctgtttatttcttgagatttccctttggtttgattgtgtttttaaaggattgggaaaaattaagaaatattaaacctgcttcagattggtttatcaaacactcacatagtaatataataattgtaaggacaataatttctagtttgtataaaatagtttttattggattcctaatgtccaagttcggaggggctggtaagcattctggtaggaaagagtcatttcatcaattagaagaaagagcgtcttgggacatatggcatttggaagtgaagtatttgatcctagagttttggctggccataaaggaaagcttgtataagcaaaaaagaaaatatgttttcttggtgagaaaacagagtagaagggacatttgcagtaggaaataaggatggtaagaagaggccaggcgcagtggctcacgcctataatcccagcactttgggaggccgaggctggcagatcacctgaggtcgggagtttgagaccagcctgaccaacatggagaaactccatctgtactaaaaatacaaaattagccggatgtggtggcgcatgcctgtaatctcagctactcgggaggctcaggcaggagaagcacttgaacccgggaggcggagattgcagtgagctgagatcgtgccattgcactccagcctgggcaacaaaagcaaaactccgtctcaaaaaaaaaaaaaaaggtaagaagaaaaataacattttatctttgataagagcaagtagagcgttatggtgtttttattctattttgaagttctagaaccaatgcagcctcccgagggaactgcaaatgggccaggcactttcataatatttacactcatttgttcatccatttgctgtccatttatcattcatccaaaatcatttattagggacctcttctatttcatgcactggggctatgatgataaatgaattcttcacttggaggaactacactctactggagggaggcctacataaatggggtttagggtaaacctgacaggtgttctactagatctaataacagatttctgtggacatacagagaaaaggtcgcccctctgggttgctggaaaagattcacagaaagtgatatttgaagtgagttttgaaggataagtgcattcatcaggttaagccgttgagaaaggaaagcccactaggggacaggcctgtgcaaaagcactgaagtgtgactgggtatgcagagaacagggaaggtggtgaggtggtgggtggaggaccgggtacagaaccgtgggagaggtgatggggaagagtgaaactgaaactgtagggcaccaggccatcgccctccatgcatccaaactcaagtgccagaaggcacaacctcaacccatgggtggcagccctactgccaacacagatacacacacacacacacacacagacaccacacaccccaccacacacacataccatgcacccccccattccaccccacaacccaccacacacagagatacacacaccccatttcacaccccaccacttacacatcccgccaccaaacacataccctccaccacatacacacatctcacgcaccctactccataccccacccccgacacaaccccacacaccagcacaccccttcacaccaccacactccccacaccactgcacacacacaccctaccacatacaccacataccccccacacacctcccacatatacctcaccacatatattctacatctacctcacacacactctctccccaccacacataccccaccccccacacaccccacacataccaccacatacccctccacacatcccaccacacacccctcaaatcctgccatacacacacaccccgtcacacaccccaccacatacacacacacagagacacaccctaccaccacaccccgaacaatccaccacgtaccccacacctcacacctgaccacacacaatctcccctcacacacacctcacctcatcacacacacacacaccccccatacaccccccaccccacatacagaaacagttgttttggctgaccccctcctgagaaagcagagttgactctgggctgcatcccacagagcacagcccagggtcctgggaacactgtaagggacgttggtaagggggatccagtactggtttttaaacatgggagtgctacacacatcgtctgtggactgtgagtacattgtgtcaggactaggtctaactcatactctgttccttcctctgtgcctagcaccatgctggcatatagaaggtcctccttaaatacttgctgcatgaataaatgaactaaacaaataaggcaatgtggagaatggactagcgtggaaggaaactactgtcagttcagaggctctcacaagaatctaggtgagcgatcacggtgggattggagaggaagaaccagaatgtagaccagcactctccaacagaactttccacatgatggaaatgttctattctgcactgtccgttatgcaaaccactagccacacatggctcttgagcacttgaaatgtagctggtaaggctgagggactgaacttttaattactttaaattttttttctttttttttttttttttttttttttttgagacggagtctcgctctgtcgcccaggctggagtgcagtggcgcgatctcggctcactgcaagctccgcctcccgggttcacgccattctcctgcctcagcctcccgagtagccgggactacaggcgcccgccactgcgcccggctaattttttgtatttttagtagagacggggtttcaccgtgttggccaggacctcgtgattcacctgccttggcctcccaaagtgctgggattataagcgtgagccacagtgcccggcctaattactttaaatttaaatagccacatgtgactattggctaccacattgaacagcacagttctagagatttttgtggcagaatcaaacaaacttgtaacaaactggatttattcattaatttaatcaataaatatttattgattgtttactttgttctgcagtgaaaacgtgtgtggcaatagggtgtgacacgccagggtgtttagactttgtgaggtgcttggtaaaggagacccaacaccagtgtttaagcatgagcagagcaggtgatgtaatttccctctagagctgacattcttctgggggaaggagggaaggaaggaaggaaggaaggaaggaaggaaggaaggaaggaggggaggggaggggagggagggagggagggaggaaaggaaggaagggaagaaagggagggaagggaagaaagggaaggaagggaaggaaggaagaaagaaagagagaaaagaaagttctatgaagagaatgaaaacaagtgatataatgagtggaggagagtggacaagctattttagcaggattggtcaaggaaatcctctctgaaaggtgacaagttgagagttgaataatgcagaagttatgtggattaagaaaaacaaaaacaaacaaaacctcaaaacaagaactaaaataatcattgatgagtaaaagcaataaaattcatcctgaagacacctggtgcaagaagggacctattccatctgcaagtgaaactcactcacttcctttctccagaaagaaaactgaagcctggagaggtaaagagacttacctaaggccagttggcaaaagactcttaacctcctgacctccaactccactccctactgggtaagtgtctcttagcatcttgaatttcatttttcttattagtaaaatgagttattgatagaaatgaaaaatgtaacatagataaggtgctaaaaatagtagctattttcatttttggattttttctaatcgttgtatagtgtgcctctcaaataattaactatgttattattttaataatatagaagtattaatataatatataattatgtataattaatataatagagaaatttagtaattggataatacagaaagcctaagagaggcaatgagcttcaagtcctgactttttcttagtcttcattgtctggggtaaatcttagcattgggcctatgcaatcaacctccagtaccacctgccattcacctggaggcagctgctggagctcttcgaatgctgtcagagaaggaataaccatcccccacactgctggcctgacaacccccaccttattaagtggtggtatgtatcacagtcctaggatacttctgaggagaggaatatgaggctgtggttttctcaacagacacagctgtcatcaagctctttatggaaagctgctgtagacaggggctgaaaagaagatgaaggctttaacaggttgtgaaattgcagtgataaaaagagagcactaaaagcatatggcactggaaagggttttctgcatccaaattgagaatcagaccttcatttgtttactcttcattttactcccaccacacctctgctgtttgagctggtatttttgtaaatattcagataggacaaacaaggtgataaacgaggtcatggctttgccagagggagagacagtgctggaatataaatgttgggtctccttgacttctcaatgtcatttgccttttctagccacacccttgggtctcaacccagggtcttggactatgagcccatgctctagccattctgccgtgttgcatctgagtttggtgtctttggagccactggttcaataatccttagctgatagtttgatctgactattgtatgatcaccagagtaacactgaaaatgaggcattgaacacctatgggttgcatgtgagtgacctgagagccatgtctgaggcttactgcccacagctcatgacctcactgttgcaacctgacctggtcagggccaggaccctctccccaggctggagcatcatctcctcccatcattcctgaatatcacaaagacccattaggataatgcctctgtgcctttcagccctcccatgctcagcaatgcaccttccagtgaacatagtggcatacaaataactgcagagatagaaggatccaagtccttggcccaaatctagcaggtctagataccagaccttgctctaccacttagttcactgtatgagcttgggcgaattactttatttatctagacccctatttcttcaaatgtgaatgtggaatattatctacctcatagaggtccaagaatcaaaaaaatttattgtatatgaaaatgctttgaaaaatagaaagcaccaatcaagtaagtacaggtattattcagtagtctacatacactacaaggatttttttgtagaaaaaaataaaacttaataaatattaaattatattaatatcactttcatccatctatccattcatccatccatccatccattcattcagtaaagttgtattagacaaccagtctggggcaggcactgtattggtgctaggtagatacatgattgtgaacagcaaatatattattccttgggttaattagggttctccagaaaaaaaaactaaagggaaatatatatctcaaaaagagatttattacaagtaattagctcatgtgattatgaaggtgggaaaatcctgagatatgtgggatgagtcaacaagttggagacccaggagaactgatggtttagttctagtctgagcttggtgatctaaaaaccaggattgatggtgtagctgaaggccagcaagctcaagatccaggaagtgccaatgtttcagtttgagtctgaaggcaagaataaaagccagtgacccagttcaaaggcagtcaggcaggaagaattctctcttacctgggggagtcagccttttgttctatgcaggcctgcacttggttagatgaggactgtcacattagggagtgcactctactttactcagtctgccaatctgaatgttaatctcatctaaaacaccctcacagaaacacccagagtaagtttcaccaaatatttgggcaccacttggcccaatcaagttggcagataaaagtaatcatcaccttcctaacagagcttactgtctatttgggagagaaggacatagtaaagcaataatcatgcaaacaaatttataatgagaaagtgtgctgagtgctatgaagaaaaaagtacaggctcccaggagtgatgataacactggaggcatataaacatgaaactttagttgacttgactgatgtgggacaaggggagtgcataggggaattccttcagataggacagcactcagcaaatgaaatatccaaaaggtcagtgtggctggaacacaggaaagaagagggattatgttgccaatatgagcagacagagggaaggtcacagacaactcttagggttgtctatgagaaggctgaaaagtttgaggctggtgaaggaagtatgaaatagaagttgccagactgagagaatgaccttattcattgacaatgtaatggaataatatggttgtgtggtctgtttaagttgagctagaataaattcataaacattgtaatctctcaggttgcatgattttttttttttctgagacggagtctcgctctgtcacccaggctggagtgcagtggtgtgatctcagatcactgcaagctctgcctcccgggttcatgtcattctcctgcctcagcctcctgagtagctgggactacaggcacccgccatcatgcccggcttatttttgtatttttagtagagacggggtttcaccatgttagccaggatggtctcgatctcctgacctcgtgatccgcctgcctcagcctcccaaagtgctgggattacaggcgtgagccaccacgcttggccaggttgcatgatttttatagccttttgtttgacaatttgatgcagacatataaattaattttaacattgattgttgtgactttccactttatactattttgcatgaatatttccacatgtttgtttttcataattttgttatttttaatagctgtgtagtattccatcatggtttccatcatgttatttctggcccttctacacactcctgtggtttttagctctgtacactgtttttctgaaaaatagttctgctgagaatatcttttggaacagtgttgtttcttatgagctatttttttaggttgcatcccctcatgggttgcttctctgcatgtcacagcttctctgtagcacacagcgtctgtggtgtggtgctttgtttgtcttgtctggatgtgagaaattcccatggcaccagctgctgctgcggagttggctggggaggagtagtgacaggcaggaagaggatgaccctcattaggagttcagagaatgcaggttattgtgttactgcactgtatcctccaggatgtggcctctgtgagtggtttgttctgcactgagaacctccatggcccttaacctaacagggagctctctgcctttgccaccttccccaagggcctattaagttcctggtaagtgttgttctatgtagaacaaagaatatgtaaggtagtggcaataatgtaaattattgttcataagcctctggactgtaattaaattaaagttatgattatatcatctaaggcaaatggttccctaggtgccatcatttttgtttattcctttatgtagtatattcattcttaatttctacatattattgagaaattagtaggggaccagctcatcaagccaagcaggtatcagggaaactcatataacatcccttctttgcctaatcatagtgcacccactcatttgacccagtgtatctcttaagcatttagcatgtttaacactggtcaaaaagttaatggaacaaaacagagtaactgaactcatttgagttgggacaaggataaagtttaaattcggttttctgggggaaaaaattctattacttttgtcaaacataatatcatacagtagtaatttagtttaatgttcttggcaattggaaaataagttccaaaggattcctctattttatcaaagcaaagaaagacaagtacggaacataataaccattttgtcctcttacccacaaagggtatgtaggagaggaggcaggctcctgctagaatcttagtcattttggtcagaaacatcatcactgatggcagtgatatctgtagttaataacagcaatgatagtaacacataaaaaccatggagtgttaactgtatgctaggcacagtgctttatattgcatcattacctccctcccatgaaatgggttttctcaaaatcacaaagctggtgagtgatggactcaagattcaaacagtagacccaaagccggtgctcctaatctctctctaccctggtaatacagtggttggaagcagtggggtggcaggaaaaacccacaccaagggatctcagcattgcattgcgaagcacatgccatgttagctttgaatctgttatgtaaattgaattaagtcacattatgattattattattttgagacagggtcttgctctgtcgcccagctggagtacagtgacgcaatctcagctcactgcaacctccatctcctgaattcaaggaattctcctgcctcagcctcctgagtagctgggattacaggcatgcacaaccgcacccggctaatttttgtatttttagtagagacggggtttcaccatgttggccaggctggtcttgaactcctgacctcaggtgatccacctgcctcagcatccccaagtgctgggattacaggcgtgagccactgcgcccagcccacataaacttcctgatgttccattttctataaaacagaagagacgcttgtattttttaactcccaatgtgggtaatgctagataagtgtggaagttctttgacaaccagccagaaagtcctatagatatctaaggattcattactttgtattgtggttgctatgatgatgatgtggcaggattcttgtacttaaaatatgagacatgcaacagctgctctggggtgaggctactccaatgggctaaattcaaatgtctcatgcagtggagttgcgtttcaatgagtcatctgatatgctgatgtgccagggaatcagatacttcacagtcagaaggcagcaggaatcatgtgtgttgtggatgtgatgtgactgacgtggtgacagatacattcaaagcatcagcaggctctctaaacaaagctccttctaggaaaactgatcactgtggcaggctccctccaatgactgcaggctgggaattgaccataacagatcatgatgtaggttctagaacaagactgaggggtggaacaggagtcaggtggtcttcagagtgattttattgacattagcccaaccaaggctccaccatgctttgggcaatcagcacatctcagggcttggggttctggatgttggaatacattgcataactggtgcagtagcaggacatgaaggccaaggcagaaatttcatccgtactttatgtaaacccagtagactggtggtctcaaactccagagaaactaaaatccaactgttgggtactacgctcactatctgggtgatgggattattcatatcccaaacctcagcatcatgcagtatactcatgtaataaacctacacgtgtacccctgaatctaagtaaaagttgaaattatttaaaaaacaattgttcaaattcagatttctggtcttcattcccagagttcactattccactggtttggggtgggggccaataatctacattcaacaagccctttaagtgattttgatgcggataatgtacaatttccattttcaggaaataaaatgtagtagatacaggaaggactctggatgagagtgaccataataaaaaccaaaaagttaacatgtattgagtatttactatgaactgggcactcttcaaagtgctgtacagaaattaactaattatcatgccatcccatgagctaaccactaatatttcctccattttacaaatagaagacactcgtgtcctggtttcctggtaaaatgtgaaagtttgaatgtgtcagaagaattttgtaaggaagggatagattgctcaaattccacctagaggaacagcatatactgccatcactctagtgttttaatatagcctgattctaatatgaaaaattcacagcagcctggtagcttagggtagggatggagcttaggagaaattgcccactgtagcatctatctcacagggtaccaacattgagactggaagacattaactccaattattccttgccctctgaatgctgaaattgcccttacctcaaccttgtttttggctgggacctgttgaaatgctgcaagcctccagcttgctaatcaggtttacagaaaaaaagagattttaagcctctactaattaaagatataatgctaaccatctatgaccagttaaccatctatgaccagttagctcatttaattagagcccattgagaataagagtgaactaatcgaacctaacatttactttctattacagaagaatttatttgaatctctcttttccttggctaagaagaatgaagaggcaggagacttgggggaccccttaactggggataattactgggacaaatcagccagcacaaagaggaggtaatatttggatggttagttagaaatattctttgctgatttattattcatgtactatgatttaaagaaccttgaagttgtctgaacattgtttaaaattttggaggtctagaattccagatttatgtttctaagtgcctacctgctaagatgttccattgggttgttcagctagtatcccttccccaaaacatatcccaaatcaatcccatcatactccccaccaagtctctcttctctggatgacactacttctgttcctgatcacactgttctcccagttctggttcagaaacacagccatctttgaatccaccctccctagagagttggttgtaagataaattcacatgttttctcaggttagcttttgctcttccagcaagaagagcatcactatcacccatagttcaatccttttcatctcatggggtctgaaccacattctggagctttcctgaccagcatcttctccgtttgtcctgcagcttcttcttcctacaatggctctgccatattgaaatataattctttagcttaaactctctgtgatttttattgcctcctaaataaagttgaaatttactaaactcaaaatctggtgtacaagtccttctataatcttttcccatactatttgtctagccttgttttctattaagtctttaaaaacaattttactactcacagggctgatttacctattagatacaggaagtacagcacctaggtcccacaatgcttttagaggtccaggatcttttaatttctttttcaatcaaaagaaaaaagaacacaatccaaattgtattgtatgcataattatattaacacagttgtaaaacataattttaatattttttggacaaagatacctatgaaagcaaaagtgtcaagtcccatgaaagtcatgtgactttccccgaaatagaaaatatagatttaataaatgaactttggtgaaagatttaaagacaagtaataaggtatgcactcattaaatgtaaaataaataaataaaatcatcaaccctgtctcaaaaaatgtttaactttcatttgttcgttaataactcaattactcactcattcaatcaacaaatattaattgcactcttactatttttcaggcactaaacaatcagtcctggtctctgttatcagagacttttgatgctaccattggagtcagacaagcagacaaacatcaacaaaatgattataaactatgacacactatgatgggaaagaaggaggctgacagagaggacattggcaggaaggagccctactgtagatgtggtggtcagagaagggcctttgtgagaagctgacacataatctcacagttgaagttgtgagaaggagctggtcctccagagagaagtaggaagagcgctccagcagaatctctgggtgagacttggacatctgtgttgttgctctactttctgggtacatctgatgaaggaggagcccctgctgttggtctcatccacaaatacagtttaagctcttcatttccgtggttttgttcatgctgctcccttgccctagaattccttctcttctgcctccctttctctatctttcaagccatactcatcttctaagacccagttcaaatgccaccaccaagccactgtctctatgccaactcctctggccagatgcctgctctcctttaaagcccccactctaatgcttagcagttgtcatcccctaccctcttcttccatatgttttatctccactacttggtggcaatttcttaaaggtaaagactgtgttttatgtcttagcattgcttgaacaacctccacagtgaccttcacacattagaaatttagtaaaaattttctggatacatgaaaaatgaatgagtcatgattccaaggtagactatgtattcacatcatattcttgcaatctttcccttatttcctttgcagacaagtgcagctacgactgctgctgggaccgcgatactgtgatgagactttgcatatttaaaaggatgtcgagagaggaggaggaatgataaatgaactcaggaagatgtgatgtcttctgtgatgacactaatagatggaatgcagaattcagctccaatacttagggttggaaaccaaacataaacaagcaagcaaggaaaatgaaaaggaatgtgtgtgtgtgtgtgtgtgtgtgtgtgtgtgtgtgtgtgtaggtgtgagagtatatgaaatacatgaaaagataaaaagttagatgctgctaaagggacagacatgtaggaattttacattagggttgttctgattttcattttcttgccttttaaaatttaatgataaacaagtctccagagatttttacagcctgggagaccactggtaagacaacaatataggtggtcctccagcaggatctaaatcagagccttcatagtggactgtcgggccaggtgcagctgtagacaatgcatcttcaggagtggggtgaagaaatttaatggactagtaatgcaacaggaggtagaagaaaagtgttctctcactaaagcatggtgggtgttttcaaaatgtttaaaaaacatttttaggccgggcacagtggctcacacctgtaatctcagagcttggggtggctgaggacccaaaaggaggatcccttgatgccaggagttgtagaccagcctggtctaacatagcaataccctgtctctaaaaaaaaaaaaaaaaaaaaaaattaattagccaggcaggtgacaagtgcctgtagtcccagttactcaggaggataaggcaggaggatcgcttgaacccaagaatttgaggttgtggtaagctgtgatcgtgccattgcactccagcctgggtgacagagtaagacctcaattctttttttttttttttttttttttttgaggcagagccttgctctgttgcccaggctggagtgcagtggcgcgatctcggttcactgcaagctccgcctcccgggttcacgccattctcctgcctcagcctcctgagtagctgggactacaggcacccaccaccacgcccagctaatttttggtgtttctagtagagatggggtttcaccatgttagccaggatggtctcgatctcctgacctcgtgatgcacctgcctcggcctcccaaaatgctgggattacaggcgtgagccaccgcgcctggccagacctcaattctttaaaaaccaattgtgttatgcttttggttgctgggttcttagaaggaggttctcaaggtggcaagtcagagacattctgttctgtctgtcagaaatgcaaaataatggagcaaaattccaaagataaagtgaaaaatatggcaatcaggatagcaagagctgagtgaatggtgtgagtttgaggaggtgttttcgattaacttgttttaacattgagctgtaaaaagaagttaagatagggaaggatggggtgaaatattgcctggtctccaactgaaacacatgggcctgagatatggtgaagttttactaatgggatgaaaaagtggagtaggcctggtgtggaggagcacagcatcctgagcctcggaagtgattcaggttaaagggcctctaaggctacactctcagagccttggaagagctacctggcttgagctctactcatagctacttttctatcccctggttgtcagctcttcagccctttattcattcaaaaaatatttattgatggcctactaaatgacaggccctgggtgaacagctgtgaaaaaaaaatgggcaaatgtctctgccctcctgggattcatatactaaagggtcaagaatataagaatttattaaaagaacagtccatggaggaaaaaatgaagcacaagtataatggatctattgacctgtgtaatgaccccagatcaagaccctgatcaccccatttatttggtgcctgttattgtaatgtcttccgccatctgttattactacttaccacctctcctctgagacgtatggtccaagccacataccctcaaaaaaaaatctgtattgaagtataatttatgtaccataaggttcacctattttgagtgtataattcaatgatttttaataaatgtatagagttgtatggtcttatcattacaatccagacttagaacatttctgtcagcctgaaatgtttctttgtgcccatttgcaatcaattctgcttctactttcaaccccaggcaaccactgatctgttttccatatctatagattggccttttctggacattttatatcaatggaatcaaacagcataagttgcgcattcctaacccccaaatccaaaatggtcaaatttgaaaattttcaagcatgacatgacaccacaaatgaggaaagaaaagatgcctgacctccttacatatgcacaccacaagtggaaaatttcacacataacctcattcacatgatgagttgcagtcagtcaaaatgcaggcatgcaacacacagtttattcagccttctcaagacaaatagacccacccagcccccatcagctgcaatacatcttttctacccaatgcccagattcccccatgcaagcacactcacaaagggtaataaaaatgacacacgtgcaggccggatgtgccaatagcaggttccccatgatgccccatggggagccaagatggcatgtattactcattgtgtttttttgcttattctctgctctgtggtataaagatattgttgaaaatgtcaaaaaggtctgcatatgggtaatagtaataagaaaaagagaacacatttatgtttgtctgtagaacagatactgaacagcagtctaagtgtgaaatgtcttatggaagagtatggtgttggaatgatcaccatgtatgaaaataaggataaactgtggaatttttatgcttaaagtgatgagcagaatttgattaaaaataggaaaacactgcataaagcttaaaatgaagatctcgattgtgtattgaaggagtggatccatcagcgttgcagtgaacacatgccacttaatagtatgctgatggtgaagcaagcaaagatctatcagagtgaactgaaaatggaatggaactgtgaatattcaacaagctggttgcagaagtttaagaaaagacatggcactaaatttttaaagatttgtggtgatgaagtgtctgctgatcgtgaagcaatggaaaaatttattgacaaatttgccaaagtcatcactgattaaaatctgacaccataacaagtctataatgctgatgaaacattactcttttggtgttattgccccagaaagacactgactatgacttatgagatgacccctacaagaataattgaggatgccaagaacagaatagctactgggatgtgctaatgcagcaggcacatattggtatatacttgctgtgatagtcaaaagcttacatccttgctgttttcaagaagtgagtttcttaccagtccattattatgctaacaaagaggcatgtatcaccaggaatatcttttctgattggtttcaaaatattttgtaccagtagcttttgctcactctagggaagttggactggatgataactagaagcttttgttattccttgacaactgttctgctcatcctccagctgcaattctatcaaaatagtgtttatgccatggactttcccccaaatgtgacataattcattgatcatgtatccttaaatcaatgaaaagtaaatatacaaaacttttttttggaacagcatgctggcagcagtgaacagaggtgtaagtatggaagctttccaaaagaagttcaggatgaacgatgctgtgtgtgctgttgccaatgcttggaatccagtgactaaatacacagttgtatatttctggcacaacctctggcctgcaatgatgttcagtaatgatgatgaaccaggtggtgactttgaaggattccacctgtcaattgagaaaaaaaagatatttgacctccttacatacgcaaaaaatatatcttcagaggctgtcagtaagttggaagaagtagatattgaagatgttttaacattgataataagcctctggttgttcattcactgattgatggtgaaatagctgaaatggttctgaattgaggtgatggcgataataacgacaatgatgacattgttaacactgcacaaaaagtatctgtagaggacatggtgaaaatgtgtgatgggtttattgaaggactagggcagtgtggatttgcgatggaacaagaaatcatgtagtatataaaaagagagattgttaagacaaaaagcaacactgttgatgaggcagatgacttgaggaaacattttaaaaatctatccagcagaacgcctcctcattgctaggggacccattttctggtccttcaactgcttctgatgttttttctcaccttaaaaaaaaaaaaaaaccatacagagtacagtaaccttttagtcagaacacagcactgcaggtggagactgaaagcctgttgttcgttgctgctgttgtctgacagctgatacagggattctggtgatgctactgtgctgcttaattaccctgaacacatgtttttttaaggtattaaagataaataatattttttactgttaagtacttatgtgtgaataagtataggaacatgattgcttattggtagcatttacatttagagtcaggaaatgtggtgatgccaaacaaccacagattgtccatatgggtgggtggctgagatagtgacacttgtgctttctgatgattcaatgtacctttaagctatgtgtataaagtgtatatgaaacataaatgaatttcatgtttaaacttgggtcccacccccaagatatctcattttgtatatgcacatgttccaaaatctgaaaaaaaatctgaaatctgaaacacttctggttgcaggcattttggtttaaggatactcaacctgtatgtatgtttttgtaggtggcttctttcacctagaataatgttttgttttgttttgttttgacagggagtctcgctctgtcgcccagattggaatgcagtggtgcaatctcggctcactgcaacctccgcctcctgggttcaagcgattttcctgcctcagcctgctgagtagctgggattacaggtgcatgccacgatgccgggtttaattttttgtatttttagtagagacggtgtttcataatgttagccaggatggtcttgatctcctgaccttgtgatctaccagcctcagcctcccaaagtgctggaattacaggcgtgaaccactgcgcctggcctagaataatgtttttaaggtcaatctatgttgtagcatatatcaatagtttgctacgtttcattgtttcaatagtattcagttgcatggatatagtatattttatttattctttcattagttgatggacacctggattgttttcagtttggggatattatgaccattaatacataagtctttgtatggaaagaagtttgtatttctcttgtgtaaatatctacatgtggaattgctgggttgtatagtaaataagtgtttaactttatgagaagctgccacactattttccaaagtggctctaccattttccattcccacacgtatgagagttctaatttctccacatcttcaccaatactgattatcgtctgtcttttaattattgccactctagtaagagtgtagtagtatcttagtttgattttgaattttatttccgtaatgactagtgatgtgagcattttttcatgtgtttattagttatttctgtatttcatttggagaaatgtcttttcaacttttttggccattcttttgtttttgttgttgttttttgtttgtttatttttgtttgtttgttttttgagacagggtcactctgttgcccaggctggagtgcagtgttgcgatcatagctcactgaaccttgaactcctgggctcaaacaatctctcgcctcaatctcctgagtcactaggactacaggtgcctgccaccatgcccggtaattaaaaaagatttttttttgagatagggtcttgttatgttgtctaggctggtctcaaacttcaggactcaagtgatcctcccaccttagcctcccaaagcactggcattacaggcatgagccaccatgagcatgagccaccaaccttttggccattttcaaattaggctgcttgtcttcttgttattgagttatattagttatttatgtattccggatacaaattcctttatcagatgtatgattcataaacttttctcccagtttttgccttgccctttcattgtctaatgattttttagaagagcaaaaacgttaattttgtttaagttttttcttttgtggattatgcttttgttgtcatatctaagaattctttgcctaatcaatgtcactatttttcccctgttttcttctaaaagttttataattttacttagacattaagtcaatgatccattttgagttaatttttgtgtatactatgaggtgtctatgttcttttttctttatgttttgtacatgtatatccaactgtctcacaaacattagttgaaaacactgtcctttcccgaattgaattgccttacacttgtcaaaaatcaactgaccataaatggaagaatttatttctggactctcaattctattctattgatctatgtacctatcctgtgccaatactatattgtctcgattattgtacctttattataacttcgaaattggggagtgtaagttctccagctttgttcttttttcaagattattacagctattctaggttctttgcattttcatacgcattttagaatgagcttatcaatgtctaccaaagaaattgctctgctagaaattttatagggattgtgttgaatctatacttcattctggggagaattgctatcttaaaaagattgaatctccaatttatgaacatgaaatataactccatgtatttagcaatgttttatagttttcattgtataaatcttgtccttgcatttcttttgttaaattgatttctaagtattttattcttttgatgctatgaaatattcttaatttccttttttggttgtttctttgctaaaacgattgacccttgaacaacacaagggattaggggtgccaactcctgtaaattcaaaaattggcacataacttttgactcccttaaaacataactactaacagctcactgttgactagagccttactgacataaacagttgattaacacatattttatgttatatgtgttagatactgtattcttgaaagtaagctagggaaaataaaatgttactaagaaaataaaaaggaagagaaaaatgtatttactattcattaagcaagtgaatcatcttaaaagtctttatccttgtcattttcatgagtatgctgaggaggaataggaagaggaggagttggtctcactgtctcaggggtggcagagacagaagaaaacccacgtctaagtggaccctcatagaaatctgtgttattcaaggatcaacagtacatgaaatacaactgacttttgtagattggtcctgtatcctgcagacttgctaaatttattagtgctaatagattttttaaatgtgtggatttattaggatttcttttttacatacaagattatgttgtctgtgaataaaggcagttttacttcttccatccaattagaataacttaaattttttttcttgccttattaaactggctgaaactttggtaaaatgtttagtaaaaggaacaagagtagagaacattgcctaattcccaattttagcaaagaaaacactgaatcttttattattaagtatggtatttgctatagtttgtttatagattccctttaccaagttaaagaagttcccttgtattcctattttgttgatagtttttattactgatgggtgctggatttttaaaatgctttttctacatctattgagatgattacatgggttttcttaattccatcaatatggtatattacactattgatttttgaatactaaacaacttgaattctttgcataaattccacttagtgatggcatagaattctctttatatctttctagatccagcttcttaaaattttaaggatttttgcatttatgttcacaatggatatcagtttgtggttttcttttcttgagatgtctttgtttgacttttgtatcagggtaatactgggttcatataatgtatttggaagtgtttccctttactcttttctaaaagtgtgaagtattagaattatttattttttaaatatatgttagaattcaccattgaagtcatttggagtatttctttgtggaaagattttaaattaccagttcaatgtctttgcttgctatagatctattgatattttccaacttctcttgagtcagtttaggtaatttgtgtctttctataaatgtgttcgtttcacgtaaactgtccaatttgttggtacaaagttgttcataatattcacctataatcctttaattttaaggttggtagtgattgccccactttttttcctgatattggtaatttgtgtcttcttttgttttttgatcagtctagctaaagatttgtcaattttgttatttttttcaaggaatcaccttttcgtttcatagatttttctctattatttttcttttttctatgtcattgttttcttttttaaaaaattttattattattatactttaagttttagggtacatgtgcacaatgtgcaggtttgttacatatgtatacatgtgccatgttggtgtgctgcacccattaactcgtcatttagcattaggtatatctcctaatgctatccctcccccctcctcccaccccacaactgtccccggagtgtgatgttccccttcctgtgtccatgtgttctcattgttcaattcccacctatgaatgagaacatgcagtgtttggttttttgtccttgcgatagtttgctgagaatgatgatttccagtttcatccatgtccctacaaaggacatgaactcatcattttttatggctgcatagtattccatggtgtatatgtgccacattttcttaatccagtctatcgttgttggacatttgggttggttccaagtctttgctattgtgaatagtgccgcaataaacttacgtgtgcatgtgtctttatagcagcatgatttataatcctttgggtatatacccagtaatgggattgctgggtcaaatggtatttctagttctagttcccttaggattcgccacactgacttccacaatggttgaactagtttacagtcccaccaacagtgtaaaagtgttcctgtttctccacatcctctccagcacctgttgtttcctgactttttaatgattgccattctaactggtgtgagatggtatctcactgtggttttgatttgcatttctctgatggccagtgatgatgagcattttttcatgtgttttttggctgcataaatgtcttcttttgagaagtgtctgttcatatccttcgcccacttgttgatggggttatttgattttttcttgtaaatttgtttgcgttcattgtagattctggatattaaccctttgtcagatgagtaggttgcgaaaattttctcccattttgtagattgcctgttcactctgatggtagtttcttttgctgtgcagaagctctttagtttaattagatcccatttgtcagttttggcttttgttgccattgcttttggtgttttagacatgaagtccttgcccatgcctatgccctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatccttaccccattgcttgtttttgtcaggtttgtcaaagatcatatggttgtagatatgcagcattatttctgagggctctgttctgttccattgatctatatctctgttttggtaccagtaccatgctgttttggttactgtagccttgtagtatagtttgaagtcaggtagcgtgatgcctctggctttgttcttttggcttaggattaacttggtgatgcgggctcttttttggttccatatgaactttaaagtagttttttccaattctgtgaagaaagtcattggtagcttgatggggatggcattgaatctataaattaccttgggcagtatggccattttcacgacattgattcttcctacacacgagcatggaatgttcttccatttgtttgtatcctcttttatttcattgagcagtggtttgtagttctccttgaagatgtccttcatgtcccttgtaagttggattcctaggtattttattctctttgaagcaattgtgaatgggagttcactcatgatttggctctctgtctgttattggtgtataagaatgcttgtgatttttgtacattgattttgtatcctgagactttgctgaagttgcttatcagcttaaggagattttgggctgagacgatggggttttctagatatacaatcatatcatctgcaaacagggacaatttgacttcctcttttcctaattgaataccctttatttccttctccttcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttactgagagtttttagcatgaagggttgttgaattttgtcaaaggccttttctgcatctattgagataatcatgtggtttctgtctttggttctgtttatatgctagattacatttattgatttgcatatgttgaaccagccttgcatcccagggatgaagcccacttgatcatggtggataagctttttgatgtgctgctggattcggtttgccagtattttattgaggatttttgcattaatgttcatcaaggatattggtctaaaattctctttttttgttgtgtctctgccaggctttggtatcaggatgatgctggcctcataaaatgagttagggaggattccctctttttctattgattggaatagtttcagaaggaatggtaccagctcctccttgtagctctcgtacaattcggctgtgaatccatctggtcctggactttttttggttggtaagctattgattattgcctcaatttcagagcccgttattggtctattcagagactcaacttcttcctggtttagtcttaggagggtgtaggtgtcgaggaatttatccatttcttctagattttctagtttatttgcgtagaggtgtttgtagttttctctgatggtagtttgtatttctgtgggatcagtggtggtatcctctttatcattttttattgcatctatttgattcttctctcttttcttctttattagtcttgctagcggtctatcaattttgttgatcttttcaaaaaaccagctcctggattcattaattttttgaagtgttttttgtgtctcgatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctgtacacactgctttgaatgtgtcccagagattctggtatgttttgtctttgttctcattggtttcaaagaacatctttatttctgccttcatttcgttatgtacccagtagtcattcaggagcaggttgttcagtttccatgtagttgagcggttttgagtgagtttcttattcctgagttctagtttgattgcactgtggtctgagagacagtttgttataatttctgttcttttacatttgctgaggagtgctttacttccaactatgtggtcaattttggaataggtgtggtgtggtgctgaaaaaaatgtatattctgttgatatggggtggagagttctgtagatgtctattaggtccacttggtgcagagctgagttcaattcctgggtatccttgttaactttctgtctcgttgatctgtctaatgttgacagtggggtgttaaagtctcccattattattgtgtgggagtctaagtctctttgtaggtcactgaggacttgctttatgaatctgggtgctcctgtattgggtgctgatatatttaggatagttacctcttcttgttgaattgatccctttaccattaggtaatggccttctttttcgcttttgatctttgttggtttaaagtctgttttatcagggactagcattgcaacccctgcctttttttgttttccatttgcttggtagatcttcctccatccctttattttgagcctatgtgtgtctctgcatgtgagatgggtttcctgaatacagcacactgatgggtcttgactctttatccaatttgccagtctgtgtcttttaattggagcatttagcccatttacatttaaaattaatattgttatgtgtgaatttggtcctgtcattatgatgttagctggttattttgctcgttagttgatgcagtttcttcttagccttgatggtctttacattttggcatgtttttgcagtggttggtaccggttgttcctttccatgtttagttcttccttcaggagctcttttagggcaggcctggtggtgacaaaaatctctcagcatttgcttgtctgtaaagtattttatttctccttcacttatgaagcttagtttggctggatatgaagttctgggttgaaaattcttttctttaagaatgttgaatattggcccccactctcttctggcttgtggagtttcttctgagagatccgctgttagtctgatgggcttccctttgtgggtaacccgacctttctctctcgctgcccttaacattttttccttcaactttggtgaatctgacaattatgtgtcttggagttgctcttctcaaggagtatctttgtagcattctctgtatttcctgaatttgaatgttgacctgccttgctagattggggaagttctcctggataatatcctgcagagtgttttccaacttggttccattctccccgtcactttcaggtacaccaatcagatgtagatttggtcttttcatatagtcccatatttcttggaggctttgttcgtttctttttattcttttttctctaaacttcccttctcgcttcatttcattcatttcatcttccatcactgataccctttctttcagttgatcacatcagctcctgaggcttctgcattcttcacatagttctcgagccttggctttcagctccatcagctcctttaaggacctctctgcattggttattctaggtatccattcatctaatttttttgcaaggtttttaacttctttgccattggtttgaatttcctcctgtagctcagagtagtttgatcgtctgaagccttcttctctcaactcatcaaagtcattctccgtccagctttgttccgttgctggtcaggagctgtgttcctttggaggaggagaggcgctctggtttttagagtttcctgtttttcttttctgttttttccccatctttgtggttttatctacttttggtctttgatgatggcgacgtacagatgggtttttggtgtggatgtcctttctgtttgttagttttccttctaatagacaggaccctcagctgcaggtctgttggagtttgctagaggtccactccagacgctgtttgcctgggtatcagcagcagtggctgcagaacagcggtggctctagaacggcggtgggtgtagaacagtgaatattggtgatccgcaaatgctgctgcctgattgttcctctggaagttttgtctcagaggagtacctggccgtgtgaggtgtcagtctgcccctactgggtggtgcctcccagttaggctgctcatgggtcagggacccacttgaggaggcagtctgtctgttatcagatctccagctgcgtgctgggagaaccactactctcttcaaagctgtcagacagggacatttaagtctgcagaggttactgctgtctttttgtttgtctgtgccctgcccccagaggtggagcctacagaggcaggcaggcctccttgagctgtggtgggctccacccagttggagcttccaggctgctttgtttacctaatcaagcctgggcaatgggcaatggcaggcgcccctcccctagcctcactgctgccttgcagtttgatttcagactgctgtgctagcaatcagcgagactccctgggcataggaccttccgagccaggtgcaggatataatctcctggtgtgcctttttttaagtccgttggaaaaatgcagtattagggtgggagtgacctgattttccaggtgccgtctgtcacccctttctttgactaggaaagggaactccctgtccccttgcacttcccgagtgaggcaatgcctccccctgcttcggctcacacccggtgtgctgcacccactgtcctgcacccactatctggcactccctagtgagatgaacccggcacctcgggtggaaatgcagaaatcacctgtcttctgtgtctctcaagctgggagctgtagaccagagctgttcctattcggccatcttggctccacctctatctcattgttttctagttttgtctttattacttcctttcttctgcttgctttgggtttagttagcttctctatttctagtttcctatagtgggtgtttaggttattgatttaatatctctcttctgtcctaatgtaggcatgtataactctatatttcctgaactttaatcactgctgtagctgtatcctacaatttttcatatgttgagtgtttttgtttagctcaaaaatttaaaaattttcctaccgttttatttgacaaacagtttagatagaagtgttttaatttttaagtattttgtgattccttaaacttccttctgtttttgtctaatttaattgcattgtttttgaagaacatacttttgattatttcaaaccttcaaaatttactgaaacttgtttttatggcctagcatatggtctattctggagaatgttctatgtatgcttgaaagaatgtctattctggtgtccttgagtggaatgtttcataaatatcagtgaggtcaagtggtaagtttaagtcttctatatccttgctgcttttctgtctagttgttctatcaattattgagagtggagtataaaaatctccatccaccatttttgagcactgtcatttcttgctcgggttattgaaatagcttggcactccttatccaccatgcctactttactttttcccataggatttatcttcacctgacttagtatatattttatttatattctagaatataaaggtcccatgctgtcaggcagtttttatcactgatgtatgcctggcaccaagaacagtacctgacacatacttgtcactcaaaaatataatatttttttaatgtatgcattcatcaccaaacaaatggcaccttctagtttctcgggtgagtgtgagactcctcatcccactatctggaataatctgaagtgggtcaataccagtggaatcctgagaaattcagggcaaagggtgggagatataagggggtaactactgctactgcttttggccacagggagaaactttccctttctccttgtgttttttgtttgaatttatctctccttgaatttttattttattttattttatttttgtctcaacctcatgggctcaagctatcctcccatctcagcctcttgagtagctgaggctacaggcatgcaccaccttgcccagctaacctttttcttttcctttttttttctttttttaaatttttttttctttttttcctttttcttattttttttttaagagatggggtctaactctgttgcccagtctggtcttgagctcctggacccaagtgatcctcccacctcagcctcccaaagtgctgggattagaggcatgtgccaccacacctggcctccttgctctttgcattttctagttatcaaagtggtaggcacttcaagaccagaactggatataggtatcaaggaaatatgccactgtgcttgattttgatccagactatttggctgccttctccaggcaaaggcatcaggtgaccctgtacatcttagtaggtattaaatcacaagtggggaaggaaaagatgggttaaaacttcagaacaatacacaaaaatgttttcccctgcatctgtactttttcctcctgaatctgagacaagtttccataggtgactggttcaggattaggtgctcaggaccccggccaagtattgttccattttagcatgattgacactatctgcttagatacatgtcttggtgtagctttgaaatttaatgcatatcctgctttggagggctgtaatatacaacaacttcagaaaaaaccagcatgcactatttattattgagtgcttggcatatgatagcaagatacttttcatgtatctggcatatcagttactttacataatctatatgcttaatcaattaaaaatgaaagaaaagattaactgatatttttcttttacttatgaaaattaggcctaagttttacaaacttttctcatatggtctgtataaccaactggaactcagggaagaggtctgggctggagaaaacagtttgggcaccatgaataaatctatggtcattaaagctgggagatgggtcacgccttctacagaatgagaaggggaaagcatctggataaaactttgaggaacagtgatgtttaatgagtagaagatgatgagcctgaaaaggcagagaaggagcacacagaaaggtaggaggaaaatgaggagaatattgtatccaggaaggtatgcatcatctttctgaaaacttgcaattgtccttgctttgggggagtctcgctactggtaaagcacttatcatttaataataaattctcattacgtgaatgatcctgcaattgttcttgactcaaatagttctcatgcagagatacttataacacttggtaacatgaagacttttgtgttaataagactctgtgctgggtgcagtggctcacacctgtaattccagcactttgggaggctgaggtgggggaacaccttaaggccagaagttcaagaccagcatgggcaacacagctagaccctgtctctataaaattagccaggcatggtggtgtctgcttgtagtcccagctacctgggaggctgagatgggaggatcgtttgagcacaggagtttgaagctgcagtgagctatgatcacaccactgcactacagcctaggtgacggagcaagacactgtctaagagaaagaaagaaagaaaagaaaagaaagaaagaaagaaagaaagaaagagagagaaaggaaggaaggaaggaaaagaaagatgctgtattttcatcaaaataatttcactccagagctgggcatggtggctcgcacctataatcccagctactcaggaggctgaggtaagaggattgcttgaggccaggagttcaagaccagcctgggaaacataggacgacctcatctctaaaaaagttttttaaaaattagccagacatgatggtgtctacctgtagtcccagctactcaggaggctgaggcaagaggatggcttgagtccaggagttcaagactacagtgagctatgatcatgccactgccctccagcctgggtggcagactcaatctctttaaaaaattactttacctcaatccttgtgcaccctgcaagtatgatatactctctcaatgactccagaatccatccgtgaccttttggcattctagcggtaatttgaataacgtcagtgaaacatggcaatagcactgtacaaataaattgaatttattattacggctctcccatgatgaaattatttatttttgtgtttaattttttcattttaagaaagaaaagtctttctgttacccaggctggagtgtagtggaataatcatagctcactgaagccctcaactcctgggctcaagtgatcctcccacctcaacctactgagtagctgcgactacaggtgcacgctaccatgcctggctcatttaaacaatgtttctgtagagatgaggtctcacttcgccgcccaggctgcgaactcctggcctcaagccatcctctagcactggcttcccaaagtgctgggattacaagcatgagccaccatgcccagccagtcttcaatatttgtggcagtaaataaccaatgaatttttattttaatgctttagtctcaataacaaatttatttgtaagagtgctattttatatgatttatacattcactcattcatccatcaaacatatattaagtacctactgtatgccagacatataatgttaagatgcatgaggcatggttctcaagtttaggtgtgcactgaaatcatatggcaaacttgctaaaaatacttatgaccccatcccactttttgtattcagtagatccagggtgggtttcagaaatctatttatagcaagctttccatgtgattctgatgcacaacaagatcttggaactattgctctacataaaaacatttagtgaaaaaataaaatgtaataaagtataagaggtgtcagaagtatacacagggtagagtatatattacattttataacatttgtctcttactatagtagtagactatgcactcaacaatattattgcaatttttgactgtaatagaatattttattagggttttgaagccctagcagtataatttactttcattatactgcagacatttttaatgtccttaaaaatgatcataaaggtaagaggatgctataaaaattcaaatgttattatatctatgcttataacttactttagtaagactgagaaaagcatctggtggttcctacttaaaactctggaaagctttactgtgtcattataggagtagttgtcttataaatgaaagtgttcttttctctcttttttctttgtctgcaaggctcttttgcagcctgttgatacaaagcttcaaacagcattcgaggaatattcatagcagtttcctactaagacttcagcaatgatgcaaaatgcaaaactcttgagtcttgcattgtgggaaacaagctttcttttaaaaaattattgctttcttcttaaaaggagatactcgttcaccatggcattgacaaggaaacttaggctgtaagaaacagatcaaccaaagtcccattgtagggaagctatgatatgctttgattataagactttacaagaagagatgtctatagatagaagcaactatttagcaagtccaactcaaagaccgagtgaaaacagcaacggaaatgtgaaaaaagttctggaatttcttcaaaatgtcttttcaaaatgtcacttgctttcgaattaacacttcaggaagtgtatcgaagagtactagcttatccaaattgctgtttctcctctccttcttgggcacatacagaaaggaaacttcccagcctcctttgtgtcacttgtggtcatgtgactaagtgctagccaatggaatatgagtagaagcgatgtctgccacttctagatttgacctaaaaaatcttcccgctgtggttctcaatgtgccttctccatttgctactgcatgatgactcccaggcaacctggaagccacaggttgaaatggcagggcctctgtcagcctgggtctttgaataactgtatagagcagagacaccgcaccccgtctcctccccatcccagtgccaatagactttgcttgagagagaaataaacttttactctgttgagcgtctgaaatgctggggtgtttttttttgtaaagcagttagctaactttaatacaagatgtaagaatctaggcaaatctataccatgagaccatgcactgacctgtcatttatgaagccagagccctgaacatagttctgtaattctcctgcagaggttgcctataccacaatcccctactgaaaagctgtctagaaaggattcctctgactccaggagcaggactcaggctgtcaagagtattctagttctccacgaatggtttaaaagccaaagtttggccgggcatggtgactcacgcctgcaatcccagcactttgggaggctaaggtgggcagataacttgaggccaggagtttgagactagcctgaccaacatgtcgaaatcccgtctctactgaaaatacaaaaattagctgggtgtggcggcacatacctgtagccccagctactcgggaggctgaggcacgagaatcacttgaacccaggaggtggaggttgcagtgagccgagattgcactactgcactccagtctggggaacaaagtgagactctgtctcaaaataaataaataaataaataaaataaaataaaagccaacatttctcttagcctttagggcatggtcctagcactgtacaaagcataaaataaacactcagaaattctaactcaagaatctggagagaacaaaattggatagaaggaagccagaggcatagctgcaaaggagcatgacatgtaacacggacagagtcacagcataaggccaccttctaggccctgcactgtgtacttgccacagactggcagactgtcattaaggtttaagagagaattctctaggtctttaagatgtttatccaaattattcctctcagccttaaaatccttcagtcattttggatacctctctctctcctttctttggatacctctctctctcctttctagtccattaagtaaaatagctcctacccatgcaatagttattctgatcaggcactgtgcatggctttacatatgttgtgttatataatcttcacattaagtacataatattattatccctattctgcagatgaaaaaactgaggcaccaaaaagttaagtagcttgaccaagctcatacagctagtgaggggaaaacccagagctgaaatctaagcacttggactccctgccaaatcatctgcccttaaccattgtactatactgtttccagcagtaaaattcagcagatttttgctcatgtaagagacctctcaggagagggttgatccttcaaaagggccaatagatagaatccagttcattggcccttcatatttgcatcctttttgttttttattttgtccctcgtgggatttgggaagctctcagcatgatgctggtgttcacccttggaggtacctcccttctctaaatcttagcagttccctagcatggtgagatcctggggctgctgccacaatcctctggaaaagaaaagcttgaagagaagcttcttggctccagtagattcttaatgctgaggagaagagctgttctgtggggccaatctgtcactgcatctatatttagcgccatctgccaggaatatttcaaactgcctattttagcacatgctgtttcgtgcaaatgcgactgctccaccactagttcgtgggaaaccaagggcactaagtggattttctgtttttttatgttaagtgttgcaagttggcccttcagtcaaccttcaaatgagatatgggagagaagggaggtggagttttcccagggtgttagtcccaggagcccacacattcagctgctcaaaagtaacccaaggatggcagctgtagaggaggcggaggtggctctgggggttcagggggaagggcaagggaatataaaagcccaggactcctatccagcagccccaaggcaaagtgatggccttatccacttcagtgttctccactccaactccgagatcattgtccagactcttgcagccttaacatacccccaggagagccttcttgacccatctcagtgaaaaacaagggctcccatttactgaggactttccttgtgccaattttcagtgcttgctttgatatgcatatttgtttctggcatacaacctctttatgggggaggctctattactagttctactcacagataaggcaattgagtcttagtgagggtcaggaacttgcccaagggcacattgcttgtaagtggtggagtcagaattcaaacccagccccagctaagaccaggtcttatgatcttaaacactgtgtactgaccaattctatacatcctcccatccagtatccctgttttcttcccccaggtataggcacacactatattttttgcatatatttcaatttccaacttattctccagacttgatggttaactgcatttgaagagctctgaccataggtttgctatccagcccccagtcagcaatgatgctaactccctaagaagccctcctagattggccccagcaatagcccagtgagggagagtggcttctaggtttgccccaactcttgaggaagaactggtgggtaggaacaaccaagcagccttatgacaggttgttatagctgcagaggtgagtttgactggaaaggtacagattctggctttatagatggtaaggactgcctggaaaaggaattgccaccagggactggcatggggctgggctgagaagactgacagtggagtggggctcaataacacagctgtcctgtatgacttattaatcttaagagcgactgactctaggcaaattctaaattgtgatcataggaaaatctcaaaatatatacatattttttatagacacaattcccaaggataaccaattttcattaaatcaccctgggataaaggctagaagagatggctccatgtttgctatggtttgggaaatttggaactgagtccttgggctgtccagggactgaagaatatgagtggcatagaatagaggctagatgttagatcttttaatagccaacttcatatcccatctgtttcagttatttattcctgcataacaagccacacttaaacttagtggtttaaaacaaaagcaatcactgtattatcatctctggggttgaggggttgactggcctcagctaggtggttctcactggggtttctcctgaattacagtcagataatgcatgggcttgaagccatctcaaagacctcctcacatacattaaaataggtgctggctgtcagctgggacctcagcttggctgtctgtcaggacacctacatacggtctctccatatggcctggacttccctgcagcatgggagctgcattcccagagggagagacctgagaaaatgcggcaaatgctatatagccttttgtgatctacccttagaagttacatagtgtcacagcacagtcacaccgtcacaggtcagcacccacgcaagagggcacaccgatattcttcttaagtggaaaggcattaacattaatttgtaagaaggtcatgtggtatgggatataagattgtggtgatcatctttgaaaaatgcaatctgccataccaattacatagggccaggggaagaacctggatttggtgaacaaattggggtggcaaagtagctggcatttgaatacaagaggggtggccaggcagcagaggaccaagactccacgcacatccttcatagtttcaactaatgcttactgggtacttaacatttgccagaaattggggctgtaatagcagtgagcaagagacaaggtgcctgccttcatgcacgttacagtctggtggggagacagcaaacaatggctcaaataaacacagaagctccataaagaaatataacagttgggtaaggggagtgacactattagggagaggggtttctattttagataaagtgcttagggaagaccttgctgaaatgggaacatttaagcagagacctgaatgaggtgagggagcgaaacaagcaaacctctggaagaagggcattccaggctgagggaagagcaggaacagtctcagggataagcttggcatgttcaaaaaataacaagaagcccagtgtggcaagtgaggaaggactgagtggaagaaggataggaaatgacgacgagaagttaccaagagtagttaatgcttaactgggggcaaaatccatttcaaaacattgcttctgttgatatttgttttcctggtcttaggatggaagaacaactcctcctcttccaaatgtaaatgactatgtttccatttggggcagagctgactgaatacagatttcagaaggcatctctgacacgcatgtagaggcatctggccaccttggggtaccttcccaccatgtaccacagtcaatctggtctttgtcagggcatctttctcttcagaaagtaactatgacaacggagttggatgctgcgagtctgcggcagccctctatttgcacacaacatgtgatgctatcagaacacagaattatgaatcagtgcagtgtcagcttttctctttgtagtgaacaagttatctgctctttgattcaattaatgttttattattggttttgtttttattatgactgttccataacaagatgatcaatatgttctatagcgtcgtttcccagacacatctgagcagagccccgtatcagttttctattgctgctgcaacaaattactgcaaacataacagctaaattacacaaatttatcttacagttctggaggtcagaagtttgatacgggtctcactaggctaaaatcaaggtattcacagggctgtgttcctttcttgaggctcaaagagaaggatcggcttcctttgtagttcaggttgttgggagaattcagttccttgccattacaggactgagggctccattccctgctggctgtcagctgagggccctctccagcttctggaggctgcccacattccttggctcacagccccttcctccatcagcaaagctagcaatagcgggtcaaatccctctcatattttgaatctctcctccttctgtcttatctccctctgaccacaaccaggaaagattttcagcttttaaggacttatgtgtttagattgggcccacctggataatccaggatactctccccttctcaaaggttcctaacctgagtcacctcggcaaagtcgcttttaccatgtaagtgaacattgtcatgggtttcagagattacatgtggactttggtggcaggtgaattattctgtctacagcaacccttatttcctgactacattaaactacagtttaatggaatacagtttgggaagcactgcccgagaggtatcaattctagacaggtaagaaactaattctttatgggtaatgacccaagcatgggtgagcacagggccaggtggaggatggattcctccatgtggttcgggagtggggtgcaggaaataaggataaagcataatggagttcagtgacagatttcaccttcttgccaagccacaagtataaatcaggtagatttcctaattgggcttgtctgtcaagaacttctaattgtagtgcctgaagggaaaggggtggacaactatggcactaggtgattttcacagtcatctcatataagggtcatgctaacttgtgaaggcaaaccctgcacttgaacctcagtgtggtgggttcatttggtgtcccactcagatcccctttatcaggctggtgtgctcatcctacagggtggtaagctgacagctcacagattctcccttctctggaaattatccttaaagcccttgggagctgccttagctaggaagttatccccccaatcaccccttacctccaacatacacacatacatacatacacactccacagaaagtctgtgacatcatttatgctccaaagtcctctggggatcacatttgagaacacattcttgtttcactcttcccccttcaatttcctgcttcccctcctccattacaagtttttcttgactaaatcaatacatctcgtgtcctcaaaaccctgcctcaggttctgcttccaaagaaccaacgtaacttgccacggctccctaattccaaagaccttgctctttgtagctacctagcctagaatcagacaagcactaagaaaaagactggagaaaatatccctgacacacctgggacatgctgtcttctagatatgtcactgaataaatcaaaggaagtttgtttatttgcaaaagttgggtgggagttcggtgtatgattctaaagacttaggttgtggaaaagaacaggaagtgagagttgagagttaaagttgaatacaatggtccactccactataagctccttggggacaggagccatgtccatgttgttctctactgcatccctgtgcttagcacaacagctggcacgtggtacctctgcaacttgtggaataagtaggtgaaaaaagtagagaaaagcaatagggggtcaggtttctgtgagtcaggaggttcaactgggagaaagctggggaaacagagtctgttctcgatagtacaggctgctttgcactcttccaagatcttctgtgatagcctcacttctggaatgtttccaggaatcggctcatgtaggccctcctctggaaaatggcagcatttctaataagcctttctccttctacacacgggaaagaatccagcagccttgtcctaaaccaagaacatatcttgcctgttagaggtctagtggatccctagattagacttacattatttttatttattaacaggttatttaaatttgtacagtataaaaccaggtattagctcattttactttagtgtttatatacaactaacatatttatgttttaaataccaaaaagtcacaaaaccggtaaaattgtaattaataacattcatgaaaggtgacctaatattgtttttgtaaaatgaaatctctaccacatgtagtgtggtactgactctccaagcccatgcgcttttgaaattagcccgttcatattaccgtgtacctgatgcaaacatcttctctgatctctcaatttctctctattcaaacgacttctaaaccttcctttgtataaaatggaccctgctgtgcaaacgcatttttgtgttaagtccacctttttcattcctcactagctttgaaaataaatagctttacttagcattaatttattacacattgtgttatacatgtaaatacatagaggcttaaatcatgcagtgcctggattataaattggacattcagataacttagaatatgtaaacttgtaagtacatatatgttatatttatatgtatggatatacagttgacccttgaacaacttgggtgttacgggcaccaacccacatgcagtggaaaatctgcctataacttttgattcccccagatcttaacgactaatagactactgttgaccaaaagccttactgataacataaacagccaataaacacatattttgtaagttgtatatattatatactgtattcttacaataaagtaagctagagaaaagaagatgtttataagaaaatcataaagaagagaaaatatatttactattcattgagtagaagtggatcatcataaaggtcttcatccttgtcatcttctaactgagtaggctgaggaagagaaggaaaggaggggttggtcttgctgtctgaggggtggtcgaggcagaagaaaatatatatataaataaatctgcacagttcaaatccatgtggttcaagggtcaactgtgtatgcatctatgtagatgagataatcatcaaagtctagttttaaaatgaaaaattacatcattcttttagaaaactcctggaaccttgaggaacactgctttaggcataccctggtctagaatgccacctgtctatacagttctccctcagtatctgaagtggatcagctccaggacccccacagatgccaaattccacagatgctcaagtcccttacataaaatggcatagtatttgcatataacctacacatatcttcttgtatacttcaaataatctctagattacttataatccctaatagaatgtaaatgctatgcaaatagttgttatactgcattatttttagttgtacctttttctattgttgtattgctatttaaatgttttcaaatattttccaattttccaagattggctgaatctgcacatgtggaaacagcacaggcaaaggctgacagtatgcagctttatttctctttctgtcatgcccatgcattcagtcaaaaattaaaattatttctctttacctctccacttgcatattcaaccattatacatagttgttcatctattttagaacaaccagccacatttattgcatgcctatcatacctacatcttgatttcacaagaacactgcaaaatagtattattaatattaatatgttatggtttacattttaaaaatgagaaatctggagatcagcgtgttcaggggacttgcccaagaacacgctcatgtcaaaggctgggctttgactcaattctgtctgatcttagatcccataattgtgccctttgctatagccccaaggtactgaaaggtgcatcgcacatagtgggtgctcaataaacattttttgaatgaatatgagaacaatgaactgtttccattccatcagtctgcctgtactcccagcctgttggcactgtttcctctctaggcatgcaaagcctaggggagtacaaactaaggtttgactcaccctggtatcccacagcatgcctggccacatagtaggttctcaaatactcattaatttgaattgacttgaactcctcccaagaccccgcttggaaacttttttgaaggttaatttagaatgagaaaagagaacttgaggaagagagtgtgctagtgatgatacaagcccccagctagccttggtaactggaatgggaagcattggccacctcctcctgagactgggctccaagccctgcttggtaatgcaggcaaaagcatgtgattcagacagcagcaaagccacagaacggcacgccaagttcaaagtcattgaagcaagtagtgtaagtgacaaaatttaaaagacagagacctctgtagaagaagccagggtacccagaattgacagcattgaaagctgggcttaggtggaaatgacaagaatctctgccctacccctagcaggaggtcctcggtgagtagcttataaaatgcccttctaagtccctaaaggagcccactgctggatcagccaaggctgggaaggtcctcgtgatcatgattgaggttctcacagtcttcctgccaaggctgctcttcggggcagacaaaatgtaccgggagctccgcgggtcatttgtgtttacattttttccctctttactgctcttgatgttcactcttccaaaattatcaagctctcactctagcctagttcaacagaaacatttctctacttccagactgtttagagcttcctctccagccagcaaaaggcccagcccattactggtgcacaggggcactgaccagcagcagcttggcttgtcctgtttgacggggcttggcctcattgcccttctgaaggaggcccaaatgcccatgtctattccatccccagatgccagcgaaattgcaaggtgttttcagtgacagggcaccttgcaaaagtgggagcatctttgcatacatcacctgaaatggggtcaaggaagaaaagattcatgcaagacccatcagggacagacactggtacccagtggatatcagctcatagcaattctgtgtgcactttgcagatcaggaaactgaggttctcctgagacacagagttgaaaatcagggggtcagttccccaaggtcccagcttcctcatcctttacactcaaatacattgcaagggcatctctctcactgaccccacctctcagaagggaatttgttctctcctttttcctcctccctcaaccactgattcaggaagaaactaataaactcatgatttgtaaagttttgttcctcagctcttctcagatacgcttcagttgaaaacacagtgttcattcattccagatttcccaagacacttccaatttcatgcaatgttataattgtaataaattcatttacttcaatttgtgacgaagtataatttcatttcatatcattttaaggtattgcatgtacacaaattcagaaactggaaagaatatgttttgttaaatgccatgccctgatttttgaattggaaaatataaaatgtgttccatctctgctgtgcatgcacatagcataacatgatcacaggaaattcttcaccttagttcttctttggtctggcttttttttttttttttttttgagaggaggttctctgttccaggcatagggagaactgttgtatatccctcattgcaggcacagccccggaatcttccagccctttcgccaaacagattcttcaccatgtggtctcagtttccctgcccgaaaaagtcaagatatgtttctcaatcttgtagcaacagctgctcccaccccaaggattcccctactcaaacccgagtgaagaatgaagctggtttctgttttaggaaccaaacaaagtcctgcccctcctcaggggcccccctttggactggctcccttccctctgtttggatagcccactctttccaaaccactgagtcatttcctctccgggactttctcattaaaatcttcctgtttgctatagttctggagcccctctctgagttaccgtttccttcctcatccccactgagctgattaattaatagcccagcaccgccctgcaatctctcccactgcggcgttccttcccactctcatgtcggctggaatctctacacttcgtacacatttgtacaaagcctcggagttcctaaagctgtgaggggaatggaggataccactcctctccggcaaggtattgcttgaaagataaattgggaagatgagtgcctagaaacgggcagcagagaaaaaaaacctaccaacagcttgtcccagagccgccaggcacagcaagtgcagcagttgggatacaggctctaattaatgcgctaggagctgctcgaccctgagcagccccttcctctcccagaagacagctgcggtctcctcgaagccccggtttggagggttgtgtgcacatctgagacctgctgaccctgacaacaggcaacagattgcagcaccaaggcagaactccatgggacagaaagacagaagacaccggggctctttcgttcagtgacggcgtgaagaggactgtcacagtcaacatggcaccttcattcttctattgggcttttttttttttttggcggggtcggggaggcagttctctgttcccggcacacagagaactgttgtatctttctcattgcaggcacagctccagaatattccagccccttctctaaatagattcttgatcaaatgaaacatcctgggctgaactgagggcagtgccatttttgcccagtgggtatttggtaaatgttcatggaagcaagtcaaactgaagttcaaaaagtacatgatttgcattcgttgaagtacaaaaaaaggtacataacaatagagatggactgcaaactcatccactgactcaacaccttccattatctattcatgttatcccattgcttctcattgtgaaaagcccccgggagatagtttgggggtgacgggtcattggctgtcccttaaatcccatcatgttggcaatccccttccccagtaacgtatgaggttcacatgatctcagagctgcacgtatggctctacagtaatccccatagcagcacattccacttggaaaagttgctttcaaagtgtacttataattgctaatcatcactgtagtctggcagcttccatggaagcgtgactggcatgttctggggctggccccttgccctctgattcacaggacacctgtctcagtcctccccaaaccccatcctgcttcctctgctctccacctcattcccacctctgcacaagcctggatcctgtggcacaagtgatccttccttctcctcctagatttccaaatctctccattccctgggacttactgcaaattgctaaactcttctccatttccaaataacttgttcctcctcgtgcttcccagggtcctccttttcatttcctcccagggggtaccactcatagcatatcctggtagtgatccaggggttttcattcacaaagaatacaacctgaatggcgacggctctccttgtgaaaagatgggcacacctgccccctccacaacaacctgtgtctctccttccctccattaccaacttcttacaagagcagcctgtagttcctcacccctccctgggtaaaagtcttcatgcatttcccactgtgaggtcagaggcctagtgttaattaaccctcatcctgcctacctgtctgcagcgtttgggacctgatcattcctgtttctgggaacactctcctcctctggctttcctgcttcttctgttccctcatggctcctcctcagtctctgaccagctctccttccagtcttctctctgaaatcttgatgttgctaaaagctgtttcctcagccaccttcttgtttttcacatgctcttccctgggcaacgtcatttactcccttggctttgattaaacttacacacttaaactgataacctttctgcttactaaattaaaaacctcttataattacaaagcagcccatgtatagataaacaaaaataagaaaataaaaatacactattcccaccatccagagcataccactgttaatatcctattgtacatccttccaaaatttttaggcatgcatatatatgcagacatatcttttttttacaaactgagaaaaataccgttttatgaattgttacatactgtttttataaaactttccatgtcaatatatgtcactatattttacctaatatccagtctatatctgatgatctaaatcattcccgaaacgtcttttgtagttcgtttgtccaatcaggaaccaattcaggcctacacattgcatggatatttcttaagcccttttccaagcataaacatgacattaggcttgttaaatgaatttggccatttagcctaaggaacaacccattttctggatttgacaagctgctttcttgtgggttcatttagcttgtttctctgaccttcttatttcttataaactgaaagtcaaatgtggccaggcgtggtggctcttgcctgtaatcccagcactttagggagctgaggcaggaggatcacttgagcccaggagatcgagaccagcctggtcaatatagtgagacctcatctcttaaacaacaaaacaaaagagaaagtaaaaggcaaaagcatggtggattcaatttaaaccttgttagctagattatatcataggagatatgtacttcttattgtattttgtcatgatatatatattttctggttcgcccactgttagagattctagtagtgaccagtgaattaaggcaaacaacaattttcttcttccaagaaacattatgttttccctcctgtgactacaaggtaatctgtgtggtgttatctgggcaatgcacaaatgttcagttccccctcaacaatgtgctaatgctttaataccagtttatacttgttgctgaagtcaatacttttaataaggcatttgtaaccacccactgggttcatttttcatggtgcccagatagagccaatttatcaagataggggaattgcaatagaaaaagagttaaatacacttcaagcttgctaaatggaagactgcagttttattattactcaaatcagccagcccaaaaattcagaggctagaggtttttaaagatattttggtgaacaaggggctagggaatggggaatgctggttggttgggttgaggatgaaattatagggagttgaagctgtcttcttgcactgagtcaattcctgggtagaggccacaggaccagatctgccagtttaccagtctgggtggtgccagcttatccatcagaattcagggtctgaaaaatatctcaagcaccaatcttaggttctacaatattatctataggatacaacattatctataggagagcaactggggaggttaggaatcttgtggcctctggctgcatggcttctaaaccataatttctaatcttgtgattaatttgttagtcccacaaaggctgtcttgtccccaggcaagaaggaggtttgttttgggaaagggctgttgtcatctttttagttttaatagttctaaactataaactaaatgcctcccaaagttagttttgcctatgcccaggaatgaacaagggcagcttgaaggttaaaggcaagatggagttggttaggtccctttcaatgtcatcaatttctcactgttagaatttttccaaaggtggtttcagtttagagcaattttcagccagagtttctggtttaagaatatttttataaaagagctatttactcaggtatgggcagggctaaggcaaccatctagggatcatgaagttcccaggggctagtgtcagtgggcggctatcgccagccctcatctgagggggcaggagaaaggaatgttcctcctggtgcctggggctagctacaaccctgggacaggagctgcccaacagaagctgtggctgttaacagaggaattcagttataacccaaatcatgaccaggcagggcactttaatgaagtaaaacttttctgatgactgttttctgtttcttgcgtgaaagacaattgcaggacaggggagattatacatcaggtattggagacaactacaatatgcccttttaatgtctgtctgtggaccaagtttactgtttgcatttgtagccatgggaaagaacaggggaaacaaggtggacacaactctcaggggaaaattggcccctggttgccaaagcacaggtgggggtagtgtgatgtgatgacgtttgcaatggataatttgtattagttaacagctctgggtcaaagctgttttgtctccatgcaagaagtaatgaaaaaaaaaacaatgttagttccaaggaaacatatcctcatccgtgaataattatttgctttgactccaggacacctttcatttaaaggtgtaaaggcacagagagggggaagtgaataatcactaactaaccttttatcaccataggagaggacatgctcctggtgctaactattatgaaacttcaaagggagtgattgtcaggtgcccatagttcagattattttcctcagcatgggaataaaacactgctgcttctcactcactacaggtaaaataaatagaactgataatgtgtattatataattctaccaagccttggagccagaaaacacattggtttcctctgtctctggggaagggtttcttattacattttcttctagttgacaagcaatttgggagtatccctcaattacatgggatgccccagtgtgggactgagaagaagattagattgtaggctgctctattacttactaactgggtggtcttgagtatgttatttaatcttcccaaaccactgtttacatccataaaacagtgataatcttcattcccctggctacaggagaacgagctttgatgaggcaaagtggataagaatgggttctggagtcagaaagagttcaaaatctaggttatgcttcttaccgattgagtgaaatggggcaaagtcacctaacctctaagccttagtttctccatctgtaaaataaagtaatagaaatagaaacaaaacagaaacacaagatagaaacaatgttgtattattttaaagattaaatgctaaaaaacacttaacacagtgctggcaataaataagcactcaatagtttgctattattatcagctgccctgtggtagacagaattctaaaacagcccctatattcctactcgtgatgcacatgccctgtatagttctattcagtgtgaatggaacctgtgaatataatgacatattactcttgtgaggaaaattatcttgggttgacttgacctttcaggtgagtctttcttcttcttctttttttttttttttttttgagacggaatctcactctgtttcccaggctggagtacagtggtctgcaacctctgcctctcgggttcaagtgattctcctgcctcagcctcctgagtagctgggattacaggcacctgccaccatgcccggctaatttttgtattctttgtagagatgaggtttcaccatgttggtcaggctggtctggaactcctgacctcagatgatccacctgcctcagcctcccaaagtgctgggattacggcgtaagccactgcgtccagcctcaggtgagtcttttaaaagcagagagctttcttcacttggtgctgggaagaagtcagagaggtgcactctcactagcctggagaaaatcaaacatccctgccatggcagcctatggggactacgtggcatggaatgtcagtggtctctgtgagccgagcatagtccccagcaggcagctagcaggcaaaggggaactcattcctacaaccccaaataattgaattttgccaataacctgaatgagcttggtagaggacctccagtctcagataagaactacagcatagctgatatcttgattgcagccttgtgagaccctgagcggaggagtcagctaacctgtgctcagactcctgatccacggaactggaaggtaataaatgtcttgttttaattcactgtaggtggtaatttgtttgaagcaatagaagactaatacactattcagagttaatcaacattgtttctgtggctcttgctgggtccatttctgttcctaattgctgttgtctaatgcaatacttggttgcataaatcatgacagtgcaagaatgacaagaggtgctgttctccaacacaacccctttagattgtcaatactctgtccgactgtcttctcctgctaatgggctggtgatgatcatgggggaggagaggtttatagacctttgtggcttcagaaaggaataaaaatatcgtcggggctgagtctttcctggaagatgcaactcgttatgcaaaagccctttcttcatagttgtttcctgtttgacactacaaatctctcaatttcaaagggcttatatgaacttcaggccaaacttagccagatgatctgttgaatagctttaggtcttcactgagcttgcagtatattggaaaaaggagacatcaaacaagtaattgcacaaacccagaattatcaactgcattgtgtgccttaaacagaaagcacagactctcagagaaacttgagcctgtggattcaggggaaacttttctgcataagaatggaaggatgagtaggagttgactaggccgagggatgattaagagtacatctcccaggaagaggggatggcttgtgaaaaggccctgaggcaggaagaggcatgactatttcaggaaacctgaagactggagaacgagcaaagagagtgaggagaagagactgtggggccatgctaaggattttggtctctccggtttgccctttcagaaaatcatccaggttgcaatggagaaaaagaaattgtagggagcaaggactgatggcaggaatactagttaggaggtaattgcaaccatgcagacaggagctcatggcagctatgactaggatcatggtggtggagacggagagaagttatatagatcaagcagatataatgttttatttttgcttttaccaatttttttaaaattgaggaaaacattttctcatcacttctactattctgtggagaattcacattcattcacatatttattcaacaaatacgtactgtgtgtcttttatgtgccagataccattttgggcataggaatataatcttgaataaaatagtcaaaaaatctctgctcccaaggagtttacaagggagttagacaacaaacaaggaaaaaaatatatatatatgtgacagcaataaatgctgaaaagaaagttgaaagttgacaagggggaatattaagtgttcaaagaaggttgcattatatgttatgtcctgacaagatctcactaagatgatgacatttgagaaaagatttgaagttggttagggatcaaggcatgcagctattggaggtaggaagactgagaggaagtattctagtcagagggaacagccagtgcaaagactctgaggtagagaggtgactggcattttccagaaggctggagaataatgggcaaagtaacgcatcagtcatcaatttcgcaataatgctgagtaacaagcaaactcaaaatttcagtggtatacagtaataagcatttaggttttcccctcagtctcaagatcagctagatggttttgctgatctgagctgatcttggtggggcttactcatgctttcacagtcagctgcaagccagcacagctttgctgatcttatctgagctctcttacatatctgagagttttgacaagatgactgggttgatttaggtctgcttccatatctctgtttctcatatcctccagtagcaaaagagagtcagagagagaaagggagggagagaggctagagagagagagagagagagagagagaacacacataagccctcttaaggcctaagttcagaatggagactgtcacttctgccacattctattggccaaagcaattgataagacaagtttagtttcaagggatggagaaataaactccacttcataggaagagcttcagagtcacattgcaaaaggtgtgaatatagtgaagggtggagaattaggaccagatttgccatcagtctgccacattgagttagtaggagatacagtcagagagataatggggatctagaaaatgtggggccttgtaggccagggtaagacctttggcttttactctaagatgagaagccattggagagtttccaggagaggagcaacacaatcctactctattttaatgaaatcaccctggctgtcagattacgaatagactgaagtggggcaggagaccagtgaaaaagacattccagtgatccaggcaagaaatgagggtggctgggccaggaaacatagttaatagaagtgctgaaaactagtcagattctagacatattttgaaggtggagttgtcaggatttgcttacaatgcaaatgtaggatgttagagtaaaagaggagaaattttggaaagagcaactagaaaagctgtgttgcaatgtactgagatgattaaagctatgggaggaggaggctgcagggggaaatattcttgaaaaatccccaactacttgccagttttttactatctttgaatgccatcaacttgacaggaagatttgactgaagtcagccagggactctcccacagtcctttctaccagcttagacttgggttctcacagatccagagataacctccactgtaacatactgcgcagcctgcttcatgtgtacagccagcatccttgtcattagctgtgacatcagctccgactggttgcagcacccactcttgtttcatcatccattctgattggtcagaaccttatttaattattgttctccatagcagagccaaaagaaacacaatgtgaatggaagtgcccctctttctaaaaggcaaagaccacgtcttatccaactttgcacttctagataaaagaaagtgaataagtctacttagattctctccattcatagcaaaagcatctcaagttgcatactctactaaggactgatgtaacatttttttactctgaagaaaaggtgcattgaaagataaaaatgattccaggcatgattattataattcaccaaatattctgtgcagaatttttaaaaaatccctgtatttgaataggtaaggtaaaagttaactattgaaaaggaggaatatttgtgttccttttgactccttaaattctcatcttggctcatggaggaggggattgacaccaaaatttcagtcctatcttaacatgagaggaagtgcagggagggaggctctgttacagtaggtagctagtcagacataagcatggcaggaaaggactccccttgccccaccaggaaagtcaggcgaccatcaggtgatggttaggtggttgttacaatatttctctaaacataacattaataattggttgtagccagcccagggaaaggcagtctcccaatagatagaaaacacctgaaaccggtgatcagcagcttcctgataagatatcaggagttgggcgggtaggctctagcatgtgcactaaggcaaaatggcgcaacttaactggtatatgaccttctaaggacatgcaactggtaagggaagaacgcctcaagtgagcatgtgtacaactccagtacaaacactgcgcatgctcccctcccagatgctagcaggctgttgcacatacggacagcccctcccaagggaagaatccgggagaaggaatgcaagaccctgggagcatgccaacatataaaaccctaagtcaaaaggtccaactgtgcacttgatctctcagttcgcccccttgggcctcttccaagtgtactttacttcctttcgttcatgctctaaagcttcttctttttttttttttttttttgagacggaatctcactctgttgcccaggctggagtgcagtggcgtgatctcggctcactgcaagctccgcctccgggttcacgccattctcctgcctcagcctcccgagtaactgggactacaggcgcccgccatcatgcccggttaattttttgtatttttagtagagacagggtttcacagtgttagctaggatggtctccatctcctgacctcatgatccgcccacctcggccttccaaagtgctgggattacaggcgtgagccaccgtgcccggcctaaagctttttaataaaccttcactcctgctctaaaacttgcttcagtgtttccctctgccttatacccctctgtggagttctttcttctggggagtcaagaagtgaggctgctacagacccatatggatttgtctgcctccctcagacaaaaatggcaactctgggctgggcatggtggctcatgcctataatcctagcactttgggaggccgaggcgagtggatcacttgagctcaggagtttgagaccagcctgggcaacatagtgaaaaccttatctctaccaaaaaatacaaaaattacttgggcatggtggcatgtgcctggagtcccagctactagctgagaggtgagagaattgcttgagaccaggagggcaaggctgcagtgagctgagatctcaccactgcactctagcctgggggacagagtgagaccttgcctcaaaaaacaagcaaacaagcaaacaaatggcaagtctgattggcaaatgtgtaatatttactaggacatgctttattaatgggtaggaattgactctgcagagtgaaaccagcccaacgcattcccttcactgggagcatgctgccaaggtgtgggccttcactctgtcccattgcggttcatttatgaagcagccttagtccttgcaactggctatagctggtgaatttgggtgggctctgcgtacctaactcttctctcagatacatgaggtgagcagttcccaaagtctagtttgggtgaagagtaggaggcctcatttgacctcagccatgctctcttgcatgcagaatcacttggccagtgccccatctagctcccttgtgtgagctccccatcagtcagagatgacagggatgagtcatctctgaagaacttgaagccctaacatcagcatcaagcccaactgagatatttaaagaactaggattttctctcatgttaatcctcagcataatctcccttctccttttttttttctgcttctagaatagtccttctttatccctttatttccttttctgaggcatatttaatagaatgtgaaattgcatatttattaatgatggcttttttggtttcaagtaacagaaacacacttgagctctccaaaagcaaagagatataatttagtttaagaaataggcctgtctcaaaactcaagggcaaataaatagctgaacttcagaaataaatcagagcctccagcgtagtcaggacccaccctcccatctctagggtaggtgaccacacatgccagtatgtgccggcctatccttgttgacatctgtcaccctgcccctttcacttttgtgtcagtctttgtccatgagggggcagaaaccacagtgacttaaacagagaaagtttaatataaattttttaaaattatgttaaaagagcaattataatatataagataactctatgtggtaccctaaggctgagtacccaagagagtacccaaggagggatgaacataaaacataaaacaggatgaacataaaacaggatgagcccttccccaaggctcagattgcaaccactggatggcagagaagtttgctgatttgcccaggccagagctggtctgcagccactgggcaagcaggaagcaaccctctggggcacaggtggcacattacaaaaactgcagccaatggcttggcacgtgagcatgcagagggagtagggacaccattgcagacaaggaggtctggagcctgcagtgtctgtggtaagaaggccatgggaaagtgggcattaggccaggacagagctgcaaggacatcaaggaatcatgagttctgggcctgtggctggaattagaacaccactgatgttcccacacccacactgctgcctgatggtgcagccaccactaacaccaggaaggctcctttctcctgtaatgtcccatcagggccctctactgagaaagcttcacatggtgaatgatcaaatcattttttctctgtaaagaagaaatgcccaatggaattccgtccattattgcagagcaggtattgaagggtgaatttgaatctgaaagtcagtaaattattagcacaactctcaacagtaccctggtaagaatgattaattcccagaagagtgaaatccatagggaaaggaaatagaataatagttgccaggagctgtggggctgtgggaatggagttacccgttaatgcttatagagtttcagtttgggaaaaggaagacattttggagatagactgtagtgatggttgcacaaaaacgtgaacataatgccactgaattgcatgctcaaaaagggttaaattgtaaattttatatttggtgtattttaccacaattttaaaaatgatgaattcctggtcactctattcatctctcatctctgctcttctctgaacatctacttcctttttcatttccgtttcttagaccacacactaaaaaatacagccaccaacagctcctggagttacctctcctttgcttaagaaaccagacggatggccgggggcagtggctcatgcctgtaatcccagcactttgggatgccgaggtgggcagatcatgaggtcaggagatcgagaccatcctggctaacatggtgaaaccccatctgtactggaaatacaaaaaattagccgggcatggtggcgggtgcctgtagtcccagctacttaggaggctgaggcaggagaatggcatgaacccgggaggcggagcttgcagtgagctgagatcatgccactgcactccagcctgggcaacagagaaagactccgtctcaaaaaaaaaaaaaaaaagaaagaaagaaaccagccagactaagtgctgcactcccatcattctctctttcaaattgtcctggaagatctgcagcagctttggtccaatgctcactttggccatttgggccagtgtcatggtcatatggtatagacctgttttcagaggagtttgtttgtggagggggaagggaaccacactgacaaaaccagaggaatctactataatcatttaatgactcctctcccctccagtcttccaactaaataaagaagccaggaaaaagtgaatattaaaaaattcacattaagagtgaaaccaatagtaaaaatcatgtcagatcagtccattttttttcttctctccacctatgttagtagtatgaatcagtaagagaggcatatggcagaataatcagaattatttatcaagctaattaaccatagattgtttcctaagtagtcacaaaatggcagaaatctttatatatatagggagacatagtacttgtattaagataattaaaaattatttgtgattgttactgtgattatcatttttttatctttgctagcacaactcctcaaactgatatatattcccatcaggtgctttagagaagcactggcctttctcttgacaggcagtgtgcattttggcaacagattttgaatggaaaaaatacaagcttttcccaagccctaaacacagaatatgccatctattagtttggatttcttccttaacgatcactgtaccaatatgtggtggtttttctaaggagaaatcgatccaaatctttctttggactcagaatccaagaagcctgagttttatccctggcttggtcacagatgcactgaaaatgggcaagttacttccgtctttgtctgaatttctccatctggcaaatgtagattctgacactcaccatcagataatgtttgcaaaatgtttgatggtccttgctggtaggcagtatgtaattgcaaactgttggttcattttttttctgtcctaaaaattcttctctttcttgagaaactatttttaaattaaaaatatcacttttaaagtatgagcacacagtaataaaaattcagttggtactggagagtaatttttaaaaaagtaaaggttttactctttggcattccccagaggtaatagcttaaaatttttctattttgaatctttctaaggccaacctctacaataataacattattcctttactttttatatatcaacttcaaagtatgtctgattgctggacccccttgtgaaagatgaagctcttggctcatttatacttccccttcaacagcaacttccagatatattttgtttttgttattcttttagacacttctatagctttatacaatatgttcatctttcaatttcttttaaaagacttatttttaattatgggtacataatagttgtatatatttgtgcatgtgatattttgatacaagtatccaatctgtcatgatcaaatcatggtaattgaagtattcatcacctcaagcctttatcatttctttgtgtaaggaacattccaattctactcttttagttatttaaaaatatgcagtaagttattgttgactgtagtcaccttattttgctaccaaatactagatcttattcattctaactatattattgtacttgttaaccatcctttctttacctccccctcctccacactacccttcccagcctctggcaaccatcattccactctctatttctgtgagtttatttatttatttatagctcccacatgtgagtgagaacatgcaatatttgtctttctgtgtctggcttatttcacttaacacaacatcctccagttccattcatgttgttgcaaatgacaggatttcattcgttttattgctgaataatattctaatgtatatattccccaccttttctttttccatttatccattgatgaacacagtttgcctccaaatcttggcaattgtaaacagtgctgcaataaacatggaagtgcagctatctcttcaatatactaattccctttcttttggctatacacccagcagtgggattgctggattctatggtatctctatttttttttttttttttttttgagatggagtctcgctctcttgcccaggctggagtgcagtggcacgatctcggctcactgcaaactctgcctcgcgggttcacaccattctcctgcctcagcctcccaagtagttgggagtacaggcacccaccactgtgcccggctaattttttgtatttttagtaaagacggggtttcaccgtgttagccaggatggtctcgatctcctgacctcatgatccacacgccttggcctcccaaggtgctgggattacaggcatgagccaccgcacctggcctatggtagctgtatttttagttctttttgagaaacctccatactgttctccatggctatactaatttacattcccacaatagtgttccagggttctcctttctcagtatcctcaccagcatttgttattgcctgtcttttggataaaagccatcttaactggagtgaaatgatatctcattgtagttttactttgcatttctctgatgattaatgatgttgagcatttttcatattcctatcagccatttttatgtattttttaaagaaatgtgtatttagatagtttgcccattttaaaatcagattatgtttttttttttcctattgttgtttgggcttcttatatattctggttatcaatcccttatcagatgggtaggttgcaaatattttctcccattttgtgggttgtctcctacctgtgttgattgtttccttcgcagtgcagaagttttttaacttgatatgatcccatttgtccatttctgcttttatcacctgtgcttctgaggtctcactcaagaaatctttgtccagaccaatgtcctggagtgcttccctaatgtttccctctattagttgtatagttttagtcttagaattaattatatagtccattttgatttctatttttgtatatggcaagagataggagtctagtatggtgagagataggagtctagtttcattcttctgcatatggatctccagtttccccagcaccatttattgaagagactgtcttttctccaatgtacattcttggcacctttgtaaaatatgaattgactgtaaatgtgtggacttatttctggttctctattcttttccattgccctatatgtctgtttttaagtcagcaccatgctatttaggttactatagctctgtagtataatttgaagtcaggtaatgtgattcctccagttttgttctctttgctcaggatggctttggctattctgggtcttttttggttccatataaattttagatgttttttctatttctatgaagaatgtcattggtattttggtagggattgcattgaatctgtagattgtttagggtactagagacattttaactaaattgagtcttccaatccatgaatgtagaatatcttcattttgggttgtctttttcaatttctttcatcaatgtttcatagttttcattgtagagattacttctttggttgactttattcttggtattttattttattcgtagctattgtaaatgagattactttcctggtttctttttcagattcttttctgtgggcatatagaaatgctactgatttttgcatgttgatttttttatcctgcaactttactgaatttgtttataggttctaactgttttctggcagagtctttaggtttttctaaatatgattttatatcgtctgcaaagaaggataatttgacttcttcctttccaatttggaggccgtttatttctttcttttgtctaattgctttggctaggacttccagtactatgttaaataggaatggagaaagtgggcattctcatcttgttacagatcttagatgaaaggctttcattttttccccattaaatataatactagctatgggtttgtcatatacggcttttatcatgttgaggtatgttccttctatactcagttttttaagagtttttgtcataaaggatgttgatgttgaatcttatcaaatgcttttttggaatcaattgaaatgatcctatggtttttgtccttcattttgttgatattatttatcacatttattgatttgcatatgttgaaccatccttgcatccctgggatgaatcccacttgatcatgatggatgatatgtatatatttttttcaagatggagtcttgctctgtcacccaggctggagtacagtggcgcaatctcagctcactgcaacctccgcctcccaggttctagcaattctcctgcctcagcctcccaagcagctgggattacaggcacctgccaccacacctagctaatttttgtatttttagcagagatggggtttcaccatgttggccatgctgctcttgaactcttgacctcatgatctgcccaccttggcctttcaaagtgctaagattacaggcatgagccaccacgcatgactgtgatgaatggtatttttaatgtattactgaatttggtttggtagcattttgttgaagatttttgtatctgtgttcatcagagatactggcctgcagttctcattttcaactttccatttcttgattcattgattttagccagtacctcttgacttgcctctaagacaatgaaggatttaacagccctaccttcctgtctctgtctcctcccctaatggctattcccaatgtcacagcttcagttcatcacatagttaattttacattgccaaaatttatagaagttatactttcctatataattatactttctttttctgtgttttggctgtttgttaagtctaaaagtagtcagaatttatattttatttaaaagaatattactatacactgtataatcaattccattcaattccaataaaaatatttgtttattacatactttgggccagacactcttctaagtgctaaggatacatcactgagtacaacaggtgaacatcctgcctttaaagagtttacattttaatgtatggttagactcatagaaaacatgatgcaactctatgtcatttaaccagtgccaatagaaaaataaatgaacatacttaaattgggagaaggagagaggaagtagagaaaacagggtgctgaatttttataatatattattagatatgcctttactttctgtctatgataacccagaatcctcagcattttagaagaaatgtatttctttttcttaaagatattctttccaaggcctcctgacttgccgatctaatttgctgttttcaatttcatcctgctgaaggattctttgtttagtttattgtaggggttttcttgcttttgcttttcccggttttattttgtattgaatggctaggttggttgcttttataattccaggtctttctcttttatttatactgctggaataaattctcaaacaattatttcaagaagtatcatatattcagataaggactttattttcaccatttcattatcccatttggtcgatagtttttgctgggaatagaattatttattaaaaatccatttctatcagaactctgaaggtattctctcacaccctgaagaaaagatcagatgccaacctgagttttgctcccctgaggctatcctgccctcctatcaacccataagtattacatattcttttctttagccttggcaaaagaaattttacaaggatatatttaagtgtgggtctttttataaaactaattttgctgggtatattatagttgccccctctcatgagacttgcctgtcttcagctatggaaaaatcccctttattctatttatttatttatctatttatttaacttttactagtcatgtgcagtagtgagaagcaggcaaagagtagaacaaggagtttgatctgtaactgactgaacaatcaattgaaataactcattaccctcagaccagcctttctttgttctttgtttcttggacaaattcctagccttttggaaatcatactgggtagatgtgggccttcttatattgcttctccatatttattcactcttctcataattcatgtcttagctttctctctctctctctctctctctctctctctctgttctgggaaatttatttaactctttggtccagtctttccattgaattttttattttaacaatgacatttttaatttccattaattctttcttattctcagatagcagccctttttaatttaatggatgcagtatcttattcgtttaaggttatcttctcttctttgaaccatctgtttcctttgcgtcctttgctctgctatccataggggtctttgccttttgtgctgatcactttctctccctgtgtatgaaggattggactgattgcctcagatagctgatatgggttgcctctgccttttagggcctactcatcaataagaaggctggcctcatgacctgggtatgatttcagggtcctggttccccggcttcactttagggcatgtgggcagagggctaggccccactgcctccctattttacactgccagaagaggctctgctgtgaggagccagtccccactctgcaagccttgtaccctctagagtgtagttcttggttttagcatgagggcagtgcccccactatagtctgggagctggttgtgaaagaaggtgaggccaatctggacaaccatcctgtaaacaagtctccaaccaagcccccaattttgtctcatatccatggattccagtgtcacagtcttgtgaaatattctgaacttttacaatcttcttctacgcgtcttctaagctgtgtctccctttctcttatttttctaccaataaaactcttctgtcttccattccagatgtcagtaaaaatcttcctccccctcatgcacccacctcttattttcaatgtctttctgaacatattcctatttatctcttttctaacatttcaaaagattttaagagcaaaaaggaagatagagatgtatgccctacccagcatcttgtatcagaatctcctttctttttcccttataagatactgaaaatatcaccttaaattgtgtttcattactgttgttttcaagtattgaaaagagactttttgtcttgaataagttggtggctatttttgtctttatttctgtcatagcaggtgccagtccaattgtgaatttaaatatattatctcagtaactgggttcaaattatgggatgtgtccagcgctgagaattgagggttaggcaagaacctctgtcttctgaaaaataaaatgttcaacatgtggggtatttgtttctgagacacaagtctaagagtgcagagttgtggggtttttcaactcaagtgagtgtccttccttggatttggtagtggtttcttagatatgtcaccaaacacacaaccaaccaaacaaacaaacaaaacctagatcttcattaaaatggaaaacttttgtgctttaaaggacactgctttatctgaatatttgtgtccctccaaaattcataggttaaaatcttaatccccaagataatggtattaggagatggggcctttggaaggtaattaggtctcaagggcagcatgtcatgagtgggattactgcccttataaagaaggcctgaggattccctgcctcctccaccatgccagattacagtcaaaacaaaactatctatgaggaagcctcgctagacaatctgccggcaccttgatcttggagttccaatctccagaactgcttgtgcgttacccagttttatagtattttgttttagcagcccaaatagactgagacagagacagtaagaaagtgaaaagacaacccacaggaccatgtgcagtggctcacatctgtaatcccagtgccgaggtggctggatcacctgaggtctggccaggtggattagcctggccagcatggtgaaaccccatctctactaaacatacgaaaattagccaggtgtggtggcacatgcttgtcatcccagctactcaggaggctcaggcatgagaattgtttgaacctaggaggtggaggttgcagtgagctgagctgagattgtgccactgcattccagcctcagcagcagaatgagactctgtcaaaaaaaaaaaaaaaaaaaaaaaaaagacaaaccaccaagtgagacaaaatatttgccaataatatatttaacaaggcacttgtattaataaaaagacaatccaatttttttttttttttttgagacagagtctcgctctgtcgcccaggcgggagtgcagtggtgccatctcagctcactgcaagctccgcctcccaggttcacaccattctcctgcctcagcctcccgagtagctgggactacaggcacccaccaccatgcctgactatttttttgtatttttagtagagatggggtttcaccatgttggccaggatggtctcgatctcctgacctcatgatccacctgccttggcctcccaaagtgctgggattacaggcatgagccaccacgcctggctgacaatccaatttttaaatgggcaaaaagtctgaatagacatttctccatgtatccaaagatacgcaaacagcaacaagcacacaaaaagatgcttaatatcattggtcaacagggaaatgcaaatcaaagcaacaatgagatatcacttcataccactgttatggctagaataaaaaagacagataatgacaagaattggtaaggctgtagagaaattggaatcctcatacattgctagtgggaatagaagtggtacagctacttaagaaagtcaagcagttcttcaaaatgtgaaatagagagttaccatatgatccaaaaatttcacttctaggtatatacccaagagaaatcaaagcatacatccacactgaaacttgcatacaaatgttcacagtagcattatttatagtagccaaaagctggaaacaatgcaaatgtctattaattgattaatggatgaataaaatttggcatatccattcaatggaattttgatttatttatttatttattttgagactgagtctcgctctgtcacccaggctggagtgcagtggcacaatctcgggtcactgcaagctccaccttccgggttcacgccattctcctgcctcagcctcccgagtagctaggactacaggtgcccaccaccacgcccagctaattttttgtatttttagtagagacgggatttcaccgtgttagccaggatggtctcgatctcctgacctcgtgatccacccgcctcggccttccaaagtgctgggattacaggcatgagccaccgtgcctggcctattcaatggaatattaatggcaataaaaaagaatgaagtacggacatattctactattggggcggaccttgaaaacatgctagctgaaagaagccagtcacaaaagaccaatattgtttcattccatttatatgaaacgtccagaacaagcaaatctatagacagaaagtacgttagtggttgcctagggctgggcaggatgttaggtttaggggtgatagctaaagggtacagagtttctatttggtgataaaaatgttctaagattgattttgatgatgtttgcacatctcttgaatatactaaaaatcatcgaactgcacaattaagaaaataagattgaatcaggaggccattttgagtagggtttaagaatacagactttggaatcaggctgacctgagttcaattcctggctttactacttactggttgtatgactttactgaggtactaattctcactgctcctcaattcccacatctggaaagcaaaaataatgatatcagaattggagtgcacgtgtatgggcacacaccccacacacacgcttctcaaaatggccagaaagtgttttgtgaaagcagaatggtggaggccagtcaagtcttcctcactccttctctgcaacaacatacccctctccaacactcgccttggtgcggaagcagctatgtcctgctttatcctgaggtgcttgactcaggggagagaagacagatctaattcagtgagaaaccaactaattgtcaccttctcttggtcctttcttttcctctgacttttatcaatcccagtcccatatgcataaagtcccttcctcaaatttgaaaaatggataggggtgaaagacagcaaaaaattaactttaaaaatatctcactattttgatgttataccccaggtcccagggacagagtagacaaggactggacatttatcaattacaaactccaaggctaggataagttacttcaatggttgtggaaattacaagtggtacttagatgctagctgactttggcaaagaccaagcagattaatcattatggtgtagtacaaagtctagatgaaaccaagtcagcccagtaattctagctggagagggcatgtaaacacttcaaaaacaatcaggcaaaaaaacataggctgtggggaatagccatttccaaagccacagaaaacttacggatgagttttctaagagaatgttttatctcaagccaaatagacgtaccattaaagcaccaagcctatagcctgctggacttaccaatccatacttctcaataaaggaccactcacccaaaaggaaaaacatttccaactcctttctttacctaccttactctgatctaaaattgactctactgagaaggcaaggaagatgtgactaatagtttggcaggaagcaaatccaccctacagtggcaatctaggattggtactagccatcaggatggttggttcttagcaagatggtggtgacatagagttataaaatttctaggttaaagcgaagataagaataatgaacatagtgatgataatacaataatcatagcaaacatttattaagaacttactatgcccaggaagtattctaaatacttcatgttttaacccatcaaattccaaccataaccctacaactaatattctcattatttagaagacaaaacttaagatagaaaccagcctcttatttggtagcacctagaattgaggccaagggaagtaaagagatcttgcatataattattgaagtttgttttatttgccttcagacttccttcttcatgaattcatcttttctctttaccgtatttcaggttctcaatcctttttatttattcatttattttaaatagagacagggtctcactatgttgcccaggctggtctcaaagtcctgggctcaagctattctcttgtctcagcctctcaaagtgctggtatcacagatgtgagccaccgtgcctggacaattctctttatttataaagaaacctggccgggcacagtggctcacacctgtgatcccagcactttgggaggccgaggtcaggagatcgagaccatcctggctaacacggtgaaaccccgtctctactaaaaatacaaaaaattagccaggcgtggtggcgggcgcctgtagtcccagctactcgggaggctgaggcaagagaatggcgtgaacccaggaggcagagcttgcagtgagccgagatctcgccactgcactccagcctgggcaacagagcgagactctgtctcaaaaaaaaaaaaaaagaaacctgttttcatgaaaacatcttatgtcagccatttatcctttactcatcaaggtcactaacatctaagtgatattggtgcaaaacccaatgtttaatgtcttcctcttgcttgtcccataggcagtgtttttttctttttgtttgttttttagaatttcaaattttattatagactaaagggtacacatacagttttgttacactgagtaatgctgaggcaactgggtaaattgagtgatgctgagacttggggtcccacatggcaaaaggaatgcacaagctccctcaggcctcttttataagagcactaatcccaattcatgaggtggcgctctcatgacctaatcacttcccaaagcctccatctcttaatatcattgcattggagatgaagtttcaacatgtgattttttgtggggatacatgaatattcagaccacagcaatgtctgagacatctcaaacttactatgaccaaaaccaaagacgtaatttcctttaccaaacctgcttctcccacagcctttccctgtatcagtaaatggcaactctgccattccttttttttttttttttttgagacagagtctcgctctgtcacccagactggagtgcagtggtgcaatctcggctcactgcaatctccgcctcctgggttcaagcgattctcctgcctcagcctcccgagtagctgggattacaggcacctgccacgatgccaggctaatttttgtatttttaatagagatggggtttcaccatgttggccaggctggtctcaaactcctgacttcaggtgatccgcccacctcgatctcccaaagtgctgggattacaggtgtgagccaccacgccaggcctacctctgcccttctaggtgcttaggtgaggagtcttggagtcatccttgactcctctcttcatctccatatttacataaacaaatcctatggctctacaatcaacacagatccacaacttaatattttgctcaccatctcacaattgctgtggtctggtccaagcctcaaccttcctgcctggattgttgtgacagcgctgaaaacagtttgttcttccacctctgccccactgcagcatatagagtgaaattttgaagccatgaagtcaaaatcctacaatagcctcatatgtcactcagtcaataactgaattccctcaatggttcataggctgtacatgcttcgcaggtttcctaacctcacccaacaatccctctgatctccttctcgtacagtatctcttaattcacttgctcttggtctccttgttgcttttgtgtgtatcagtcatgtcactactttaaggtctttgcacgtgctatctctcagtctggaacactcttccccagataaacgcatggctagcatcttctcttattttaggactgtgctcaaaaatcattagagaagccactcaaaatgattagaaaagaagccactgaatataaatgacaacatatcacttctgcattcctgatcccctttctcttgatttgttgtgagccgtagcaattataaccacttgattattatatgtttaattgtttattgttggtctctccatattaactctaaaccacatgaaagcagaaactttgtttattttgttcactgtaatatccccagcatctcaaacagcacctgtcactgttaaatacgtgaatggataaagttaaatcagagtgtaacctatcacaggactacttgttattaggatttaccttaataataaaataataaaatctgcaatttactttattgcagaaataaagacatttcttctgtcaaagaacttcaggacctaaatatggtgagggtgaatgtatctgtggaattattcttcatggggtccctaaccctaccttcatattgatttatcctgaaaactgtttctttaaagattcacttataaattaaaatcaatgatagaaggatgaccatatttctttggtttggtcagggctttttcaggcgttaaaatgtgttgataattgcggctgtgtaactatctgttgacttgactagagtccttgtgacatctgtatgttttgggaaatctttttttttttttttttcacatcccttgaggaaaaacatgaagacctgagagtacagtggccacagctattctctgggaaccaacttaagggctgtcttccttttaaaaagcacaccacatatacccactcctattatgaatatgatagccatgagtgtgactgccatggagacccagctgcaccacagacctcatgtcagatgaacagacagttaaatgaatgaatttgctgaagagactgaatgtttggtttgcttacagactgtttttttaacctttgcccattcagcaactgttagtaactgttttgtctccttaccccacagtacagttggtcctccatatccatgagttctgcattggcagattcaaccgtgtattgaaaatatctgaagaaaaaggatggtttcatctgtactgaacgtgtatagactttttatcttgtcatcattccctaaacaatacagcataacgactatttacgtagcatttacattgtattaggtactataagtaatctagagatgggccaggaacagtgactggcacctgtaatcctagcattttgggaggctgaggtgggagggttacttgagcctaggagttcaagaccagcctgagcaacatagtgagaccttgtctctataaataattaaaaaattagccgggtgtggtggcgcatgcctatggtaccagctactagagatactgaggtgggagggtcacttgagccctggagactggagctacagtgagctatgatcatgcgactacactgcagcctgggcaacagagcaagaccctgcctcgaaaaaaaaagtaatatagagatgatttaaagtatatgggaagatgtgtacaggttatatgcaaatgctacatcatgttgtataagggacttgagcatccatgggttttggtatttctgagggcgtcctggaaccaatcccccatggacactgagggatgactgactgaattgtgtagggtcaagcttccactattgagcatctgacttgtattacacttctcctttttgatattcatgtgagtgggcttgatttgggtaaaaggaaaggcagatttccatgagttccagtttccaaggagaaggggactctgttgacactgcactctgtgacacatcacctccactaccccagaggtcacctaccaatggctcccacacaccctgattggctcctatggctctgcctgaggacactgtctggacataggcctaaatttggccacgctcccatatgctcttaggagtggggcaggcccaatgcgccagcgagcccatgctgcaggaggagccctcaaccaacagagatgggagttgctgaacaagtaactcagctttttgtcctctcagggggacagttctggggtgtttttcatccattttctaagaatgtacccagaaatattaaccctgtcacccatgatggcaacctattcattaactcccaatgtattggctttactctctttcatgtcttattttcccactccctcaatgtccttcttggactcgcctcccaaagaaactacttgtactgaaaatcttttctcagattttgattacagggaacccaaactgaggtggggcatatgttcctacttgaagtggcctggtcctactcttgctcttggagaggacaagcacttagagctacagaatatctgaagtagcagctgttgctgccactgagctgcgtgaagtgatatggcagggtggaaactgaccatgtattttatcagttgcatattaaataaaattacttgttggttaatgagtaccaaagacatgatactcatttcttcacatactttattgatttaaatagatatgtaagttatcaatatgaataacagagcaatgcatgttatcattggatgatgataagatttgttgtctgttatacagcacttttaagagataatggtcatttgtgaatttaatttatgctcaatatcattagccatcagggaaatgcaaatccaaactacaatgagatatcacttcacatccactagaatgactggaatgaaaaggcgcagacaataacaatgttggtgataatgtggagaaattggaaccttcatacaccactggtgggaatgtaaaatggatcagcctctttgaaaaacagtttggcacttcctcaaaatgttaaacatggagttagtgtatgacccggaaattctattcctaggttgacacccaaaagaaatgagaacatgtgtccacataaaaatttctacatgaatattcataacaacattattcataatgaatggcttaaagtagaaacaacccaaatatttatcaaccagtgaatggataagtaaaatggggcaaatccatatgatggaatattatctggcaatgaaaagaatgaaacactgatataggcaataacattgataaaccttgaaaaacccttgtgctgaagtatccagacacaaaggctatatattattctatatttatgaaatgtccagtatagaaaaatccgtaaagacagaaagtagattagtggctgccagggctgtgggtggggaaaataaggtgtgaagctaaaggatatgtggcttctttttgagatgagaaaatgttttaaaattggttttggtgatggttgcacaactgcgaatatactaaaaaccattgaatttacactttaaatgagttagttgtataatgtgtgaattatatatcaataaggctgttagtttttaaaaagtagaatgatagaaaaagttataccatgcaaaaactaataaaaggaagctgaaatagacttcagaacaaaaatattatcaggaataaagtagggtattttataatattaaaggcataatttcattatgaagatatgacaatcctaaatgtgtatgtacccaaagatagagctttaaaatacacgaagcagaagttaacaaactgaaaaagaaatagacaaatccacataaatgtatggggatttcaacatttctctctcagtaattgagggagtaagtatatttaaaaaaaaaccagggatattaaagtcataagcaactttgtcaaccaacttgacctaattggcacttagagatactccacctaacaaccagagaatacaaattctttttcagtgtacttggaacattcactaaaataaagtatttgttgggctataaaacaaatctcaatcaatttaaaacattgtaatcatacagagcattagacaaaatcaatgagaacaaaagctagttctctcaaatactcaataaaataaacctctaaccagatggataaggattgaaaaagataaattacgagttatcaacatcagtaacaaagagtagatatcactataggtctttcagatattaaaaaaataaaaaggaaaaaatttttagaaggaggtatgggggaaatcttcatggccttcagacagtcaaagatttcttacataatttttaaaaaagcataaactttaaaataaaaaagataaattaggctctctcaaaattgaaaattcctgctctttcaacgatatcattaagaaagcggaaaagcaagccacagacaagaagaaaatattttttcaatacatgacaaaagacatatccagaatacatttttaaatctctcaactcaatcaatagagaaaaacagtattaaaacagggaaatatttgaacacacatttcacacacacagaaatgatataagaatgctcaataagcacatgaaaaatgcttgatcgataataaccaggaggccaggcgtggtgacttatgcctgtaatcccagcactttgggaggctgaggcgggtggatcacctgaagtcaggagttcaagaccagcctggctaatattgtgaaaccctgtctctactaaaaatacaaaaattagctgggcataatggcaggtgcctgtaatcccagctactcaggaggctgaggcaggagaatcggtggaacctgggaggagaggttccagtgagccaagatcatgccactgcactccagcctgggcgacagagtgagactccatctcaaataataataataataataaccagggacattcaaattaaaaccacaatgtgatgccactacaaactgactaaaatagcttaaaatactgacaagtgttgcaaatgtggagcaactagaattctcatatattgcgggcgggaaagcaaaataatacaaccactttagaaaagagtttggcagttccttggaaagttatacataccacacaaaccaaaaattctatttacttaagagaaatgaaaacatattttcacacaaaaatttgtatacaaattttcatggcaactttattcatgatagccaaaatctgggggaaaaaatccagtttccatcaagagtttgtataaacaaactgatatattgatacaatggaatactactcagtaataagcagaaatgaactactgatatatacagcagcataggtgcatctcaaaaaacattatcctgagtgaaagaagcaagacacaaaaatgcacatactgcatatttcattttttaaacttgagatgtgctttgagtctgaattttgctgattgcctatccgtgttgcagttcaacatgaacatgtatgtcttgcaaattggaagctggatccaagagcttgatcacactcagatttgatgtctttggactcaaatggtggcattttttttttcaccgatgggcacgtaatgtctagttattgctcttggatgatgttaacaaaatgatgattttccaatctgtcactatgctggttggaataatttcataaagagatactccttctcatctactatttgattttccagtggtacagttcttttttttatatatatactttaagttctagggtacacatgcacaacgtgcaggtttgttccatatgtatacatgcgccatgttggtgtgctgcacccattaactcatcatttacattaggtgtatctcctaatgctatccctcccccatccccccaccccatgacaggctccggtgtgtgatgttccccttcctgtgtccaagtgttctcattgttcaattcccacctatgagtgagaacatgcggtgtttggttttctgtccttgcgatagtttgctgagaatgatggtttccagcttcatccatgtccctacacaggacatgaactcacccttttttatggctgcatagtattccatggtgtatatgtgcctccagtggtacagttcttaaaggaaagcaaggataagcatttgatgattctttctttttatttaatctgtttccatagtaacgctttagttgtttatcatacaattagttgttgttgttgttgttgttttttttttagaaacataagttatctgttgcccaggctggagtgcagtggcacaatcatagctcactgcatgtccaactcctaggcccaagggatcctctggcctcagcctcccaagcagttgggactacatgttgcacaccaccacacctggctgacttttaaaaaaattttgtagagatggttgggggtctcaatttgctgcccaggctggtctcaaattcctggcttcaagtgatcctctggcttcaaccccccaaagcactgggattacaggtgtgagccatcacacctggccctaattagtttttttaaatgtctgtagaaatgcatggactcaaagatatttaatgggttccaatttattgcaattcttatctttgttgaaagtcaaattgttctatcttcggcaataagaaatgggaatagaatagagtagagtagagtggaatgggcggaacggaacggaacagaacagaacagaacagaataggtgaacctcattgagttagcttctgagcctttacacaggactctagtggttttcttaatagtttccttggtatgtagtatatcaagatgtttcagattcatcttcttcatttgctgcctcatatctagaatcaacatattcaagaaatgttgatttctttgaatatgcaatggcatttgaagaccacaatcttagtacagatatgcttagtgctacttacaaaagatatatccagaatatatattttaaaactctcaattcagtcaatagcaaagaagaattaaaaatggggtaatatttggacagacattttaatgaataggtcatggcttctggccttttcagtggacggatggatagatatagttgggtagaatatgttgtgagtatgtgctatttattctggtgttttcattaaattcagaaatatcggatttttatttaacctcttctatactacatctccattttctttctttcacactgacaatcccagttctgaaggatacaggggaaaatacagttagaatgctgtataattattcatttacattctctcatatgatacacataacaatcagagaaaagcaatattaatacaaccaccaccaattataatgactaaaaaacagtttaaaacattattgaatctgtcattcctattttttctactttttgtgcatacaaatgtaatcttttcatatactctcagggcttatacctatcttgaagccagtatatgggtcttaatataaaaataactattcttcaatttagttatcttacaatctctcctcattgaaactcaggtatggctaggatacactttcctagtgtagtcacataaggaaaagcctttttcatgcatcactggttaaatagaccatctttggccaagtgtttgcagtgctacctctgtcatatattaactttccatatatgtaaacatctgtttctgagctctatttgtctatctgtgtgccaacaccacatagtctcaataagtattacatctggtggagcaagtgtccctgcctggtagaaacaaacacaaattctttctgaaggggaaaactttacaaccaagtctcagagaaataccatagttaaagttccatgccttacacatgcttactgcacacataggaaacacacaaccatgaatgagactcagcaaaaatagaaaacctcagaatcagacgtgcaaagactcacattattcaaattattagataccaaatatagaacataaaataaatatgtataagttcattaaaataccatgtattaaataaatttgaaaatgagctctggaaagaatctccagaagtgaaaattataattgaaagcagaatctggatggatggatttaatactatattaaactcagttaaagaaacaattagtgagtttgaagacaaagctgaagaactcacacataatgtggacaaagacagagaatagggacctttgaaaaaaagattaagaaatgtgaaagacagaatgagtagatccaacacacatataatctttgttccaagaagaaataataaggatgagggagatgcaatattgaaagacctaatgactgagtgttttccagaaggggttaagaacaccaaatcacaaattaacccttacccatttgccccaagaatacttgctggcagcacttgcagttgcagcgtttacccagagataactttgccacaaaatattttgtctttattattattattgcatcgccctagtatatcaactttggaaaccaaagacatcattccatttatagcattctgtttttagtagtggtatttctgttactgtagatagctggccaggcatgagggggcaggagagggttccccccaccacacccaccaggaatgtcaggtgaccatcaagtgatggtttggcagttgtcacactgcctctctaaaaatgataattgtcagccagtgccagggagaggcaatttactgatggtccgcagttgtcacactgaagtgatcactgattacaggcaccagggagagacaatttcccaaacagaaaaaaacacttgaaattggtaatcagcttctaataaaatctcagaaaactggggaagtgagctcaagcatgcacataagagatataatggaagggtatgaccttctggggccattccactagaaaagagaagaaagcttcaggtggtcatgcatacaacttcctaaacacactgtgcatgctcacctcccaagcataaggagggcactgcatgcagtcagctcaccctaagggaagaatcatgggaaaggtgtgcaagataccggaaatgggccagcatatacagtcctaggatcaaggttaaagggggcacttgaccttcacagtgcccacttgggtctcttctaagtgtactttcctttctttcttgctctaaagctttaaataaacttccactcctgcactgaaacttgcctcagtatctttttctgccttaggccccttagtcaaattctttcttccaaggagacaagaattgagattgcggcagaccagtatggatttgccactactaacatttccatttacaaaatatggtaattctttatcgctgaaaatgtcaaatcctagaaaatgtagcattcctatgtgtaatgttaacattgctctcgaacagttgttgacagaagattcatttgatgaatctgatttttccaaaatagacaattctgatgattcagatggttctgatgattcagatgattccgatgttagttctgtttagaaataactccaagacccatttttatattttatttccacattgaaaatcagtcagattttcttcagcctcaaagaatgtgtttatgtaaaattaaatgagctctggcagtgaactgcatttttttttttctaaatgggaaaaggtttaaggaagtttcccaaagtgtttcaccataggtgaaaagaaacacacaactgagtgccaaattcagaacaatgaaaacacagagaagaaaatagaagcagcccaacagaaacaaaatataaaagaacccaaaaatcatctgtaatgactgacagctgacttttcagcagccagattaaaaccagaagctcagaaaataaacttccaaagtactgaaagtaactttcaacctagaaccctatattcagcaatataatctttcaaaaacataggcaaaataaagacatcttcagacacaaatccaagaggatttactattagttgtacattcacaaaaggaacttctaatgagggtacttgatgtcagaaggaaggtttgcaatacatgaaaagagaatacatgtgttgactgtttcaatggtaaaattaatgcctaatttgtgaggctaaatatcaagaaagggtaacatataactttgggtaggtagttattggcattacagcactttaagattcttatatgatttagaggagagtaaagccgttaatattaaaatgctaattatgcatgttaaaatttctaggataatcacgaaaagaatagaaatagctataaatattagttcttatcattattatgattattatcatattccagggatcttatagaaagaagaacacacacacatacacacacacacagacacacacacacgcacacacgcacgaaggattctgtattcaaaacagtttgaattaaacatttcctgcttgatttctttatatttttctcagctaatgtgtattataaatccctaagtggagactgtagaggctttgcagcatttcctatgtttatgtgacatcaaaacccttatcttatggaatcggataagatatggaattacctattaacatcttgaggtacttgacagtttggggaacaccttttaagttaaatctgaattcacgagagtttgtctgtttaaggaaataatagaaccatgtgggcttgaagagaacaatagagtcaatgttagaaagacctcaggtttgggaaaataagacattaagaaagagttgaaaatactattgatcaatgataccagaaagagtgggacatattgcaatctgttaaatggaaagaaaaaaataaaatcaccacctagcaaatagattggaaagcttctgctacaaggctgttgggacatctgggaacactgccaaacaattctggggaacagacttggcactaattgtggccttgtgttctttatgaaagaaaaaagattattttataagccataacacactacctagatgccaaattgccagttaaaattctatttgcaagcaggtgtaggctttcaaaaaagctttcacccaacatcataggatgctgccttttcataatcaaatatgatgcaaactatcttttcatctacatgttcagtgtttcaaaatgttcccaaaatggcaggttcactgtgtctttaattataatgaaatcctatgcatttgctttaaatgtagctgtttggttgaatacagagatcatataaaggagtttttgctcttatccatccaattaattattagattggtgcaaaagtaattgtggttcttgcaattacttttaatggcaaaactgcaattacttttgcaccaacctaatatttccccttcaacttacattttaaatgtgtccaagcaaagagaagggtgaatggtatttggtagtgtttctaatttcaccctgtttataatataggatgctatcttttatttcagtccataatatttctattgcaattgatgtaatttaatcacactgatgccttatgctgtgcatataccaggcttgttttctccgaagattcaaagaaatctgcagacattaatcacagtcctcatggtggaagatggaaagggcagccaaatctaagctctggcatgaaacgattttgataggtggaaagaagagaagcctttcaccctctccaattctactagaatgccctcagcacaattttctcttcctctctgatcctagtaagttcaaagcctacctcttccatgaatcttccttgataaccctggtccaccttaatctttttccttttttaaattcccacagcccatatctctagttctcaaggtagcactcaaatcctactgcccggcattgcccccaattattagctggatcttttcctctaaacaatgaggtcttgtatttctgattcctgctcaattcaatgatggctttacagagtgcagtccataaatgctgttgataaagtgattagtgcaagaatccaagaattcgattgtttaggagccaattatgctggcagtagggaggtttggggttatcgtggggatatgtcatcattcttgttatctattttcaaagaccttaaggaaacacactgagtactcctgagagcatctaatctctcagaatccttgtttatctgtgcttattattagattagaccaaaggcaagataaggaccttttcctgggatctaaggctctttatgtgacaaagaactgccccaaagggatggtgaggagagaaggcagggcatgaagtggtgctggagacatatctatatttttcatttctcctgccctgcccccctcccaaccaccacattgttgtttgattgctactttgttctttgatttccccttacagtcccctacacttgtatcttaaaggactgctttgaagatgaggatttggaaacgtgtgtttagcaacttgtaaacgcctcctccaaggttttgcgaagtcaacaggaggcattttgattatagctatttgttctcaacacattgcgagtttgcagattagagatcagatcctgcctcttcttgccaatcaggataaacccgtgcagcaaggctccccatggggcacccaatggagctctccatggaacgggcctggctagtaaggcctgaatcaggggagagggtggggaacacagccctgagctctgctggctttggagcgagctgcctcctctgcagagaactgatgcagccttggctgtgcggaggagccaacatgcggtctccaagaacgcgatgctgactaaagcacagggctgtttcagcgcgaacagctggctgatttatttcagaggcaccgtttccaggggaatgggaaattgtttagtctgagatccttggctggtttccttttacatcatttctgtgtctttcaattatttgcacatttggggagttctagggccgtcctagagcatataggtgtgtacttttaataaaatgcaatttatgaaagtccaagtttataaaattggtaagttatgaggatggattatttttaccacaaaaggattttgtgatgaaatttaggatccgttttattagtcaataatgttcctggtgtatatagcattatatttatggatttcttttatctgacttcagaagtaatccctgctcctagctacgtacacaatggaggttaaagccacatgtgttgacttcagacaaaacctaggtttgagaccaggttctgccacttagttgttaatgtgtttgaatagttgcttaccttctcaaaaatacaagttaaaatttttgcaaggattagataacatacctcaggcacttagcatatagtaagagctcaacacattaagaagaaattcttatttttcttattattagagtatttatatgtaaaggttggtttacccacatttgatgtcaatgccgctttccttgtttgtttacatgtgagatctacctttaatgctgtgacccgcctccttcaatcattctaccctttgcctctcctgcctagcagttttggttctaaggctctgggactgccccagggaacaaaccaatgagtccttccctggaccactcatcacagaatggggtagaaaaagggatgctctgccaggcatggtggctcacgcctgtaatctcagcactttgggaggccaaggtgggaggattgcttgagcctaggagtttaagaccagactgggaaacatagtgagaccccatctctacaaaaaataaaaatattagctgggcatggtggcatgcgcctgtagtcccagctacttgggaggctgaggtgggagaatcacttgagccagggagatggaggctgcagtgagctgtgattgtgccactgcactctggcttggacaacagagcaagctcttgtctcaggaaaaaaaaaaaaaaaagaaatgaaaagaaaaagggctactcccagatcacactggctctagatagagattctgaaactaaatgaggtttctctctaaaataatgtttcttaaattgaagttcatggaccactctatcactttgttaaaatgcagattcctaaggtcctgcccagggcttttgaagcagaatctttctttggttgggccggggcagggttgggggtgggagggtggtgggataggaatatacattgtaataagcacctaggttactccttgtgtgtttgtttacatgtgagatctaccgttaatgctttaatttccagtgtagtttccaagcttgcccaactatagagtggcatgaagggtgcttagtaaagatagaagttcctgggcctatcccagaatatccagtggtggggcctgaggatgtgtacttttaagaagcaccctcagatgcctctaagaaatgagtcagggaaatgctgccctagagtgactggccagtgatgtgctcagtgttgttgttggtcacagtaatggggtaggggtaggggttagggaggggcttggaggtatcattgatccagagagtgacctgggttgagttgagcctcccttgtgagggctcacctttggctttctaatgtctccttcaggtatgatggtctgtgtcccgccattcccacagtgtttgaggtaggaatgccaatctgaagagaggaggcaagcccgagagcaaatagcgaagcttgtgggcagagaccagcaatcccagatgagctgtcatgggaccctggataaatgggaagaataactgcttatataacagccagccctggccctctgtcatatcatggttgcaattcctgcctatggttttttcctaaattgcctcctttccttaagacagtctgggtaggtttgtaactcaaatgactttacctaaaactatgtcctaccaccaggagctggcctttggtgacctgtgactgaactgcacctcacataccccccttctgtgcctctgcagctagattcattctctcagagctcatgctgcatcccagcttcccctcggcagcacctgccagtgatgacaagccatcctgccttatgcccaagttttgatctgtggcaagcagaacagtaatgcttcaacctcatgtttcattgacagacatggctaccagcttgacaaacataatacttttagagatgctctcttgagacattcatccttttcccatgatggtcttcttccagcaaagctggacaatgctcctcttacgctgcccacccagtgatgagaaagcagcctacaaccagacagcaaagtgtgtctctctgtctttgtgtggtgcctgcctctgctgtttgcccccatctacaattgcacctgacctacccctcaagacaacactgctttttttcttttctttcttgtaggcattagctgtcatccaaagggtgctataagagtgtgttttatcacatttcagccagcaaacatttgatgatgccagcctcctccaggtgagatattgcagtagactcgggggcattcaaagataaacaaagtccaacaaagaaagtaattcaaatgaagaatgctgtggcattccaatgggtggcatatccaaggaccagccgtgttataaaaaatacgagtcaggatattaagtagagaaaaaatgtcggaacttttggtcacaatatatgtgtgtgtttctatatttgtatctacagcatactgaaatcttattaggaaagtgcatcagtcatgtgcattgtatcaagtactgtgttgccagctgacctaaaccaacttgatcatttacaactgttgggttcttttagtgaataatggtgatttccaatgactaagggaaggggaaggttttaggtctccttactgacaaactcactaccaggaagtaaattacaaggaaagcaaatctcagaccaaatcctgcaacaaactcacacacaggcacacatttattagcacataaacacaaaaagagtaatacaatatgctcttattggctccctcccttggaccctctgccagatacctttcataccatttccctttggcagatacagcagtattctctagggaggatcagctagacatcaaatcagaatcagacaataaatcctctgataaaagatgggacacaggaccaaatggaacttctagactaagttgagtctatctggggaaattcaaaaagctaatattaactcatttcctgctttttggattttttatttaatagggccctatcctagagggtagtgagtatagatagcccttttgccctaaatgcagggaaggacagagatctaatattagaaaatgctggagaaagaagtataggtttttctacagaatggaagaaaattcttgcaatctacacatctgacaaaggtctaatatccagaatctacaaggaactcacataaatttacaagaaaaaagaatcctatcaaaaagtgggcaaaagtttgagcagacacttctcaaaataagacatttatgcagccaacaaacatactacaaaaagctcaacatcactggtcattagagaaaagcaaatcaataccacagtgagataccatctcatgccagtcagaatagtgattattggccgggcgtggtggctcacgcctgtaatcccagcaccttgggaggccgaggtgggtggatcacgaggtcaggagatcgagaccatgctggctaacacggtgaaaccctgtctctactaaaaaataataataaaaaaaattagccaggcatggtggcaggtgcctgtagtcccagctactcgggaggctgaggcaggagaatggcatgaacccaggaggcagagcttgctgtgagccgagatcacaccattgcactccagcctgggtagcagagtgagactccgtctcaaaaagaaaaaagaaaaaagaatagtgattattaaaaagtcaaaaaaaatagttgctggcaaggtgtgaagaaataggaacacttttacactattggtgggaatgtaaattagttcaaccattctggaagacagtatggtgattcctcaagaatcttgaatgagaaataccatttgacccagcaatcccattactgggtatatacccaaaggaatataaatcattctgctgtaaagacacatgcacacatatgtttattgcaacacaatttacaatggcaaagtcatggaaccaacccatatgcccatcaatgatagactggataaagaaaatgtggtacatatacaccatggaatactatgcagcctgtaaaaaggaatgagataatgtcctttgcagggatgtggatgaagccggaagccatcatccttaggaaactaacacaggaacagaaaaccaaacactgcatgttctcactcacaagtgggaggtgaacaaggagaacacatggacacagggaggggaacatcacacaccagggcctgttgagggatgaagaacgaagggagggaacttagaagatgggtcaataggtgcagcagaccaccatggcacacatatacctatgtaacaaacctgcacattctgcacatggatcctggaacttaaagtaaaatttttaaaaaagaagtataagttttttaaaatgcttgctctctataaaggcaatgctggtagagtatgtgaagggctttgatagggtgggccatagagtcacaagaatgcatgagaggggcatttagagctgactgggaagttccaggaaggcttcctggaggaaggagttagctaagtggataaggaggtttgggaggcagagaaagtagcacaacagagggctgcaggcctgatggaggttatgtcatatttctgcaagcaatttggtatgactagaatatagtctgtggtaggaagggagcttagtaaaatgtgaggttgaactgctaaacttggctcagctcataaatcttaaaggtggtagaaagtcacaggatttttgagtgggagaatatgagtatcaaatattcactgtgcagaggtcagtctgccattgtgagaactaacttaaacgcagttttatagcaggcagggaggccagttaaaatgagctttcaggaaccaagaaagagattatgaggctctgatctgctataatggcaagtgagggtaaagagaaagggaaacgttgcagacataatgggtagactcgatttagcaacagattgaatgtggctgtgagaatgaccccgtgtttttagtcaatgatggtgacattcctcaagacaaagaatataaggggaaaagctgatttctggggtgagacgggaggatgaggtaaaaatattaatgtctgcaagacatccaaacatatgagggttgggatctcaggcaacaaacagaggctggagatgggaactgaggttcagttccacagagaaggtggctcatattatgggagtgaatgaagatcatagagaaagtacacaaggtacacagagaaaaggaataagtctaacttcttaaagatcattatcatttaacattcagttccttttgtgtattattttctgtttcccaagctggtttgcatcagaatagtcattctctgtttcaggattttaatgccaactgcagataactctgtctttctgtttgtttacaattgttgaaagccctgactttgaaaatagtgtcttcaacaactgtgttcaaccactttggagatgtggttggagcatcatgtttctcttgttaaagcacttgtctgtgctatgcctcttgttaactggcacatggcatctccctctctagcttgccctgtggtagaggagggggcaggaatgttttatggcttccaaacctagaggagagaacaatgtccaaattttgtgctgccaggatctccatctcctcagaagtcctcaactctcccttctttctgaattacttggtgaggcatctcctgggctgtaaaaagaatttcttaaagttttgatgtcacaaaacataaactgatgacattttatgcacagacttataaaatatttctctaaaaactattttgttaggacaacaaaaacccccaaagtaatatatgataaaaacaaagcaaaatcatttgatcttgaaaggtaaggaaataaaatttctttagtatttttcatgattatgataaaatgattatttattgtaagacttgaaagtagttttccatgtactcacagcacacctgcaggttattcacagaacaccggtattctgtggcacacaatatgagaaacactgtcgtggggatttcattgtgatggtccacagttccgtgctcaccatgtggggtgccattatctttgaatccgaaaggcaattagagaaaagaagagggatagcccagagaactggctagttctgtcctttagtctctactattcttgttagtgatgttggagagagcagggctctagggggccatggaaagaccctgcagagtagaaggcaatgcttgctgattctgggaagcagctgcagcagtgagaggcataggagcagtcattagacaaaaggccgcccaaagagcagagcggccaagccactgatggcaatcggcttagttagcaacaagccagccccaccacatcataggagagggctggaaaaggctggcgaggatgccctggccttaccttatttcctgcgttgtgttttttttttctctctctctctgaatatgtatgcataatagattgttaaaggattttttttctaaaaaaaaaaaaggtaaaatcaggactgtcatacaaatagaaaatgaacgtctgtcaaatattgtgtttctttatttaataaattagggaacaagtaagatgttacaaccagtttaaagaacctattgcccaggctggggtgcagtcgcacaatcacagatcactgcagccttgaactcctgggctcaagcaattctcttacctcccaagtagctaggactatgggtgcatgccaccactcttagctaacttaaaaaaatttctttagagacagggtcttgctatgctgcccaggatggtctggaactgctggcctcaagcgatcctcctccttgggcctcccaaagcactgggattacaggcatgagccactgagcccagccctaattttttaatcagtgtgtattatatctattttgtgaataatgaagaatagaataatgtttataaatacccagtatagtgcttagcacagagcaagcattcaatagtgatagtatatttttactattaaaattgatcattttaataatgccgaaacttctgtttatgtaaccaactgttgccattttcattacaagtataatcagctaaaattccttttggaattttggatataaagttttaaattatgaatagataaataaatagatgccaaatattgagtctggcaaaatggtgcttattatgtctgtgcttgttccaaaactattgagtaggcctatgttttgctttgctttttttctttcctaaatactagacataagtgcatccctgtccctagacatggaaaagggttgtcaatgctccctaggaataaaacacatggcacagaaacttttatcaataactacttatgaaacagatgattcaacatcatgagtcattgactgtcctttctatgaatccattgattcatagaatggtaagataggacacttcaggaaaacaaatccattcattcctttacttttgagataggaaactattattcagagaagttaagtacattgtcgaatgccacatagccatcagcagagctggagccagaagccaaatctgctgattcctaagttagttttctctgaattcccctatattatctcttcatctctttggccatagctaaaaaacagaagagtagccttcctctgtatatactgagttgagaaatcaagccccatagaaatggcatgcaagcttccctgcagtactcaggacaaaatggacatgccagaaaaggaggttccacttgagcagagctgagcaaccacagcccaatgtggaatgaacgacctcctcgtctgctgcacctcatgatttattagctgctactggtggccatgaaatattcatccactctttcctagagttactgcttcactgcatcaacaaaccattgctttcccatctgtttaggtgtgcagcttggagaagaaaagcttcacacaaaatggaaaagaggcttattttcatgtttagcccagaggcagaacaccaattcacatcttggttcattgtcgttttcccagaggcacagtcagggctgactccctaggctcctgaacacagagaagccctgtcactcatgtaagcaaaggttgaatagctagaaagaagagtgaaagacttcatgtggttggctggctggttgtaacactcccagctctagcctcagcttattttgctctgtaagcagtaaagcggggcacaaagagccagggcttgcctgacatggaggctccttgttgccaaggcctagtgtcaagcaacgaacctgagttgctccatgcagcctctcctttgggattagaagcactgcttataggagcagaaggagttaactctgccccacttccctactccctcttctttttaggcttcatcatagacttttcttctgcataccccttagctgtggttgctacccttcagccctcttctcactcgctgcatatattccccatagatgtttgtattcatgatcatgcattctccctccaccaatagtcatttgtaaatctctctttctccagcttcagatctataggttcaactacaccatctgtctataccaggatagccaattgcccttcaacctccataggtcccaaactgaatttattattactaccctatgatcccttcccatcctccattcacatctataaatctttcagaaaagattttaaaaaggaagctttcttattataaattcatatgttgacattgcagctttgaaaccagtttcttttaaaggtagttaattagaaacatatataaatatttcagaaaagaagctccatcatattatcaaaactggttgggagtcatccttgattctctcctctttctatttatttttttatttttatttatttatttttttagagacagggtctcactctgtcacccaggctggagtgcagtggtgaaatcatagctcactgcagcttcgaactcctgggctcaagccagtctccctccccagcttcccaaaatgctgggattccaggcatgagcacttttcctggcccctctcctctttcttatctccatgtttcagttatctatttactgcttattattgaggcaaaacttagcgacttaaaaaacaacaaccaccgtttattttgttcatgaatgtgtcatttggacaacctcatttttactccacatgatgtcagttgggatatcttgaccgaggacccattttcaagacagctcactcacatagctggcaagatggtgctggttgtcagtggggagttcacccagggtatttggccaggggatctcagctcctcttcactggggcctcttcatggggctctttgggctttctcacggcatggtggctgggttccaagaataagtgtttcaagagacagaaagtggaatatataggtctcttaaggcctgggtctgaaaactggcacagcattacttctgctgtattctattggccatgtagtcacagagcccattcagactcaaagaggaataatacagaccccagctcttgaggggaagtgtcaaataatttaaggctatcttgaatccaccacattctacatccaattaaactcttgcaatcctctccctgtatccacgccttttcacattctgttcctttggtcttgaatgcctttctccaccttgtcctcttctctgctctttctccaagattgtgctcaagagttgactccccaaacctttctcaatccctcctccagaagaacaccctatgttagcatttattattttgtgttgcgattgtttgtatatctttcctataagactgactgaattattcatgacacagtcatgaaagactatgtcttattcatttttgtatccccagaaccatggagatgggcagagtaaaggacctcagcaaacatttactgaatggataaatgtttccttgtttcaatctctcaatagtcctgtgaggtggcagaaatggagtgttattcctatcttactgcactgacctccttattgtagataaaaagaaacagacagagcaaaaagtaattgcattacccaaagtcactcagccaggaagataattcagtatagtcaataggaattcagttccccaaagtaagttgaacatcatagatttaggcacaaagttaggaaggcttaagaaaaagcccaaccatgaatggacttagttgtttagcagaaaatgccttcgaggttaccctactagtctatgtatactggtgcctactcagggggcgcaattgattttctgtacactgctaggaaactaaaaacaccagaaaagatagaagatggtctgatagaatctgttaaagaagagaatgggcatggtacagtgctttgtgcaaataggaaatgtggatctaatgtagagtcacaaaatgacagtgggagagtgtgagttcacagtaattctcaaatgactcttcagggcagagaaaggcagctattctcagaatgagaggctgtttctaggggcccaagtgtttgggtcaattggataattcactggagttaaaaccttagctgcaataaaacacccctcaaggacagctgacatcctgtgctctgatttcatacttaacaagccccttctgtgcactagtttggtttcttacatattttttattacaaaaatattcccttggtagtggacatgggcattccagtcaatagaaagaaactttcttattataaattaataatatgttgacatgctttgaatgtttcttttaaatttagttaattagaaaattaactaaatttgaaaccagtttcttttaaatttagttaattagaaaaattctcctgcacacagatgaatagattttttatttgagttttttgattactttagttttttaaaaattacacaaatacttaatactgtattagtccattctcacattgccataaagaaatacctgagattgggtaatttataaagaaagaaagtttgattggcttatgtttctgcagactgtacaggaatcacgattctggcatctgctcagcttctggggaggcctcaggaaacttacaatcatggcaaaaggtgaagtcagagcagataatgtcttacatggcaggagcaggagcaagagagagggaggtgctacagacttttaaacaaccagatctcatgagaactcactattgcaagaatagcaccaagtggatgatgccaaatcattcaagaaggttccgcccccatgattcaatccctcccaccaggccccacctccaacattggggattacaatttgacatgagatttgggtggggacacagatccaaactatatcacatatatactttcttattgtaagagatccaaacaattaaagtatacttgaaaagccctttcaacatcaagccccgtcctctcagcctctgagataatcagttataagttcaatatgcagccttcagtcccttttctatacacttatttatagagatgtgtgtatatttataaatgtcccttttaattttatacaaaattgatcgtactatacattttcctttttcatataattccatcccatgaagatccttccacattaatttttctacattctacaagaaacaagaaagctctgccttcttgtttcttatggctgcatcttttaaaaaaataggatgtattattcatgattcttcagagacacaggaaagataggatatatatatatatagagagagagagagagagagagagagagatttactataaggaaatgacttagcagttatggagactggcaagtcccaagagccgcagagtgagttgcaagctagaaactcaatggtaggagagccagtgggtgcagttccagtgtgaaggacagcagacttggaaccaggaagagccaatgtttccatttgagtttgaaggcaggaagagagcttatgtcccagtttgaaggctatcatgcagaaaaaaattctctcttactcaggaaagggtcagacgctttgctctattcagaccttcaactaattgaatgaggcccactgacattatggaaaacaattggttttactcattctacctgtgtaattttaatctcatcaagtaatagcctcacagaaacactcagaataatatttgacgaaatatctggacaccctttgacctattcatgttgatacataaaatcaaccctcacacaaggttatgtaattattccacttttaatgaatagcttttttatttcttttcttttttctttctttttattttcttttctattaggaacactactgcaataaaaaatatttggacacacgttttgggtacgtgtgtctatttctgtagaatatattcctacagctggaattgctgggtgtaataggtagtgtaatgcccctcccccaaaatgtttacatcataatccctgggacctgtgggtatggtaggttgcatggcaaagggaaattaacattgcagatgggatggagtctcctattcagctgaccttacaatagggaaactatcctgaattatccaagtgggcccagtgtaatcataaacatccttaaaggtagaaaagggaatgaaaagacagaaccaggaagatggaagagtgcaaaggagtaggcctggtgttgctggctttgaagatggaagaaggggccatgagccaaaaaatgtgtgcagcctgtagatgctggaaaggacaaggaaacaggttctcccctagagactccagaaaggaacataaccctgccaacaccttgattttagctcaaggagactcatttcattcttctgaactacagaactataagacaatatacttgtattgttttaaaccactaaattggtaatcatttgttatagcagtcacagaaactaacatactgggaattggagaatgcatattttaaaaacatgatgagtaatgaaaatggctatggctttcacacacacatgagaaggtttttcagtttacagttctatcaccagtgtaaaaaaaaaaaaaaaaaaaaaaggtcattttcccttatcttcaccagctctggattttatcaatctttcttagtaaattaatgggtgaaaaattattattactttgttgctgaagttggggatcattttagtgtttacttccctatttacaaattggatgtttatctttccttatttttatgcaagtttggtgatctttgttattgacttacagatgctctttagatagtatggctctcagtcctttgcctgatatatatgttgcaaatattttctttcaaccaatcacatctctattaactccaattatggatcttttgttacacagacaaacttcataactagagttttgtgtcttggttaggaagagaaagctaatgtcttaactagaaatgctgcagatgccagcctgagctgagtcataaatagcttgagtgaccttgggtaagcccaacactcctttgatcattagttttcttatcaaaatgattagcttccttatcaaatttattcatgcaaaaattatttactttgaatccactttatgccatgtctagatgttatagagacaaatgaacacaatattcaaggaatatacagtctaatgggagatatggacaattaaacagccataacaataaccatgagaatggaatatgctgtgatggaggtttgcgcagaatcccatgaaaccccatggaaccccacatccagaccatgaggttttataggagttgtccaggtgagataggggaataagaagggcccattggtcagagggagttacaggaacagagacttgggggcaagagagaggaactacaacaagttcatccaataggggtgatgatgttggtgtgttatgaatctggaaaggtaggcggggactattgcagtgcctttcattctgtttggcctttttcctgaggacattaggatgcctttaaagtttgaagcatgggagtgagatgtggactagcctttagtaaagatcactttggcatttctgtgaagaggataaaagagggcacagtcagaggcagggaggccagcaaggaggctgttgtactggcctgggaaggagatggccaacacaaatgaagcagtggggaggagacagacacgttggatagctttgggagatttgtgcccgtgtttcccatcactcatatttgttgtgaatcaaaaacaatatgtagcattgttccacgtggaagttttttgtaaactaaaaaaattccacttcttagtggaattgtaagcactgtgacaggtgagtggagatagttctgaatacagaagactttccaggaagaagaaatggtcactatatttaaagtagaaaatcattgtgtattcaaattgtacttactttgtctttcatattttggttttctttatatggctgtgaatgtataacctaagcatcagctcatctgccctcccctttcctcctcccaacctcttattctttttgattacattcccatgatatatgttagcaaagaccagggcttattttagtctttcctgagagttctaactgccactctgcaattggccaccagctatctcccagccattcactaccctcactgcacttgaggacaagtgtctgctgcctcagccaaggagccagtgaagatgtgaatggggagaaagaaaactctccaatatttctccatccctttattcttcatatcagcacttatcaagctgatatggggacttcatactttactgaagcactaaattagacaaacgaaattacaataaagaagagaaaattattcaaacaatagactcactgtaattttcaccttgctctaagggacaagtgcttcttccccccactccacactcatcctcagctctgcttctattttctgttcccaagtgagtggctgaacagtactggagagaaaacatgccctttgtcaggagcaaaccttttctcatcacagtattgtttcctcagctctctgtttcacttagaaatggaaaaaatattgaatgccatttcccagacccactgctggctaatagcttcaactgctaatgttttatgaaatctgtcccagttgatgtggtgcattaagcagaacccactgcgttgactttgctcctctcctcctctctcccggttatttggcctgtgctgatatgtgaagaagctctgcaggtccaaagctctgcctgtgcacagcaacggcaatgggaaatgactgccatctgcatgctgccattttccttttggtgctgacatggattctttggcagatcttccaaagaaagctgagtgtgttgacactgtgagtttggttatcacccactttcctaggacaaaggctcaaggcaacccccagtaacatttggttgatattaatttcatctatttgtattcctcgtggttaaagacagtaacagcattggtgatgtggcatcaagatgcacagtcctacgaatggggcatctggcctaaaatggcaacaggtaattggagaggacagaactggaaatcaattcagaaagctttaataataataatcttaatacatttacaggtgctctcttatttgatccttaaatgaggtaggtattgtttttatccctgttttaaagataagaacactgaagttcaatgaccagaaacttgcccaaggtcataaaccttggagggaggaggtatggatttaggtgattcaagccctaagagttccaatatcttatctggatcctgttgttaaaggaaaaaatgttcgtgacatttgttaagacagtaaggcagattttactcaagacaaacgtaacaggtgtagggactaccacagtggggtttagcagtaggggagacagattgggttcaactctgaacataagaaaaagggggaatttagagtcaagggggtggaggctgtcagtagatggagaataactaagagggtagggtgatactttgctaaactgtcctaacaggattcttgttaggggcaggcaagccttggtaatcagatataacctggggatgatgggagtggtgaagaatttggtcagatattgaggatgatcagatattgagggtgggaaatcctggccaaaccaacctgacaaaattcttgctgaaactggatgatgcaagaaaggacacagaagtccaaaagtcaaggactaccttggaagaggatagtggtgacaaagagtctctccttgaccaaattttagtcaggctccaccactgtgaccctctgcccatagctgagggctgcagcatccgggaaagtaaggttcagtgagttttgagtttggtcgtgaagaaggacagaaacaagatctggcaaacagaaagaagtaacatttgtttggagatggtggtggaatgggaatgatcctttattaaatcctgggcattaggtacatctgatagggaggaaccactaacactcaagatcctcctgaggcagcagctcccaagtccaccattttcctctgggaacttttgtgtttagtctgtaatcagctgagcattaagggcagcatcatcctggaaagtaagtaaataggttcaggtgagttttgagtttgtgaaggacagaaacaagatctggcaaacagaaagaagtgacatttgtttggggatggtggtggaagggaacgatcctttattaaatcctgggcattaggtgcacctgatagggaggaggcagtaacactcaagatcctaccgaggcagaagctcctgagcaccgttttcctctgggaactttggtatttaacctttaatcagctgagcattgtggattgctagcctctacaatccctacatggtttccagttctgttaggaattgggagcagaggaaagacaggtctgaaatgggctgggtaatggaaacctgactctttctcttagagctcaaaagagtagcccatgtcacaaacaggagcctcagctgggcaccgtggggctatttgcagcctgacagcctctgctgaattattgatgcccctcagtacctcgggacctcctccatgttaacaaatcacactgcatattaaaatttaaagaggcaaatgagggcaatctctttccctattatttccctcttcttttgccatctgagctctaagttttaagtcaatcagcctgaaaggcttctcttaggagatggcacagctcagagagccaagcctaggaaaggaaaactagaggccatgagtgggcccaggactgagtcctgagtcaattaatggagtctgggggctctgggccaggtgagcactgactctctgagtcgtggaaacacctgagaaaaaaaatctgttcattcccttcttacgacagttatgccactgcccagtgtgccatatctcaagtgtttccctaaagcagaagataaaaacttttaagttgtggtccaaatttgttgttgttgtttcttagtgaaaagagttgcaaaaattttaaaatcagaaggttttacctaaacctgtttttttttatatttgacgtgctattttgcatgcaaatatagtaaaaactgttttactacctagattaattattccttttattagtataaatgaccttttctctttgttttcatgcatttctcctcaagttctactttcactgaatgtaatttcttcttttttgtttattattattattattattttgagacagagtttcactctgttgcccaggctggagtgcagtggtgtgttctcagctcactgcaacctctgcctcccaggttcaagtgattctcatgtctcagccttctgagtagctgggattacaggcgtgcaccaccaggcccggctaatttttgtattttcagtagagatggtgtttcaccatgttggccaggctggtctcgaactcctgacctcaagcctcagcctcccaaagtgctggggttacaggggtgagccactgcgcccagccttatttcttcctttaaacataagattttctgacttctcttcagcgatctgaagacttgggctttcatctgcacattgtaccccttactggggatgacagtggctagtccttcaaatgaagtatggcctcttaaccatggttcttaccatttcccattagtggttgaatttgcaacccctgatctcaagaaagatggcaaacaagtttttctatgtgccaactcaggtctattagcaagactgcctgtagcaccaaaatgaatctgaggtcagctgtggtagattgctgtgtactttgcaattgtgcacccccccttccctctaagaggattgcatgtctctgacctttgccatgtgaccatgtgcagatcattcaagcagaagtttttaagaggcatcataagttgtcgccacctctctggcgctttcacattctgctgtgggaatagcacaccctatgatccttcagcctggatcccagaaggaaaaggacacatggagctagtagctgatttacagcttggagctgagccacagtctggagcagtgcttcagccaacccacagctttcagtaacatgagtgaatagcaaatgttgctgtaagccacagagaattggaggttattcattaccacagtaaagctgaccaatacagcaagactagtctttatagaaaagaatactgaggtttttttttttaaagcagcatttttctattttctgagaagaaaaaattaggtagcattaggaaattcctgaatattaattttaatttccttcaatttaaaaatataacttccaggattctgaaaaaatcatggcattggcagtaaaataactgagttggattcctgaatccacacttatgaccatgttataaaatattgaatgacgttccttttattaaagataattatctttttttaaaaaaacttcttgtgtatattgaagttgtagtatctgtcaatttcatttctaacagtgagcagagaatatagatattgttatacaaagggagtctggcatctgatagggttttacccactaccttattgtgaggatcaaatgaccttgattgaaaatgctctgtcagccttacgtgattactagtgatttctagtttttgctagtttcgtaaaaaacggcatctctttctcactttctccattaggaggcaggttaggcatgactatcaccatctgacagatgcaaaggcagatgaggtggcaaacgggtcagggccggaggggatttgccagctagttaagggcagaactgagaggcagtcagtttatcacggagtctcctgaccaccagtaatctgtccactgccttactcaaaagggggccaaaccaggccttatgagcaattttgctaatacacagatttccagtctaatgctatcagttatcatgaggcatgtgctggtttcttggaagcagtcaaatctaattaacctcaatatctactttcatgtttaccttttacatcctttggcctctggcattgctttaatttacatttttcagtttgtaatgtcaatgttcatcagcccctttcaatccttgattaaccattttgtggtaggcatgctagttattcttttctttgttagagacaaggtcttgctctgtcacccaggctggagtgaagtggtgccattgtagctcactgtagcctcgacctcctggggtcaagcaatcctcccacctcagcctcctgaatagctgggactacaggtgcaagccaccatactcagctaatttttaaactttttgtgaaggtggggtctccctttgttgcctgggctggtcttgaactcctggcttcaagtgatcctcctgcctcagcctcccaaaggtagtttattcctaagtaagaaaaaggtttaatttgcacatggataatactagtatgcatattagtattatctatatacaaattatgaactatgttcatattagagaacatttatggtatacaaagttaaactcccagagttgggatttttatacttcggcatcattcactaattttggactctctagtctgatacaacttcaggtcatccttttgggcttcaaaggaatttttatccatctaaaaggcatctccacctcaatgtcccataaacaatcagacagctttgaaggagaattacctaaactaagtgcctgctagctgatacatccccttttaggagatgttgatgtggggcaaaagctgggtcactggttagaaatctgctgctgctgcaaatacacaatggaatcctccagaatttggggatgccatgtcagttgctcagtatctgagggcaggcaagctatgtggaacggtctttgctttggaaccccactatacatttatcattttcatttcctgtgttctctgctgaactcaaactccttttttgaaagtaggcttatgccaagaggtcaaggctgcagtaagccatgatggcaccagtgcactctagcctgggtgatggagtgagaccctattaaaaaaagaaagaaagaaagaaagaagagaaaaagagaacgtaggcttatgatggggctccattggagagtagacatcttttccattgacttaaaactttctgtgtgtgtgtgtgtgtgtgtgtgtttaaagagagtctactgatgcagaatgaagaaagctagagaccaccaggtcatggagaaacttcctaggggtggagaagagctcagaagaaccttttggggtagaagctgtgaggccagatgttatccagtttgccaagaaaccctcacctagaggcaccaaattattgcccccagctttggcttgtaatttttgcaacctccctaatgttaaggtttcaagacctgcagtaaatttttctcaggggtggaacatgacgacaaggggttcctcaaagccctccctgccaccaagcaactatcacctagctctccacttctcttccccttcattggcatcgcctatctcctactcacaagggagggagctccctgtggaaggggctctgaccccacacaccctcctgccacggcatttctagtcaccctatcccaagaagctttgcaaacttaatgcaagatggaccaaggctgggctgccctgcatgtcaagtgtgctcagcaagcatgtcccacctcatccccttgccccacccgcatggcaaaaataattaaaacaccgcttctactatttcccagataacttggcatttgtcaagggatttcatgcacgtgacctcatttatttttacctcagcagcttttgaagcagggaccatgactgccatcttaggaatgaggaagcaaaacctcccacagctttcaggacttgcctgaggcctccctgctgggaaagggcagagctaggacttaagtctggcctttcactttcaggcccatcttcccttccctagttggcctccttgggtctatgaggttgagtctcccccgtgtttcccccagttctcatttccctcctcccagttggctccacaccagcctcccaccacagagtagcttcagacacactaggagtccttccacagccgtattcctttttcgccctagtctcctacaaagtatatattttaaagcttctgtttatttgacagtctcccctgatggagggtagaggaggtgatggctttctctcttcctcagtccctcagcaaacatactataattgtgtgacttcccttccctaagattttgcaatgactccttacaaccaatctcataaaaccagagtcattaatccatcatggaagcaactcccttctaacttttttcttttcttttcttttctttttttttttttgagatgcattctcactctgtcgcccaggctggagtgcagtggtgcgatctcggctgcttgcaacctctgcctccttggttgaagtgattctcctgcctcagcctcccgagtagctgggattacaggcacatgccaccacgcccagctaattttttgtatttttagtagagacagggtttcaccatgttagccaggatggtctcgatctcctgacctcgtgatccacctgcttcggcctcccaaagtgctgggattacaggcgtgagccaccgtgcccagccccttctaacttatttctattcttacctctcttctttacgaactctgtgttctggttgtttctttggtctgtgtctcccactttccgctctgaattctcattcttcgaggcttaaaggcccttccttccacaggtgctgcccctgcccccctcccctcctcaggcccagagcacttggtttgcgccgcctatcagacatctcactctggcttgtatggttagattttacgcatgtgtatgtgtgggtgtgatccccaccactagtgagaaaagtctttgagggaaaggatcccctctcgtacgtcccctcctgctagaggaaggtaaaggcatagggaaccacatggcttggagaaggaatgcagagaagctgagaataaggcacaggtgcataaacttgcacaataattacttcattaatatcaaaaccagtgtgaaacattctcagtccagagggcggggctgggccgggctccttcctggagcctctggccagcactgcaattcctctgaggcacagggctctcttgatatatatatatatatatatatatgtgtgtatatatatatatgtatatatatatgtatatatatgtgtgtatatatatatgtgtgtgtatatatatatatatatatatttttttttttttttttttttttgagacggagtctcactctgttgcccagactggagtgcagtggtgcgatctcggctcactgcaagctcctcctcccgggttcacgccattctcctgcctcagcctcccgagtagctgggactacaggtgcccgccaccacgcccggctaagtttttgtatttttagtagagacggggtttcaccatgttagccaggatggtctcgatcttctgacctcgtgatcctcccacctcggccccccaaagtgctgggattacaggcgtgagccaccgcgcctggcctctcttgctatatttctccagtccctgtagctgtgcaggaggagccacgaccactcgggaaccctcgtctaatccgacctcccatcctcactttcctctaatggctttaggggtgctgacataacagtacctcgcattagccttcatgtctgttaccccattttatgctagccattcctaccttagacatgaaggactgacatggagaaattacatgatttgccatagctgttttgcaatacaagagagtaaagagaaaagcaggaaaatatcaagctctcagcacataagctgcccttgaagaagtccacagtaaatgtaccttattttgtgaccatttcccactgacccccctcagttcctcacccccagcctgcagaaaaatgaggtttccccctatccctagcagggcaagagcccactaacaggcttgcgctctttcttccagaccagagcaattcctttcccttagtgaagccctctgggggccttctatcacaggtacaagaactgaaacatccaggctgtctggaatgacttgctcaaagtcactgaacacattggtggcccagttaagatttatactgaaagctgctaatgacagtatctgtcctccaaccaccagtctgggccgatgggtatctgtttataacatgcttttctctggctcccttgacagcccctaaccaatgttttcttatctaattacattccatgtaatctgctcctgcagatttgccctcattgttgccagcatttacagccttttccacacatttcctagaaaatgctcatgtcctgacgttaggtaaatattgtcataggtaggagagctctctggtgtgttgatctatactcccgtaccactactaattcttcaaaaggaagcttcccagaagccacaagctgaagaagccacttcatctttagaattggttttcacttgctcagtgccatggagtgttcagtgagaccaggatgtcactgcagcctcgtggttgtgtattccaggtgcctggcctggacgggcataggagcaagagctagtgggcagttgtcggggtgggagtggaagaaggagttttcatacagggaaggtcaagggacgtaagttctattctgcagtgaacattgtatagggtattagacaaagcgtgtaccttgtctgtgttttagtttcttctttggtataatgaagaggataatgactttaaattgcttgccttgtcagtaagaacaaaatatatttttaaggttttggatgtccaggtaagtgctggcatatgattagaatggatttaagcctttgcgctctggctatgcctcttaatcctgagatcttggccaaattacctgagtccatcaatccccagttccttcaaccagaacaaggggaataaaaactagtacctacctcatagcattgttgtgaggtttaaatgagtcactgtttataaagcacttaatgtatgcctgcatttctctagtgcctcagtacagtcctcacagtcggagcaaagatgacccagcttaaatgtctagggttttgagtctagtgtattgatttcctcatggcattagacaagctgatctaaaattttatatggaagagcaatggacaaaggcagtgttggaaaagaacaaagtggagacttacctcaccaggcatcaagactttttatagtgtttgtattagggttctccagagaaacagaaccaagaagatatatcaagatatatggaaagggatttattatgaggaattggcttatggggttatgaaggctgagaagtcccataatctactgcccacaagctgggggcccaggaaagctggtggtgtagttccagtccaaatctgaaggcctgagacctgggagtgcagatgtccaagggcaggagaagatggaggtgccagctcagcagagaaaatttgtcctcctctgtgtttttggtctattcagaccctcaacagattggatgaggccccctgacattgatgaggacaatcttgtttacttggtctactgatttaaatgttaatctcttcagaaaaccttcccaggcacactccgaaataatgttttaccacctatctggccatcccttagcccagtcaaggtgattcataaagttaaccatcacagagtttcagcaatcaaggcagatggtaccaatgtaggaatagaaaaatagacaaatagacttggttatccatatggagaagaattgaaacacattatacacacacacaaaatcaaatccaggtgtatcaaaattaatacactatgtgaaaagcaaaaatatactttagaaaaaaatataggaaagcatcttggacttaagggctaggaaaagagtccttagataacacacaaaaaacaaaaaccataaaggaaaattgtgacaaatctgattgcatgaaagttatgtttaaaatttccttttaatgaaagataccataaacaaaaattaaaggtaagcccaagaccaggagaaaggataagaaatacaaatatttgataaagtcctagaacctggattttaaaaagagcaactcaataatgaaaaaaaagaagctggcaaaacataggttaatgtttaatagttgttaattgtcaataaatacatgaaaagatgctcaaggtccccagtaactaataaactacaactacaaccacaataagacaccattgctcactcatcaagttaactgagaattgaaaagtataagcaagagtctagataggtgagaattcttccacattactttgaacttagttataatcactttgagctagaggctccacctctgggcatataatctcatgaaactctgtcacatctgcagagaaggtgtatagaagaatgttgactacagcattattagcaatagaacaaaataagaggaaacgaactgaccatcaacagtagataaataagctgtgctatagccatataagtataatgaaattttgtgtaagaactgaaatgaatgaactaggattacatgtatcattaacatgggtaaatctcaaaaataatgaattttaaaaaaccaaattacagaaaaataggtacaataggacaccttttgtataaagtttgaaagcatataaaacagcctatttgttatttatggattcacacataagacacatatgtgaagagtagtataaagcatgaataggaatggtaaacatgaaatttaacatgatggttacctgtagggtggcttagaggaggagcacgtaggaggcttcaattactttatagtgttttattattttacaaaatctaaagcaaatatgtcaaaatgttaagattcaataaagttagatggtgggcagacaagtgtttaattatgttattttctctcacgctgtacgtatttacagaattttgtaatccattttaaaagattctaaattgtcctttacttccaatacaaagaaagatgaaattataactatatgctgttaaagttttgatgtatggcctgccaccctctttcaacagccctggacaactattcctagtacttagcacagtgcctggccccagaagagtagacggaaagaataaaagaatgaatggacctgtccttggaaatagaggtgtggccacatgtacgctgtgccctttctgtcattaaatcacactttcctttccaaccatctcactcagcctgagttgccatccagtgtaatgattcagggtaattgtgcttagggacgattgctagtgggatagcaaggagttgcaattcagccctggctgtgctctgaattcattagtgaattcattttccagcttcgtgtcctgctcagaagaatgatcctctctccaagcagggcattgctgtctttctcatacttagcaataacaaccaaaaacaaacccaaggaaataaaatcaccagggaggctttcctctttaattaaggagttctaatgagtcacagtctcaccatgcatgggactcaattatcctttataaataggggattgtgaatgtgggatgtgttttcttttgcagccctgctgctatttctcctttgtttccttctcctggtgctgctgcttctctctgtacacgtgtatgcacatatgtgaaattgatgacataaagaagatccaaatctcttcgcctagtcaacttgaagttgtaagattccttgagtgtcattgagaaatgtaatagggagtgggtggcttggctggtagcttaaatggtgccaatgattgtaaagtcataggtaccatcccccaaaagccagaatgatttcctctgttctgctgacacagagagcatcacaaatcttggcaaatatatcattggttacatggttgatcagacaaggcagggaggagtgaatcgtgtcaaatggaccaccaccactgaaactcaaacctgcccccacgctggtgatttttgtggattcctttaagaggaatggtgagtgtcttctaagagtaagaagggttagcagtgttccagcttacctacaaaatgtgaaactgagaaagcccactggggcgacttccatctttattgctaaagagtaagaaatagagacttggtcattctcactgtcatttttgtgatttttctgaacctgaaggtatataatgaggaaaaatgagacaaattcaagcaaagagaaatttgggcagaatctctggagggaaaaataatcatggtgaaatccattagactacgtaatagtcatccccaagggggatgacgtaagcctcatagttgcagtcatttaaatgtagactgaaccatgcatttgtgagcagaccccagggaacaatcctgcattgcacaggggatagggaaagcgataggccagatgacctaatagatcttctgtaacttaatttctagggttgtgggatcctaattaaaatgaactatattgcctgttatgaaccctccatgttaatattctgtaaggtctccaggcaagtcaagggggtcttggctttttcttatttcttttgagccagaacccacaggctgccttaagcacctagctgctgtccatcacttcttatagctgacaaagcttgacttaaaaaaaagtttttaaagaaaattacagcacatattatgaactaacattttatacaaattaattgagtgaaatgagagaagtatgcttcattctttgacctgtgataataaatattcttccggtcaataacacgacggtgagtcagccctgcgatggaggcagttgtcgccatataacacacaggactccaatctgcttcctcacatctagtgctgacttttccttttagctttaatgatgtttgaaagggaatattgacgctggaaaaatcttagagaggctccaccaatcacagacgagcgcaattctccactaatgtgggcctcttttccttgacttcctctagacatggaactccactgaggattctcaggcagggccactggcgagctggccagagctgctctgagaaccaccagtgaagggcagagggcactttagccccaaaagtagtagcagtttagggcaggtggaagagacgggtggttcaattgccccatgtggcgtttcaggtgggccacatgggtcaattgagtcttatcaacttgtgtcttatctagcaattgaatgccattgctagataagagtggtgacctccagctggtaagttattttatcagccttgtcccatcccaaggatccccaaaaaggccacagaactctgccagcaggaagtagacaccggtgtgcatcagagaatatcaaactctacctattttaaatttataaactggattctaattagcctgcagggagtttccatggaaattggagatatcactttgcaacagtataagatcacagcatcaagtagacgggaaaagtggaaaatctctattcttttaggaatcagctggagtcacctcgctatgaaattgtccctgacccaggcagattccaggtgttcccacttccattacagtatttgtagtatgtaattgtcagtgtacatatctacatcccgcagacgggggagacactgtcattgtttctgtttttctccagaatatggctcagttcctgatacagaagacacttaaaaacaacaacaacaacaacaaaacttgttcgattattacagtgatgtcttagaacattggtttcttcatctataaaatggcataataatactaattcagttggctgttctgaggattaaatgccagaacaaataagtacttacaacaatgcccagctcctaaataatgtgtagttcctatccccgcttatcttgtgtgagaggattatttttggttttgataggtatcaggcaaaaagggttttttaaaacagcaaataaatcagaatattccacacttgtagtctgcattttgtgttgccatttgattgggtttctagactaggccagcattttatattctgtaagcatggtagaggttatattatctccagccccaaatcttggacattaaaccttttcctcattgctcactcggctagatatacattattaataaatgagatttctgagatgtttagacttgattctaaacattcatgaaataaacttggagaatgagtaactatcatcagtgatgataaaaatgagcttgggaagataccctgtgtgttgattctgatgagaattttacctttattggacaccagaatatttccaggtattccctgaaaactcccctagagatgtcttaactcttctttgatggttaatattaagtgtcaacttgattggattgaaggatgcaaagtattgttcctgggtgtgtctgtgagggtgttgccaaaggagattaacgtttgagtcggtggactaggagagacagacccaccctcaatgtgggtgggcaccatctaatcagctgccagcatggctagaatgaagcagacttgctgagttttccgcccatcttctttctcccgtgctggatgcttcctgctctcaaacatcaaactcaagttcttcagcttttggactcttggacttacaccagtggtttgccagggactctcaggccttcggccacagactgaaggctgcactgtcagcttccctacctttgaggttttgggactcaaattggcttctttgctcctcagcttgcagatggcctattgtgggactttaccttgtgatcatgtaagtcaattctccttaataaactttcctttatatatacatctatcctattagttctgtccctctagagaaccctaatacactttatttttacaaaacaagaagtgcttatagaatgacttttcaaggaggtttatgcgatcaaaacacactacagtgtgatgctgggtttgcagggcgaccatggaactgttgggcagaaactcacatatagaatagcctgctaccaaccaaagccaggtttcatctttcccaccagcagaatccacctcttccaaatccacccacatcattgcatggcctgcaggtaggcttttcagcttcctctgattgtcataccaggcactgggcctataaaaagcaaagcggaggctgagaggaggcagaggcaaacactgaaggtgtttcagaggcctattccccctgtgtatggtgagcacagcacctggcaatggatcgggctctcccacccaagccccatgcccactctggccccttacccctcagccttggtgccctgggttccctagttcttctgtggcctcgactcccaactgtgtgaaacctgcattgtcttggagtcagtgagctactgccttctctatttcctgcttttaattccagttgactcttgacttacaatcatgtattcttactggaattgcctccctgaagggcagaaattccctttctcctgctcttttgccccatctgccctctgctggccatcgataggtactgcggtcaaccctgaaaagccgtttttcccagtagcatgtaccgaagctgtttgctctttcctaattcagacgctttctttttcttctttttaaaattttggttgcattgcctcagagtttttcaaagcaacacggaaacaccctttctctttccatgtccccagtgaccatgtcatggatctgccgtaaagcatctcttacagtagtggtctccaacctttttggcaccagggaccggtttcatggaaggcaatttttccatggaccagcggggtgtggggatggtttcgggatgattcaagcccattacatttatcgtgtgctttatttctgttgttatcacattgtaatatgtaatgaaataattatataactcactgtaatgtagaatcagtgggagcccctggcttgttttcctgcaactagaaggtcccatctaggggtggtaggagacagtgacagatttccaggcattagattctcataaagagcctgccattaatctacagcatcagtgttacgctgtagaatggttcagaatcttagccaccgagatccctcgcatgcgcagttcacagtgtggttcatgctcctatgagagcctaatgctgccgctgatctgacaggaggcggagctcaggtggtgatgctggctggcccacactcacctcctgctgtgcagcccggttcctaacagataccagtccgtggccctgggggttagggacccccgtcttacagcatccagcggggccaggcacttggttaagtagatccttgatgactgaaacgtgacaatgctgaaatggctgtggagtactgtttggagtttgtgggggtggggtttgtaaactggagaactttatgttagagtttcttattattgacatttgaggctaaataattctttgttgtctgagtctctcctccacggtgtagtatgtttcgcagcacctctggcctctaccctccacgtgccagtagcaccttccccaagtttgttgtcctcacagacaaccaaaaatgtcttctctactcactcccaaatgtcctgggggggcaaaatcactcactgcggagaaccatggcattagggtgatggagtagaaagcctgctctactcagaaggacttctaagtgccagaaggtgcaggtctgctctctggggccactcagtgctttgaaggacacctgatttattttggagatggacacttaactgctgaatacactggcatgggtgggtggtcccatcgagagtttttctcaaaggttttcaatgactcctcttgtgttctctggcctatcctactccagctctcaattctgctaggcttgagttccagcgtcagagcctttctgagcctctcttctcagtcttagcctcccctccttccctctctctccacccaccttctggccgtctgggaagcttcagcttcatcctgcttccccagcactgctcctccatccacctttttttcttccatagattcgttaaaaacatcttgtctgaaggcagttctcccctttctacatcaccatgggttttttttgcagaattttcttccattacaatcactgattgtaatcaattctctttcccccaggtctctgcctcctctctgtcaggaaggagagagagaagttaaccacacagaactgaccaccctctttacccagaaggagctgatcagccatctttaggcagaaggcttcctccagctgcacccagattccccttctgtctcccacagcaccctgggcttacttctccagatcatgtaacaccctgtgctaagattgtttatctcttgtctgacttcttgagtggatcataagctctttgaatgcaggcattgtgtcttctcactcgcaacatctccagtgttgaggacagaagtgcccacagtgcataggatatactcaataaaggattatcaaatgtcatggaaataaggccttaatttaaattcagtgggaagagattttcttgaactttaagaagacttggggacaaaatttgaacttcttgtatgtgtttctcctcaaagagcatagctctgccttaattcttctgaatctgacatcgagcctctggagtttactagactcttaggctgggaagctcttggtccatttttgatccactgcattctgcagtgagatgaagcccattcctctgacatcccacttggtgtgccatgctgataaacccataacactgatgctgtagattaatggcatgccttcacttatgaacactttttccccatggtgactaatggcattttgatggtgtctccttagacagctgcctaaatataaagcagtatgagctaaaagaataaattgaaaatgtcagtcgttttgtgtaatccttccataatattatctgggagcccagcctagctttatggaaatcattcagtagaatcagacaagatttttcctacagcacttttatgtttgcaaaaccatcatcattgtcagctttaattaatatttatttctgtgtatcacacctcatgttaataactctcctccaggactattaacaaaatccagaactgttatttttcaatagaggaagcggaggtatacacagaggtttgacagcttgcttaaggctacaggataaactcagagtcaagctgagaccaggaggcacagatcttcatctccctgagaagggcggctgctctagggtcagctttgggacatatgcctcacctttgtgtgcccatcagacaaagtgagccacctggtagctatgcctggacatggtaagaagcacgcttttgaaatgaagagggagccatctcattttcctggcatatgtcacatctcttactgaagggagagacccatagctgcctgtattgtccgttggggcatgtcacggtctagagacatatgaaagacaaaaaagctcacttgtcatctgcctttcagtctaggagagacagcccgagactgctgccgtggtggctgtgagacgctgtgtcacatattaattaggaggagcatatgtagcatttctaagccaggggccatttgtggcggcagcagccacgcaggaggcagggagtgcagctagtagctaaatggagggtttaggatgcaggttctcggctcagacaccgggaatgaatccgttaagagaatgttgcggccctccaggccccgctcctcctgcctcgcaggtgcagtcacttgctgccctgggttcccgcgcaaccagaagcttcctgggcccagcgaaagttctcatcccctgctctgtagcccttgagacgcgcgggagggttggaaaagccgagccgattgtgggtggcaggcctccacagagatcgatttgaaggcagaagctgaactcatcatacctctttagagaagaagtagtaacgtgcccttttcgctcaacaaaaacctgggcaaggccaagggaaaggatagcatgccccatgcggtgagcaagggcgcgtgcgcagagtagcccggcccaacactcacctggaaatgcggctgggccagggtacaaatcacagtctctcttccatccccgcccctgccacccacttccctcctccgacttggctttctgcgagtgcgcgtgaggagagacttatccaaggtcagggacagaagtcagaagatcctgatggttgcctgctccttactaactgtgtagcctttggtaagttccttaatcattttgaacctctgagtcctcgttaaaatgagaatgagaatacacatcttacctatgaggcatggtccagtgaactatgagtactgtagagagaagcatgctccacaaatatgaatgataatggtgattttcatattcaactttgtcaggtatacctttaaagtcacacactgaagtactaagatacaaaacccttagccaggcatggtggctcatgcctgtaatcccagcactttgggaggccaaggtaggaggatcatttgaggccaggagttcaagaccagcctggggaacattgtgagaccttatctccacaaaaaaatgcaaacattaaccaggcatggtagcacacgcctgtagtcccagctactcggaaggctaaggtaggaggatcacttgagcccggaggtcaagaggctgcggtgagccatgagtgcacaactgcactccagcctgggtaacagagcaagactctgtcgtaaaaaaaaaaaaaacaaaaacgaaaacagaacccattagggacccaaggcataaagagagagttatgtgatgatacataactctcataattttgaggatgtgctgcccttcttgtgttactgtgcccagtcaggtgaagggactgggatgagacagcccatcacctccacagacctttcttcttttttttttggcagagtttcactctatcgcccaggctggagtgcagtggtgcgatctcagctcaccgcaacctctgcctcccgagttcaagcgattctcctgcctcagcctcccgagtagctgggactacaggaatgcgccaccatgcctggctaatttttttgtatttttagtagagatggggtttcacaatgttggtcaggctggtctcgaactcctgacctcaaatgatctgcctgcctaggcctccaaaagggctgggattataggcatgagccaccgcacctggccagccctttcttaagtactggtagtgtttttaccactgggctagacattgtagaggatacaagaagagactgaatacaatctctgcccctagagaatgagccatctagaaacaaacaaacaaaaaaagaagacaagggaaggaaatagagcactctctagtccagttgttttcaaccttttggaaatgccatgtcctcttgggcagctgaaggtctagaaagtacagtttatattgatctgccgttctgtttctcgaacaccactctgttctcttctcagtggagatgaagcacaaccacatgcttcagatttctttttagatcaagggatctcccaccctcttgttcaaaattctctgtgtggatgctgcttctttacatcttgaagttgaatagaacaagtcctttttcttccttgggcccgtggtctgcatgctggtgacagcccattgctcttgactctcctcaccaggccccttaagtcaatgtcctgcagcacaggatgggtactttctccgttctccctcgaaggtggcctggtagttccctgtccgttaaaaacttttggcccacaaaaatgcagaaaccagttcaagatttacataacagttcatggcaacagaatattgatcacgaggcagtacatgatgagttgccaaatgaactgcatagccctgttgctataggagtggagcttcctcaggtcctctctggaagtaagcagatcatgcactgcgagccagccgaaatgaacaagctgacagaggggaaggagatccaagcagacagagggaatagagggaatctaaggaatttgtctctgaatgaccaactgtactatacaggaaatattgggccatcaaaggatgtcatcactttaataagtcaaacatagttaaatattgatcatttcaacttaaacatttgaggatttggtaaatattttttatatttacttgaaaagtttatgtggctttttctttggatttgaagataaatctagagcatagttttgacatcttatttggccattagaactgatagcatctttcctatgtaccttagactctagagaaattgtcacatttcaaactcataaacactgtgaattgggtatttttaatttttatacagaaaacagaggctcaaaaaggtgaatttgcccaaagttatgcagctggtaactgcataactcaaacctcagcaaataggtcaaacctcagcaaataggtcagattccctgtttatagttgatattcaagaaatatttattgaatcaacctaagtgcacacattcaaaggctcagtcactacattttcatgcaaaatatgtgtgattctcacttatgtatacatatcactcatgcatctcatccaccactttttcctttcgtttacccagttactggatatctctgaacctcgttttctcttccattaaacatataattggtgagcatgtactatggccccttttgatagctgtttctgcttatcatgtctttattcaattttttttttatactttaagttttagggtacatgtgcacaacgtgcaggttacatatgtatacatgtgccatgttggtgtgctgcacccattaactcatcatttaacattaggtatatctcctaatgctatccctcccccctccccccaccccacaacaggccccagtgtgtgatgttccccttcctgtgtccatgtgttctcattgttcaattcccacctatgagtgagaacatgcggtgtttggttttttgtccttgagatagtttgctgagaatgatggtttccagcttcatccatgtccctacaaggacatgaactcatcattttttatggctgcatagtattccatggtgtatatgtgccacattttcttaatccagtctatcattgttggacatttgggttggttgcaagtctttgctattgtgaatagtgccacaataaacatatgtgtgcatgtgtctttatagcaccatgatttataatcctttgggtatacacccagtaatgggatgtctgggtcaaatggtatttctagttctagatccctgaggaattgccatactgacttccacaattgttgaactagtttatagtcccaccaacagtgtaaaagtgttcctgtttctccacatcctctccagcacctgttgtttcctgactttttaatgatcgttattctaactgctgtgagatggtagctcactgtggttttgatttgtatttctctgatggccagtgatgatgagcattttttcatgtgtcttttggctgcataaatgtcttctttagagaagcgtctgttcatatccttcgcccacttgttgatggggttgtttgttttttttcttgtaaatttgtttgagttctttgtagattctggatattaaccctttgtcagatgagtagattgcaaaaattttctcccattctgtacgttgcctgttcactctgatggtagtttcttttgctgtacagaagctctttagtttaattagatcccatttgtcaattttggcttttgttgccattgcttttggtgttttagacaggaagtccttgcccatgcctatgtcccgaatggtattgcctaggttttcttctagggtttttgtggttttaggtctaacatttaagtctttaatccatcttcaattaatttttgtataaggtgtaaggaagggatccaatttcagctttctacatatggctagccagttttcccagcaccatttattaaatagggaatcctttccccatttcttgtttttgtcaggtttgtcaaagttgtagatatgtggcattatttctgagggctctgttctgttccattggtctatatctctgttttggtaccagtaccatgctattttggttactgtagccttgtagtatagtttgaagtcaggtagcatgatgcctccagctttgttcttttggcttaggattgacttggcgatgtgggccttttttggttccatatgaattttaaagtagtttttttccaattctgtgaagaaagtcattggtagcttgatgggggtggcattgaatctataacttaccttgggcagtatgaccattttcacaatattgattcttcctacccatgagcatggaatgttcttccatttgtttgtgtcctcttttatttcattgagcagtggtttgtagttctccttgaagaggtccttcacgttccttttaagttggattcctaggtattttattctctttgaaacaattgtgaatggtagttcactcatgatttggctctctgtttgtctgttattggtgtataggagtgcttgtgatttttgcacattgattttgtatcctgagactttgctgaagttgcttatcagcttaaggagattttgggctgagaccatggggttttctagatatacaatcatgtcatctgcaaacagagacaatttgacttcctcttttcctaattgaataccctgtatttccttctcctgcctgattgccctgaccagaacttccaacgctatgttgaataggagtggtgagagagggcatccctgtcttgtgccagttttcgaagggaatgcttccagtttttgcccattcagtatgatattggctgtgggtttgtcatagatagctcttattattttgagatatgtcccatcaatacctaattaattgagagtttttagcatgaagggttgttgaattttgtcaaatgccttttctgcatctattgatataatcatgtggtttttgtcgttggttctgtttatatgctggattacatttattgatttgcatatgttgaaccagccttgcatcccagggatgaagcccacttgatcatggtggataagctttttgatatgctgctggattcggtttccagtattttattgaggatttttgcgtcaatgttcatccgggatattggtctaaaattctctttttttgttgtgtctctgccaggctttggtatcaggatgatgctggcctcataaagtgagttagagaggattccctctttttttttttttttttttttgagactgagtctcgctctgtcacccaggctggagtgcagtggcacagtcttggctcactgcaagctccgcctcccgggttcatgccattctcctgcctcagcctcccgattagctgggactacaggcacctgccaccacacctgcctaattttttgtatttttagtagagatggggtttcactgtgttagccaggatggtgtctatctcctgaccttgtgatctgcccaccttcgcctcccaaagtgctgggattacaggcgtgagccaccacgcccagcagattccctctttttcttttgactggaataatttcagaaggaatggtaccagctcctccttgtacctctggtagaatttggctgtgaatccgtctggtcctggagtttttttggttggtaagctattaattattgcctcaatttcagagcctgttattggtctattcagagattcaacttcttcctggtttagtcttgggaatgtgtatgtgttgaggaatttatccatttcttctagattttctagtttatttgcgtagaggtgtctatagtattctctgatggtagtttgtatttctatgggatcagtgatgatatcccctttatcattttttattgtgtctatttgattcttctctcttttcttctgtattagtcttgctagtggtctatcaattttgttgatcttttcaaaaaatcagctcctggattcatggactttttgaagggttttttatgtgtctatttccttcagttctgctctgatcttagttatttcttgccttctgctagcttttgaatgtatttgctcttgcttctctagttcttttaattgtgatgttagggtgtcaattttagatctttcctgctttctcttgttggcatttagtgctataaatttccctctacacactgctttaaatgtgtcccagagattcaggtatgttgtgtttttgttctcattggtttcaaagaacatctttatttctgccttcatttcgttattacccagtagtcattcaggagcaggttgttcagtttccatgtagttgagcggttttaagtgagtttcttaatcctgagttctagtttgattgcactgtggtctgagagacagtttgttataatttctgttcttttacatttgctgaggagtgctttacttccaactatgtggtcagttttggaataggtgtggtgtggtgctgaaaagaatgtatattctgttgatttggggtagagagttctgtagatgtcaattaggtccacttggcgcagagctgagttcaattcctgggtatccttgttaactttctgtctcgttgatctgtctaatgttgacagtggggtgttaaagtctcccattattattgtgtgggagtctaagtctctttgtaggtctctaaggacttgctttatgaatctgggtgctcctgtattgggtgcatatatatttaggatagttagctcttcttgttgcattgatccctttaccattatgtaatggccttctttgtctcttttgatctttgttggtttgaagtctgttttatgagagactaagattgcaacacctgccttttcttgtgttccatttgcttggtagatctttctccatccctttattttgagcatatgtgtgtctctgcacatgagatgggtttcctgaatacagcacactgatgagtcttgactctttatccaatttgccagtctgtgtcttttaattggagcatttagcccatttacatttaaggttaatattgttatgtgtgaatttgatgctgtcattatgatgttagctggttattttgctcattagttgatgcactttcttcctagccttgatggtctttaccatttggcatattttttgcagtggctggtactggttgttcctttccatgtttagtgcttccttcaggagctcttttagggaaggcctggtggtgacaaaatctctcagcatttgcttgtctgtaaagtattttatttctccttcacttacgaagcttagtttggctggatatgaacttctgggttgaaaattcttgcctttaagaatgttgaatattggccccccactctcttctggcttgtagagtttctgccgagagatcagctgttagtctgatgagcatccctttttgggtaacccgacctttctctctggctgcccttaacattttttccttcatttcaactttggtgaatctgacaattatgtgtctcggagttgctcttctcgaggagtatctttgtggcattctctgtatttcctgaatttgaatgttggcctgccttgctagattggggaagttctcctggataatatcctgcagagtgttttccaacttggtttcattctccccctcactttcaggtacaccaatcagatgtagatttggtcttttcacatagtcccatatttctcggaggcttcgttcatttctttttattcttttttctctaaacttctcttctcacttcatttcattcatttgatcttccatcactgataccctttcttccaattgatcgaatcggctactgaggcttgtgcattcgtcacgtagttctcgtgccttggttttcagctccatcaggtcctttaaggacttctctgcactggttattctagttagccattcatctaatcttttttcaaggtttttaacttctttgccatgggtttgaacttcctcctttagctcggagaagtttgatcaactgaagccttcttctctcaactcgtcaaagtcattctctgtccagctttgttcagttgctggtgaggagctgcattcctttggaggaggagaggcgctctgatttttagaattttcagtttttctcctctgttttttccccatctttgtggttttatctacctttggtctttggtgatggtgacgtacagatggggttttggtgtggatgtcctttctgtttgttaggtttccttctaacagtcaggaccctcagctgcaggtccgttggagtttgccagaggtccactccagaccctgtttgcctgggtatcagcagcggaggctgcagaacagtgaattttggtgaacagcaaatggtactgcctgatcgttcctctggaagttttgtctcagaggagtacccagccgtgtgaggtgtcagtctgcccctactggtggggtgcctcccagttaggctactcgggggtcggggacccacttgaggaggcagtctgtctgttctcagatctcaagctgcgtggtgggagaaccactactctcttcaaagctgtcagacagggacatttacatctgcagaggtttctgctgccttttgtttggctatgcccttcccccagaggtggagtctaccgaggcaggctggcctccttgagctgcggtgggctccacccagttagagcttcctggctgctttgtttacctactcaagcctcagcaatggcgggcacccctcccccagccttgctgccaccttgcagtttgatcccagactgctgtgctagcaatgagcgaggctccatgggcgtaataccctctgagccatgtgcaggatataatctcctggtgtgccatttgctaagaccgtcggaaaagcacagtattagggtgggagtgacctgattttccaggtgctgtctgtcacccctttccttggctaggaaagggaattccctaaccccttgcacttcccgggtgaggcaatgcctcaccctgcttcggctcatgcttgatgtgctgcacccactgtccgacaatccccagtgagatgaacccagtacctcagttggaaatgcagaaatcattcgtcttctgcattgctcacgctgggagctgtagacttgagctgttcctattcggctatcttggctagctccctattcaattttttttaaagtatgtgtatatgtttatattacacacacatactcaacacttattgtgtgcctgcctctgcaccctgaagcaatgaatgaatgatgttttccgctttctatgagctcagagctaagcagaggaaataaactgtaaacctaagcaagaccctgcccaatgttatggactgaagcaaaataatagaggaatatatgaggtatgtaaagtaagatattgggagaaagtattcaattaagagaagctcacagagagctcacagatagctcacagtgagctaagctgggcagccctataaccccaggatacaattccaggcatgtagcaggcattcaataccttttttctaaacagaatcacattgattaaactgaaaatttcagaaggataaagaagagttttcaaggtaggtaaggatcaggaaaatcttccaagccaacaaaatttaaaaaatcacagaagtatgaaacactatggtaggctgaggacctcaggaagcttagtatgatgatggcattaatttggagaggaacatgacatgagatgtggctggagagtttatacatctcaatggatttttttctctgctgggcagtggggaggcctgaaggagcctaaatagaagagcacagaatcagatttgtaggatgtgtagttggcagataagacctagcaaaagaggtggaaggagatgaatgtgctgaatgagaccactccatgccaatccagggcaaggagcaggatcagagtagggttgcaaggggcagaaatgcaggccatgcagtggactaggaaggggagatgtccttccaggaccaccagcctgacctgctgtgtgtggggactgctctttcttttttttttttttgaggcagagtcttgccctgttgcccaggctggagtgcagtggtgcgatctcggctcactgcaacctccacctcccagattcaaacaattctcctgcctcagcctcccgactagttgggattacaggcacatgccacccatgcccagctaatttttttttgtatttttagtagagatggggtttcaccatgttggccaggctggtcttgaactcctgacctcgtgatccacccacctcggcctcccaaagtgctgtgattacagatgtgagccactgcacccagcctgctctttatttctttaggactgctctttatttcttttttcagttatttaaatttatatcccactttctaaatttgagatggttttttctttttttctttttctttttttttttgaggcagagtctcactctgtcacccaggctggagtgcagtggcatgatctcggctcactgcaagctccgcctcccgggttcacgccattctcctgcctcagactccggagtagctggtactacaggcgcccacaaccacgcccagctaattttttgtatttttagtagagatggggtttcatcgtgttagccaggatgatccgcctgcctcggcctcccaaagtgctgagattacaggcgtgagccactgcgcccagcgagatggttttcaatagaagaaatatgtataatgaatttattaaaatagaaatagattattttaaaaaaatagagaaagaaatcaatagtttaaaaccatacactaagccagtatcactactattaacgagcattaagtttggtttaagcttttaagctgccaaagaaaaaaacatatagcacagagttatttagtcctcattattttttgagagagacaacttttttcctggtactaaattctgtaaggaatttccaaagttgggccctattaaaggtgctaacatcaacactctatccccatcgtttcattctgagctgtcctcgaatgtctcctctgagatttcttgcctggctgccatttctacaacagcactcattctcaagagctcaaggaaatgtgagccctgattccacacttccctgtacccactttctctggattaccttttaagatgatatgctcagttctagtcagaaacgggtataagcaatagcacatggagaatctttccacatttttggaaaaactgatgttgaagacattgtccattgtttagcaaatactgaagacccacactgagcagaatactgtttcaagaaaagatcatacagcagggatcccaatagataaagttctggcccttgtaatcctatatttttgtgggaggacaggcaatacgtaaataaatatatgaggcagtgttaggtgctgggaagaaaaataaagcagggtaaagggtcctctttcagatggcgtgctcaggacgcctcctttccatagctcaactttcatctcacacctttttatctggctacatcaccttttccttagcaacagaacagagaacaaacattacagaaccaaataccttcaccaagttgaccactaaggatggcaggaaaatgttctgctactatttgaggccagaggcttatgccaaattgttcatcacaaaaataagtctgctcagccaggtcatttcaatggtaaatctaattcgaaattaagctactgaatccaaggtctttctgaattccctttcagggttccagaataatatatttgattgtttgaggcagggtctcactctgttgcccaggagttgagggcatgatctcagctcactgcaacctccgcctcctaggttcaagcaattcttctgcctcagcctctgagtaagttctgcagtagcccagctaatttttttttaattgtatttttagtagagacagggtttcaccatgttggccaggctggtctcaaactcctgacctcaagtgatccacctgcctcagcctcccaacgtgctgggattacaggcatgagccaccacgcctggccttatccagcttttatacgggccatgccctcaacatttattagctcactgaatgagattcctagtagccacacgctacagactgaattgtgtcccttccaaattcgtatgtcgaagccctaacgcccattgtgatggcatttggaaatggggcctttgggagtaattaggtttagatgaagtcatgatggggttgaggggtatttctcatgatgagaatactgtccttataaaaggagataccagagagcttgtgcacatgccctctttgttttcaccatgtgagaatacagcaagaaggcagcagtgtgcaagccagcaagagagccctcactagaacccagtgatgctggcatcttgattttggatttctagcctccagaactgtaagaaaataaatttctgttgtttaagtcacatagtctatggtattttgttatggcagctcaagcagacttgttatggacaccacacaagaaaagaggcagtagagcatatggttacaaagctgggctctggagtctgactgcctgggtctatatcctgaccccaagaattcctctctgggtgatcttgggcaagttattttacctctctgcgagtgatctccttgtctgcaaagtgagaataataatagtaaatatcttgcaatgttttgtgaggattaaactacttagcacatgtgtgacaatgagaacatgtctgacacataatgctcagtaatgtttattattattataactccaatttacatatgaggttactgaggctttgagaggctaagtaagttgcccaaatacatacagggagtgggttgccgattcagaatttgaacctaggcttctctgactctgtactcatgctccttctgttatgactgtctctgtcaccatgaatacaaattaaaatgatgttacctagaagagatctagctccaaataacaacagaaaaacaggagtcctcacaaaaaactgggatcctccattacagtggtgtgttgcttaattagccatactgtatttatcaaatgctactgtgtccaaggtctttcactgaataaacagtggtaactcaaagcaaataggatttctctttgtctgatttttcacttcactccttcagttgtttatttgtataatatttactgaactttgggggattcacagaaatagtgaaaatgatgctgctctcagtctcaaggaggaaaggacagaaaacatacaaagggcaaatctgtagagaatatgatctgatgctcaggacagtggacccagtcacaaaagaactggactgagacgtaagatttggttgatccagggtgggactagtcacacagagttggcctaggccctgcagaaagtaactgacataaattagccaggggttctctaaagcaaagatttcaaattttagatctagaggataaagttatcctgaataacattacctctcctaagacattacaaattcagtgaaattcagtgaatattacaaaaatcagtaagtttttatgcgatggctctgtgtttgttgaatttttaaaaatccatttgtgttttcatagaaacctgaattttacatccccatgctaaagaatttcccctttggttcaacaaatgtatcagtcagggttcaggcaaaagatggaaaccacaaaaatattattttaacagagtaaatataatataaagaatagttagctagatatagttaactaagtaactaaaaatataataagaaaactctgccatttcatggaggtagcaccagcaggaagcagctctaaggagagggtgctggcccatgctggtgtctgtctggggggcacaatgatgctggttctgcaagggctggagacattgcagacctgactcagctgctgatgcaggaaggcaaagaagcattgctagagtgatgctcacaggaacgggaggtagaccagaagccaaaaagaagcatgtctcttctttctcctccagtcttgcagcctcattctagcacttcctttggcagagcctaacatggaaccaactggcaatacaaatataaatacaacacaagaatgaatgtggcatcttctctcatcttcagcataaaaggaatgacagacatgtaaaccagaaagcacaatacgtatatatcataccagaagattgtacagatgtgagggcagcactaaatgagaaatgattcttctggttgggtgcggtggctcatgcctgtaatcccagcacattgggaggccaaggtgggagaatcacctgaaactaggagtttgagaccaacctgggcaacatattgagaccctgtatctataaaaataaataaataaataaaactagccaggcttggtggcacgtgcctgtagctacttgggaggctgaggtgggaggatcagttgagcctaagagtttgaggctgcagtgaactatgctcacaccactgcactccagcttgggcaacaaaattagatgccgtctcttaaaaaaaataaaataaaagattcttcttacttacagtagcagcttggaaagacttcatagaaaactcttgagctgagtcttcaaagacaagctttgttggtcaggtagacacagtcaccaagaacattccagacagaaagagcagcctgaacaaagatatgaagaaggaagaagtgggatgtgtccagagatcatgaaaataatttggcccgattggactgtggggcatagaaaatggatgatgtggaaagaggtaaggttcgtgaggtaggctagggccagatcgtgaatactcttccatgccagctgaatggtgggaaccctatcctagaagcagtgaaagatttgttagcggggtaccatgaacagaattgtgtttttgagggataactcctggtttgtgatggagaatcattgcaggagagcaagggaggccagttgggagactgttatgctattccagttgagcaatggttagggtttgaccaggggcagcagcagtggagatggatggaagaggcagactgcggaaatgctaagggagtagacatgagacaagcagggatcagggtgggcagcagagacaggagtctgggtttggggcttaggtcgtgggatggatggtgatgccattctccaagaaggaaggttggcagaggctggtctgtaggtgaaggaagaaataaaaaggataagatcatgacttaagctttgtacactgggcttgaactttccaagggctgagaagattttaccttaaaaggagttgagttgatactgatctcatctttaataggactcgacagtccagatgacatcaactactgccttcctaaaaaggtgttgctcattaaggagatagaaaccattcagcaattccaggaaagatctctgcaatctttaacacttccagaaaatatagtcatcatttccacattatcattctttccctctgtccgcttgataatgttgaggcctgtgttggcaataggacagatgacaacaaagattgacatgtgaatggctttgtcctggggcttaatgtctaattcctcaacatgatttctgatctaaaatatcctcctaagatgtccagaaaattaaaaaaatatattttctattgtgcctgaagtgaattcaaatctcagataatgatgttactgctattcttaagttctcaggaatgactgctgccacattttagtcaactaagggctactgtcatagtcagagctactttttctttctttcctatctcttgcattgaggtagcaagtataattatagaagtcatagaaagccaacacaatagaattgttcttgttaagtatttttagaaggcctccttaacattttgtcttctttttgttcattgaacttatcttcccttacataaaatatagttgtttaaaaggaagaaatgaaggaacaatttgtgaatatgcagggagtccatagatgtcccagaatccacagggcaccatctctcctgtcttttccctctatctctctgacttccttttgcacacattctcacccacccaaccttttagcactatctctgtaaagtctagctcaaaaccatagcctttctccttccccagatacccaagcccagagcaatcctctgagctcctgcaacatcaggactataactccattagcctttaattgccaatattgagtatgaaatatcatctttctatgtgcatatctgtctccctaatagattataagtctctggagtgcagagatcctctcatttgcctctttacacactttgtgcatatagtaactggcctttgattaattacttccatgataagcttgacccttgttctccccggctaagccctagaggtcaccagatacttactttgtggctaatctctggccttcctgctgtttacaaccaggcttccttctagctctagaggatcttacacagtacagagtcactgaataagctactttctttcttaatcacctcattcatttcatttattcttccttgtatttactttgtggctaatctctggccttccggctgcttacatccaggcctccttctagctctagaggatcttaccatagtacagagtcactgaataagctacttcctttcttaatcaccctgttcatctcatttatttctccccacagatgagccactctttctaatttgtatcatatttattaactctctatcttccagtaacacaacacacacatcttgaggctacacaaagtcttgctaaatgggatacactactactctcagaaggaaatcaaccaccataaaagttaatgtgctcaccccataaagaaaaatcttcctgacacacaatggtagcttgaaaattggtgtattcattttatgacctcctttattagccagaatgatgccttgtttgatttctaaaatttgtttaggatcattagcaatgggctcctgggtgtcactgacaacttatacattagccttgcacacaagtcctagaaatgagaccaaggaaaccgcagtttttattccttctagggtataattttttctttctccaaccagtacctgaatatttctcaaataatttatattttcagattttacaaacatctcagcaagactatattagtttattgaccccattttgcaaaagggaaggcagttaccaatagtaggaggctttttggggccacgatggtttcttagatgagtcagtatcagacgtgagctctaatatgaccctatctaatttcttttctctattaggtagtttcctctgtcctaaaaaaaaaaagtaggaagagaagtatactagcttgcccctcttgtgtgcctctggctgtcagaaatagaatttgaaagagtagatgagaaaatgtgagaaaacccgtttactgataactgttcctatcttctcaggttttttatctctggccacaaagagtgattgggagaaaacatactccaaataagtttttctttcaactcctccttaactctcaaggcagtaattgccaccccctgccctccctccccggcatcaccactctgctaatacaaacgtgatattttacctttgcttctagctttggttctttttagcaataatatgtcttgagtggaatgagattttttcttccttttttttttttttttgagacggagtctcactctgtcacccaggttggagtgcagtggcaagatctcggctcactgcaagctctgcctcccacattcacgccattctcctgcctcagcctcctgagtagctgggattacaggcacccaccactatacctggctaattttttgtatttttagtagagacggggtttcaccatgttagccaggatggtcttgatctcctgacctcgtgatccacccgccttggcctcccaaactgctgggattacaggcgagagccactgcacctggccttttccctccatttttaaacttttattattattattatttgagatagagtcttgctctgtcacccaggctggagtgcagtggcgctgtcttggctcactgcaacctctgcctcctgtgttcaagcaattctcctgcttctgcctccagagtagctgggattataggcgcatgccaccaagcctggctaatttttgtatttttagtagagacaggttttccccatgttggccaggctggtcttgaactcctgaccttaggtgatccatccacctcagcctcccaaagtgctgggattataggcatatgatattttaattgagcatttcctatgtgccaaataatgtggtcagagcttattttctaataagggagtaaaatttgcattgttaactatgctagtaataccttctgggctacaacaacattgttatcagtttctagctacttaatgatgaggtcagatttgataagttcaggagttgtttgaacttcagagaaggttgatccagtggctcaatgttgtccgcaatgagcagatttttctgcctttcatcctaaggctgtcatccccatcgtgtcaatgtggctgaactgcttcaagctttacatccacaaagcaaaccatccaggagagatatttttcttgtcaaccatttcagaaaaggccacatagccatcgctaaatcaatgaccatggctaggcagtggggggtgttgatcagctgaagcaaatgagagcccatctctagaactttgggtgagaagagcttcttcccagatatataacataaggcaggagggaaaggtgaacacttgaacaataatgtaggatactacttggaagagatggggagaggggttaaaaacatctaggtaggcaaccaacagaccaaacgtctccaatacacatccctattttatcatatcccaggccccaggccaggccttatcacatcatccttgggttacctgagaattttccagctgaattcacaaatgcctcttctctatttggtctgtattcatttacctaggaatttccacacttctctctgataagttacctacttttcatctttacttcctgtattagtctgttctcatgctgttaagaaagacatacacgagactgggtaatttagaaaggaaagaggtttaatggactcacagttccacatgactggggaagcctcacaatcatggcagaaggcaaaagagaagtgaaggcatgtcttaaacttacatggcggcaggcaagagagcatgtgcaggggaactcccctttataaaatcatcagatcttgtggcatttattcactatcatgagaccagcatgggaaaggcccgcccccatgatgcaattacctcccaccaggtccctcccatgacacgtgggaattttgggagctacagttaaagatgagatttgggtggggacacagccaaaccatatcactttcttttctttgacatgtcctgggattctgtttgccttccagtcctctttgcagtagagattagaccttccctcccctactggtaggattattcctcaatctcctttttctgctttttattttttttttttttgcaagctttccccagccacctgttatttccaccttccctatggtactccccaaacacacccttccattcctactcatccatcaagagaaaatgcatgtgatgaagtcccatgttcacatcccacaacacagatagatggcaccaacagtagatgctccatattgtataggcgaatgtaaattgacttgtgtttatgcttccaaaatggatatggtatgtttctttcactttatcccctttacacttacaatttgaccagcactggctcaaaactttatttcaacaagtaagcaaatcaccaagaactccagtgcctaaatcttgaatttagcagctcaaaccagaaccaccaatctcatagtaaaacctagtcccatgagaatctaatgcaacttgggatatgaaaattatcttagtattcaaatagcctccaggagttgagatgcttatctgattctcaagattggaagtttccccccttaggatctcaggatttgatgatcagatgtaaaaatctctggtaattttggaacatattttgggcatttttttcaaaacccgttattattattattatctaggatatgctccatccagatactcctctggttttgggtcacttcagccagtgagtttttcctaagaactcttccccatcattccaaagcagctctcagaaaaatctcttttagaaacgtagttagaaatgataggagccatcataaagaacagatggttactttttgtgagaaataaatgcttttaaaacttctattcacagcattaactaaggaaacttgtccagcccctaagagttgctgagactcctttcagttggttctttgctaacattgatataagagatttgagttcattgtaaaaaaaaggtctttgtaaacccattaaaacaatattgtcaaacaggggcttagatgcatacatagctggctagatggatggatggaaatgcaaaaaagcaaataaactaaaatatgaatgttaaaatgtagatggtatgtttatgggtattcactgtctaatttttaaattttttctatgtttgaagattttcaaaataaaatgttggggagcaaaagaatcttgaagaaaaaagagatggaccagttgagggagaggtggtacactgacacacctttggaagaagcctacagacaatagggagaagtccatataagcatggcattacggggtgaagactggaagctctaattgggcaaaacaagagaagaatagacataatagttcctgtgagaaactgtcagaagtacagctagtggcatataaatgccttttatcactgttcctcccattacaatcaaaatcctattaacagtctgtcaggagggaagagaaagtctgaaccctgtgccaagcactttgcctggattatccccttcactttttgcaggaagaatgtgtatttatttatactgtgcatttatttgcttgttgcattcacagcattgcttaccccttttccagctagaatcacactagttctcctagggagactcacccaccatcactgaatatagacttgatgccctatcctacctgataaaaggtgtggacaaataacccgagtgaacgaggtcaagtaggcactctctccaggaaattctaatcgtgaacacagttggtaatgaattgaaaattgtggagttgacaacatagagacctcaaagaatgttttcattagtgcctgctatctggatcctttggaactctctgaattcctgtaattttgattgggcagtgttgcttctgttacttacaaacaaaactcttaactgaaggagggaatgtagctcccatttaagaaatcaagaaacccaagctcagaggaattaagtgtcttggctcatgtcaacatctgatgtttgtacctgagtccctctggactacaaagtccatcttttatactgactctactatgcttcctctaactctatagactgggtttaattcctgcctctggcacttactagctggataagtttgggtaagctgtgtgccagttttaaattttaaattttttgatctgtaaaatggagtaaaaatagtcatgtatctcacagagctatggagaggataaaataagctaatttatgggtggtgtttgggcatgtgtctggcacataagtgctcaataaatgtcagctgtgatgatgatgatatcagtcagggttctggcaagaaaaaaagaagtgtttgaggagagtttaatgtaaggctaattagaaaagcgaggagagggtgaaggagatgaacaagggatgggtgaaggaccccagggctagaaagagcagcaagctgtggacaagggctgcccaacaaggctggcatctctacttgtatttctaaattagtggccatggcagacacagccaacagtgattcagcaaagtgggagccaggcaaataaataccctgtttgtgccctctcagttcaccctctattttcctgccagggccttgaattggccaaacctaaccataagctaaagacaaagaagtctggttgatgcagtccatgcaagtcaatgtctaaggacaaaagcaggctgcagaaaggtagatattcaacctggagatacttcaccacagcatactcttagctaagtgaaaaacatgtgtccctgacacaggtcacctccatcccatgctctcccagcccctctgcaggatggggttctttatttgcaggaaagttttgaaacaatttgagggttcaaagttcttagtcttgtctgtgttcccctaaatgttcccatcctatgtctcaaattttggctcttttctctgctccataacaaaacagatgttgatgcagttctcagatgctgggctggtcctcactcatatctttttcaaggtggttggtaagcagctcttttaaagctgccattaaagttttctgatattatacttgtgccctgaatggacctacaaagcttttaatttttcctttcatctgtgtacattatctaggactcacagaaacaccagtcacaccacaatcttgataattaccattgtcaccgtagcaactaaggaccctagctaattgatctttcaacaccttgccctctacttgcattgcatcccaatctctgctactaggaatgatttgagtaacatagcgtggattatccatatcccattttcttctgttaagaagcctccttgttctcatcaaatatgttagcaacttgtatcagttttctattgctgctgtaacaaattactacaaatttattggatcaaaacaactcacatttattatccttcagctgtgcaggttaaaagtctggatacaggtcccactgggctaaaatcaaggtatcaaaaagactgcattctttctagagaccctaggggataatccgttttgttgactttcccatctttagaggctgcctgtattctgtggctcatggccttccatcttcaaagtcagtaatggctgttcagtctttcctacatcacgtcactctgacactgactctcctgcctgcctcttccacttttaaggacccttttgattgcattgggtaatcaaaacctggttaaccaagataatctctatatttaggtcagctgattagcaaccttaatgctatctgcaaacttaattcccctttgtcatgtgacataatctattcacaggctccagggattaggacacaggcatcttttgaaggccattattctgcctaccacacaataccatcccaatactattttaagagtctgtttcctgaggccatttctaaaggtactactctatttgtctgggttctatcaggaaacaaatggcatgctcaaaaggaattattggagaacatttgctgaagagacaattgcaaaaatgtgggcaggggaaaggaaatccatgagggataatgaagcacccgaaagacaatgacagcaggaagggtcagggattgggggaagcagttagcaggaccaggtgatggctgtgccttaggtaaaggatcccagccagtgccaagccatagcccagcagggaagtgaccaggggaacagatacctgaatctctccttctaccctttgatctccttccagtgctgtcgattggccaaacctgcacaaggcagaaggcaaaggagcagagttgatgtagccaaagaaagtcagcatcgtagggcatgaagcaggtggggaagggtgaataatagatctatggagccgacagactataaactgcatattatttaactaaataatttctactaaaaggtaaatgggactaccacccagcatggcatttgtattttaaaatagccaaactcaaattaatctataaatagaagttatggggaagtatttttgagcggcaaagcctaaagcgagtcctatctattaatagtaagttccactatagaatgtttacatcaacaactaataaaaataaagaggtagcacatctatacagaaatacgggatgtcagttattttatccttttaatgagggaagaatcacatggatttattccttcactaccatgaactaaaagggatttcattccatcacagtgatgatagcaccaactcaaaggatgtagccatgaagataccataatttttccatcatttgacaaggactttataaataaacatagtggtggtcatcacattcaggataaaatgctggtctggcagtgcatgtaggttacatgaacactttttcatctcaccagtaaggttactcagacacatgacaccatattttccaataactacagtgcacgtataggtccaaaaagtaggtctgaaagtaaaggagctgatatgcatgtttctgtcactcatgttccatgtgcataaaaaaaatgacaaaccaacccaacaaaacccaccagctcggccaagtacatgctcagggaaaggagtttccttcacagtggagaattttccagtgagggacagacacaactgtagaggaaagagcatttcagtaaacaggagagtcttccagagaaaactctgtgcagaataaattctttttccttcctcaaaccacagaggcctataaattcctacctccaaagtgtctggaaaggtaggatgttacagagagcagttgctctcttagtccaagtgaagttcagggaagaattacccttcccaagacttccacatggcatatacatttggaacaatttcaatggtaaagaaatagagtatttagacatgtaatgactgaagtctggattatggaggtcaaactaaactcctgcattgtacattttttaaaaatgttaagaagagtacatgcttattattctaaaacttctaagcagtacagaaccatataaagtgaaaaccaaaagttttctccttctcctctttctctccctccttccttctcttccttcctctcccttccctctctctggcgctctctctctctctctctcatttttattctctatatatctatctccagctacttactcatacaggaatatggttacagatactcctctaaaactttagaagatctgtttttaaggcatggtcatcaaagtggaggggaataccagatttaccatggcatggaataccatatgggaatttctatgtattttaactaatcctattttatagctacttgggagtatgttatgtgagttagacagtactataccatatgcataaaaattacttatgtacaaatattcacatattgaaggtgcatggatgaaacatttttctgaccaaagtgcctgatttaaaaatttggagaccattgctgtaagaaactgaaatgtaaacatttaaataacattaagagtatccatcagctgatgtgtcagctaataaaaggaatatttataaggtgcttacaatgttccagctgttctccttgcattatgtcttatgtactatgcacaatggccctatcagggaggtactattatttccccaacttctcaaagagagaaactgaagcacagtttagtggattgcccaaagctacacagctggaaaatggtcctcacaggaaacaaacccaggtctttcaatctaaagatacagtgctcctcacactactccagaagtgactctaccatagactaaggcagaattaaaaggcagcaacaggaagagagaagatgggaagcccctgattgacaaaagaagaaggacagagtcaagaaagacatcctatcccaggcacacctgccctaccgatggggaggtagcagttaataccagggtccatgctacaattctgctgcgactttataatgtaatttcaatctaaatataatccctctgtgtggcagattatattttccaaagacattggcacaatacatttcatcctgcatgcagttcctacaaggcattgctacttcttccataaaaatgtgtagtccatcttttttcctccttataaaaaactatgcagccataaaaaagaatgagttcatgtcctttgcagggacatagatgaagctggaaaccattattctcagcaaactaacacaggaacagaaaaccaaacactgcatgttctcactcatatgtgggagtgagaacatatggacacacggaggggaacatcacacaccagggcctgtcagtgggtgggggacaaggggagggagagcattagaacaaatacttaatgcatgcagggcttaaaacctagatgacgggttgataggtgcagcaaaccagcatggcacatgaatacctatataaaaaacttacacattttacacatgtatcccagaacttagtaaaaaaaaaaaactaaataaaaaaacttttaaaactaatcaatgagtccagtaaagttgcaggatacaaaatcaacatacaaaaatcagcttcatttctttacactaataacaacctatctgaaaaagcaatcaaggagacaatctcatagtaaaatcaaaaagaataaaatacttacgaataaatttaatgaagaagtgaaagatctgcacactgaaaactataaaacattgatgaaagaattgaagatgccacaaataaatggaaaaatctatgttcatggattggaagaattaatattgttaaaatgtgcattctacccaaagcaatatacagattcagagtgactatgggagatgatggatgtgctaacttgcttgactgcagtaatcattttgctatggatatgtgtatcaaagcatcatgttgtataccttaggtgtatataagtacacacacacacacacacacacacactcaaaggtgttcattttctcacccctcttgaatctggaaggcctgtgactatggtggaagtgatgctatgtgactgccaaatagtttataaaaagtgatacagtttccacctggaccccataaagttcatttctgttatgcaggtgccatgttgtgaggaaacccagatcacattaagaggccacgagtaagtgttccaaacgacagaccctgctaaggtctcagctgacagccagcatcaactgccagacaagtgagtgaagataactctcaccccagccatcatctgactgcaacacataagagatcttgggcaagagctgcctggctgagcacagtccatccccaaaacatgagagataataacggagtgattgttgttctgggccactaggttttggggtgatttgttgcacagcaatagataaggagaacaccgttgtgccccctgtggtcatgtaaggacaataaatcaccagaaataaaaaagccctcctagtgggtggtcctgaatataaccacacttttccttcaggttttcccttttgggttgctctttggtccttgtggattcagcttctgctgaagcctgggagaccctctatcccatagcttccttctccctttctctttcttttctatcctctgtccttcctactcagtggaacatgttcctggctccatctgggaaggtcccagtagatccacatatgtgggggttctacctggagtgcatggtggaattaagctgaggcctttggtatttttcaagtagtctctagaagacaaataaacctctcttatttaacatggattgcctctcatcccataatacagatctcccttccttcctaccagacatgaggaaaaagcccttccagtcacaaatagagtaactgttagtaaacatatataacctgtctcttgttcagggtctattcttttccccagactaactcctccagctagtctctcagattgaccttagacactgcctcctgaaggaaagcttccctgactcactccccgacccctgaggatgtggctgtggctgcggctgcagctgcagctgtggtaggtttccagcctaggttccaccaacatcctaaaaaccctccacttgaattatattgcagttgcctgttgctgtctctttccctcatgactgtaagccctttgagggcagggatgtgtttcagttattcgttattgtatcatccagtaccaggcagtccctgatactaagacttttctgataaaagaataaattttagaaatcccaatgccattccctcttcttcagatcaagtgaatatctacaccatttttaatgacctctgaaaggcatcctagtagtttgcctggtatgtacttctgatactctgatgcataattgtagaattcaaccagtcaaaagttcaccaagacaaaaatacccactgtagagtgatggacgtcttatcacttcttaaagcactgcttcccatttttttgaacatctcagtttgctagaaaggccttttacacgttcagaatgggtctgtcttcttgtcattcacactgtattggccccaattctgttggtctttaaaacaacctagatttaatcttagtctttatattctactctgtaaaacactcccttcattaaaacagaaattctctcacaaaaggataatgcattaagttggtcaatatttggctcaaaattgctgatcaaggcaggcatgttttaaagaggaattagtgtgctctgtggaagaaggattaatttggagtatagggtggatggagagggagcctcaaagctcagaaaagcaggagcctatgagcatctggaattctctaatgggataaggagtcccaggagagcgatatggtcaaataccaaacccaggatttatctatttaaccacatcactaatggactgcccgggctgtgggaggttgaccagcaggcccacctgttttgagaagcccacccctcaggctctgtgactgagcctggagcacacatacaagggtctgtgaaataaggctcctgacacagccagcctcctggtgttctggggaattccagctattttggggcaggggctgtaggcattgtgttatctggaggtatttctgataaatatccaagattagtgtctttgttcaggagcgggtaggaatagggagaagtcctagttgtcttgatcaccctggaattaccaacccctagctcaatgtttagaaagaaacccagttcctggcatcctgagcattgaatatgctccagggagccaatccaatctcgagtgcaggaaaatcttaccaggacaatttcaaaagcttataattgatatcacttgggtggctctgagaaacaacagttttgtaagagataaagtcttttttggaatatattattcaaaaactaaaccccagcatttctgtggtttgtatatttcattttgtggaggtatttctcctcttccaggccatgtgaagacttgaaaagaagagaaaatatatagaataagaatcagttctaaactactcattgatttactaaggagaaatgtgagtgatttaagtccctggggttggaaggtctccttctccttgtgctgagaaaagcaagtatcacttgttttccacctcccacctcccattggtgctggtaaatttcccagagaatgaggaacagctgcttcccaagtcagggtccttgaaaagggctcagtcatcagctatggaatcagctgtttgtttccttcctccaactaggaagacactagaaaacacagaaatttaaatatcctttgtctaaggacaagagtgggaaaatgtgattcttcttggtttctttttaagtctttttctttttttcttttcttttttttttgagatggagtttcgctcttgttgcccaggcaggcactccgtggtaattttcttcttaccttgctgtcttccctttggcttactcatttctcactgcatgtttcttaaaagtagtgttcccctggtatctagatttgactttcttttcattggaaaacctcacctcaagtagtctggtccattcctgtagcttcagttaccaaatgtatgcctatgactcccaactctttattctctccctgatggtgtcactccagctcaagacctagagacctcctggcattttcatgtgaatggtccagagattcctctaatttatatctcagactgagctctccactttctcattccttctcttaacaagctctatctcctacattcccaccaccatgcaagtatttgctcaaaacagaaacatagacccctcccccatcatccatatcaacttttaatcaatttctgtcagttgttcctacttaatcctctagaattttttcacttttccgtatctgctctgtcactgccttagttcaagtcaccgtcatcttccatctcctaatggattgctctgccctttgttttacccctcatcagttcatccattacccacactgcaagctacatggcttttctttagataaaacttggccatgttactcccaaaccttcaaagggctttaagggtaaaatccatataccttggaatggcatgcaaggcccttcaagatataagggttctgccagtttctcccgccccatctttccccattcctctgtcatgcaacaatcatgttgaactgccttccacagggctgcaactctctctggcctctggacctttgtaaatgctctttttaagattcagactacctctctacaccacaaacttgcctatttctcaaggcttgtaacggatcacaacttcttcgagtagattcttgcaggtgttgaaatctgggctaagacctattgtgtgctttaccaaatcttccataacacctttttttttctttttttgagatggagtctgactctgtcacccaggctggagtgcagtggcatggtcttagctcagtgcaacctccgccttctgggttcaggtgattctcctgcctcagcctcccaagtagctgggattacaggcgcctgccaccacacccagttaatttttgcatttttagtagagacggggtttcaccatgttggctaggctggtcatgaactcctggcctcaggtgatccacctgcctcggcctcccaaagtgctgggattacaggtgtgagccaccatgcccggcctgtttctttttaagtcttgccttctcctccaatgctggacactgaataggcgctctgcaaaaactggttttcataaaatcttgatactaatttaacagactattgtaatgaaaaaaggaaaatctataggctactcctgggcaatacagattctagttatccttatgtagtagaatcagccctaagccagtgttgacttgcctagaatttcagaagtgggctgtcattccatgaagaccacccattcagtctggcgttaaagctctttagtgctgttgagaatcaatccctgacagagaaaggccaattccctgaatgagaaaagaaagggccatatcaggctgagagtagaaaagaatatcttcccataagcccattcctaaggatagggtgaggctacccttaaggatagggtaaggctaccctttagtgcttaatcaaagagcagtgaatgccaaataaagggagattatctgttcaagaaaagccacgatgttgtagagcacacaaaatagtggcaaatcactgaatggttcacacatgggtccatcatttaggaatattagagaaatgaaaagtggagtacctccactggggtgtgtgtgtgtgtgtgtgtatgtcatgtgtgtgtatgtgtgcacgtgtgtgtataactttcagggtggcatattttctcttctctttcctgctctttctacctctttctcagaattcttgggaatatatataatacaggagcaagctctttaatgcttttgccacagagacaatgaatcctgcctgactccaaaggaaggatgggtgttgccttctttctttcctctctcttatctttttcctttgcgaccatagggtaatttcttgtccgtgccgagttttattttctctagttagattgttaaaacattcaggttcacgttcactcagtctttcaactccacccatttttgttgatgtatctctgacccacactcctattagaggaataaggcttgtcattaataattcctcatctgctaattctttaaagaaactagaaagaggaggatgtgtaattcgtatttatttctgtattatatgaaagaatcctaattctgggtacttcaggtatttaagtggtacttgttggcttattaacagggaatgctttgtgtaaaactggaaccaagagataaaaacgtgtcatcagaaacctctgtgtccacttctcaatttctcttatatccactttgttttattttatatgcagtctatactgcatatcagggtttgtggttgcaaaaatcagaagctaaatctggctaagtgaaacagaaagggttttgatgagaagaatcctgagtagtatacagaattgaggggaaaggcagagaagcagttttggaaagaaagcagccagtaaaggaggctgagaagcatagtgcacaggcaagagcagctacaggaagagactccatcaccatgagaccattgactgccaggcatttggcacacagccgctgaactcaactctgctgttgccagagtacgtgacttctcaccatccctgaacctttgcatcgctctctccagatacatgtgataaaatatattctaactccacactcaggaactaggtaaacagccataaagaatgtctgcagttactactgagatgcatctgtttgaggctcactttttactttacgcccatgaacctcactctgaccagtggatgacagtggcattctgggtcctcgggaataaatgttcacagccaggttccaaatatccctcctccccaagaagtatcatacagttgccctggtatacattcatgaatgcctttggggactgcttggagatagagtcacagcgtgcacttcagtaaagatttctaggttgcccatcattcagaatgctctgggatttgtgaactgattcaggtctgggaaatgggagagtcatccttgttcaagtaaaggctttttttctatagaactggaaggttttagttaaacaaatcaaattgagatttagttgctgtccatgtatttcagttcagggaccccgtgatcaattaaccactatggttcaaatcttcaattattcccactggacctgctgcctattatggtagccacattcactttgtttctgctggttaaatgctattatttgactttatgacatcccaggatcctgatattatggaagccaagacaattttggcattcctcaccccaccactggctattgcgaggttgcagagtgcagccactagagtgctgttcagagatgttggcaagagcaaccctcaccaatgtattgggtgggcttggtgatatctggaccctcttggggaatataattcaagggtgggtgtataggttcccagtctaaatctactccagtattcctaatcccttaaatctttgtttttttgtcctatacatgattcagaggaagctttggcatatacatattgttttgtttatgctgtcatttcctaaagcattgaccttgtctgtatagtggaggccatatcagagccatatgggcatttcaaaccagagtaaagagggaaatgccaaaatatttttttttttttttttttttttgagacagggtcttgttctgttacccaggctggagtacagtggtgggatcatgactcactgcagcctcaatgtcctgggtacaagcaatcctcccacctcagcctcccacgtagctgggactataggcacacgccaccatgcctggctaatttttgtattttttgtagaggcagaatttcatcatgttgcccagtctgttctccaactcctaggctcaagcaatctgcccacctaggcctcccaaagtgttgggcttacaggtatgagccattgcgcccagtcccacaacttttcaagttaaaattaaacaagtacaagtagatgcatgtcttacttttgctcatatcctaaactttttcacatagttattcatatatagctgcaaagagaccaggaaatgtggtttatatctgtgtggtcacatatttgggaagaaggaaaaaaaagattttgaataacaactaccagtctgccaaacaaacttaagcaagaaaacatttatagaaggatatcgagtagtttacaggattattagaatgcttcagaggtaggaatataaaacaggcaatacccaagggtttctagatagctgtgaatacaacaaagttcatgccccagaaatggtctagttaagatgctactgcagatgaatacttgtttcaagtatgtctggaagtgccataactgaacatttcctgctgtcattggatttttcactccagcatttttgtgtagttaatcactatttttgcagttttacatcacaaccttaatatctgaaatagtgggtaggagagtcacattgacaagactcagtctgattgagtcacagctttcaggagtagggagaaagaatgttttatcttagctgggcacgatggctcacacctgtaatcccagcactttgggaggctgagatgggtggatcacgagatcaggagttcaagaccagcctagccaagatggtgaaatcctgtctctactaaaaatacaaaaattagcccagcatggtggcaggtgcctgtaatcccagctactcaggaggctgaggcagagagttgcttgaacctgggaggtggagggtgcagtgagccgagatcacaccactgcgctccagctggtgacagagcgagactccgtttcaaaaaaaaaaagaaagaaagaaaaaaaatgtttgatctcttttattattagagtgagtgtcaggaccctgcctcctgctaaaggctacagagtagagatctcaaattggaagagggtttggatattgagtagcccaagaaagacaaacccctattttatagactgtgtctttttagatagcaagctgtctgtcaagagatccagctcatatcttcccagccagcgacctcaacagaaagagaatgtctctctaccattacctatgtgttaagctcagggaagatgctgatggacatggtttggatgctcctttctgtactcatcactgaggtctaagagtggagtattttgattgactccttctacgcaaacatgcccacatttgtgactaggagtgcttaggaaagcgccgaaattgaaagctattcataatccgtgaagtggggagagggaggttgtcccaaggaagatgcactggaagacaaaactacaaagttcattttagagttctcataatcatctggtttatctcttgactaccatttaaaaaaaagcttataatatcttcctttctcagttacctgaatatcaccataaaccctcagatttcattactaatgaaactttggtttcatcaggtagctctttaaatctgtggtaaggcttcacccatgagggactaactatgggattagccctctggccataaacaacactaaaactgcaaaatatatgaggcaacatttttttaggcatttgaccatagactgcacaaaactgcaataatacttgagagaaggaaaactcaagagatgagccccacaatcactgtatttgttggcctggggacaactttagactttggagatgctgaactgattgggatctttagagcaaggcagggcaccagagaggaaagagctaaacagaaaggagactcaaaaatctgggtaggggttcttcatgaatccttggctaaggtctagactgtgcatgtttagaatgagtccatactaggtttacaggagagtggctaccatggggattgagaggagaaaggggtatcagagatggagtagtgttggacgatactagagtgctggcttaactagagtgcagagcccttgttaataccctgggtacccagatgaggcaccaaaaaggacctgctttaggaggaaggaccactctaaagcaagacctacaatagacccaccccaacaaaccctaaaaatgagacttaatgagatctgtgaggcttcagagtttggaagctgactcaacccaggttagagagtctaagaaaacactttgcactttgcacatgtctgccataacaaaccataaaactaatacataggttcaaggtgctaagccagtaattaaactacctcctagaacaaaagtcaacactcttcagaggaaggtcatagaatcaaaataatctacaatatgtcaccaaaaatgtccaatatgttgtaaaaaattgccaaaaataaaaagaaatacaaaaatgtaagccataattgagaaaaaaatggcccaaaagatttaaagcagcagttatacatattttcaaagatttagaataaaatatggtcttaatgagagatcatatagggaatctcaatggagatatgaaaactctattgtttttttaaaaaaagaatgagataaaaattctgggactaaaatataaaataactgaaatgaaaattcactgataaggattcatagcagagtagattacagaataaattatcagggaacttgaagacagatttagagaaattataaaatattaagaacatgcgtaattgaaatcctaaaaaagaaaggaaagtgagaaaaatggagaaaaaaattcataaaaacaatggccccaattttctcaggtttgatgatttatattgacttacagggctaaaagcataatgaatttcaagcagagtaaacacaaagaaaatcacaagtgatgcgccatactcagactacttggtatggcatgtgaaaagccaaagctaattaatagtgttaaacagtccagtgcttccctagggtgagagtggtgggaggagattggagaaagggacagaaaagttttggaatggtagaaatattgtatgcattgatgtgagggtggttaaatgagtgtatgcatttgtcaaaactcatcacacttcacttaaaatttgtaccttttgttatatgtaaattatttctaaataatgttgacttacaaaactagaagtgatgcttagtcaatctaatacttcaaacattctaacttaattattttgccttatttttatgtctttacattttagttctttacattttagttcctataagtctggtttttattgctttctgtaaaaggatgtactagactccaaattgagagttgtattcacacaaatactgacatatcttgttttgttgcgctttgcagatattgctgttttttttttttttttttttttacaaattaaaagtttgttgcaaccctgtgtcaagcaagtctgttgatgccatttttccaacagcatgtgttcattttgtgtttttgtgtcacattttggtaattttgcataattaatattattacacttttaaacttcttcataattaatattattatttttatcaggcagcctccaaacctgaataggttcagagagattccccattatttttatatctgttatggtgatctgtgatcagtgatcttcgatgttactactgtagctgttttggggtgtcacaagctgcaccccaataagatgtcaaacttaatcaatcaatgttgtgtgtgttctgactgcttacaccaattagccattcccccacctctcttcctcacctcaggcctccctattcctcaaaaccatattgaaattaggccaattagtaaatcctacaatggcctctaagtgtttaagtgaaaggaggagttgcacgtatctcaatttaaatcaaaagctataaatgattaagcttagtgaagaaggcatgccaaaagccaagataggctgaaagctaagcctcttgtgccacacagttggccaagttgtgaatgcaaaggaaacggtcttgaaggaaatttaaagtctactccagtgagtacatgaatgataagaaagcaaaacagccctattgctgatgtggtgcaagtttgagtggtctgcatagaagatcaaaccacccacagcattctcttaagccaaagtccctaactgtcttcaattctataatggctgaaagaggtgagaaagctacagaagaacaattggaagctagcagaggttggttgatgaggtttaaggaaagaagctgcctctataacataaaagtgtaaaatgaagcagcaagtgctgatgtagaagctacagcaagttatccagaagatatagctaaaataattgatgaaggtggttacactaaacaacagattttcaatgtagacaaaataaccttatgttggaagaaaatgacatctaggactttcatagctagaaagaagtcaatgcctggcttcaaatcttcaaaaggcaggctgactctcttgttaggggctaatgccactagtaactttaaatttaagtaaatgctcatgtatcattctgaaaattccagggcccttaagatttatgctaaatatactctgcctgtgctctataaatggaacaagaaagcctgtatgacagcacatctgtttacaacacggtttactgaatattttaagctcactattgagtactgctcagaaaaaaaatatttctttcaaactatgactgctcattgacaatgcacctggttgcccaagacctctcatggagagagatatacaaggagattaatgttactttaattgctaacacaacttccattccatagcccataaatcaaggagtaaatttgactttcaatttttattatttaagaaacaaatttaataaggctatagctgccatagatagtaattcctctgatggatctgggcaaagtagattgaaaatcttccgaaaaaaatttaccgttctagatgccgtcaagggtgtttgtgattcatgggaggaagtcaaaatgtcaacattaacacaagtttggaagaagttgattccaaccctcatggatgagtttaagagttcaagacttcagtggagatcactatagatgtggcggaaaaagcaaaagaatgacaattacaagtggagcctgaagatgtgacttaattgctgcaacttcatgataaaatttgaatgcaagaggaattgcttcttatggatgagcaaagagtggtttcttgagatggaatctactcctcgtgaagatgctgtgaacattgttgaaatgacaacaaagagtttagagtattacatacacttaactgataaagcaatgacagggtttgagaggattggctgcaattttggaagaagttctaccatggataaaaaactatcaaataacatcaaatgctacagtgaaatgtttcatgaaaggaagagtcaatcgatgcagcaaacttcattgttgccttactttaagacactcctccagcctggacaacatagtgaaacctcatctctacaaaaaataaaaaattgctcaggcatggtggcacatgccaagtagtccagctgcttggaaaactgaggcaggaggattgctttagcccaggagttcgaggctgcagtgagttgtgatcatgccactgcacactagcctgagcagcagagtaagaccctgtctcaaaagaaacaaagaacaaaaaaagacatttctacagccaccccaacctttagcaaccagccactaccctgactagtcagcagccatcagtatcaaggcaaaaaccttcaccagcaaaaaagattacaactccctgaaggctcagactacagtagagtataaacatagcttttttttttgttttttgagatggagtctcactctgttgcccaggctggagtgtagtggcactatctcggctcactgcaacctccccctcccgggttcaagtgattctcttggctcagcctcccaagtagctgggattacaggcatgtgccaccatgcccaactaatttttgtatttttagtagagatggggtttcaccatgttggccaggctggtcttgaactcctgacctcctgtgatttgcccaccttggcctcccaaagggctgggattacagtcgtgagccactgcacctagccaaatttttatatgcactgggaaaccgaaaaaaaaaatgtgtggcttgctttattgcaatattcactgtattgtgatgatctggaaccaaaactgcagtatctctgagatatgcctataacatatgttgtttgctattttctccttattaaatagcagacttcagcctagtcaaattcactcacatgaaatccacccaactacacattttctgctgccactgaatctttaatcccttaatagaatgcctcagttactgcgtctattcattgggcattatatatcactgttactacactatatgttgaaatacatattatttaaaattgcaaataagattctacccttaaaatattcatataagtgactatgaaagtgctataaaaataacatgttgtgtttataatttgccattttgtttcttgcctaattatttaaaaaattaaaactttgatattttggatgtgatgtaaaatttcatctcatttataaaaagtgtgctgagaattttatccaatatagacaaatttaagataatccatgtggcatcaaaatagcttaaattacttaacagctatgattgtttggaattagttcttcctttcccaagaaatgctttcgctgtggatgaaagcagactctggctgaggttttgtgatgttataatgataggaaaatgctagaaaaagacagaggagaagaatctcagtgtataaacagtggagacgctaaacctgtgaggttaattttagtcagttctactaaaaaaaattttttttaagtatgagcctatagggataaaacaagatgatataagcagagcagaatagtagatttgataaagtatctgctaaggtaaagatattttatattgagtaatacagagcagaagaagaatggtgattaaatccaaaccataagacttagcagtagactggagggcctttctcagggcaggatttgtagccagcagacaggctttaaatccaagtttcattgcttactacctatatgaattctataaatcttggttttcatgcttgaaaaatggctataatagtccttgcctcctaggattcttgtagaaataaagtaagatgcaaattgcctaacatggtacatggcacatagacacccagtaaacatttactgatccctcgacatcagaataaaagaaaagggtagttattctaatcttggtacagggtgtggcagaggatttttgctctggcttctggaaacttgtataagtcaaagcttacagaaaggacgtctggcattgggctagttattgcttcaagtacacgaatgcccccagagggaagcttatactctagattttccaggatacaaccatttatgctgtaggaagaggccaggagcaaagtaagctgcttgtgaataacagaaaaactgtccttgtgtactacgatgataatgttaacaaaggaagttatttccctaaccaaatttattattgacccgaaagtgagataaaaacgatattttttttttccagagccacataaagcctgaagagaaggctaggaaaagcaacgagctcgagaaactgggcaatgttcagatcagtagctatggaaaactctcctcattcttatgtcacctcagatttaatgcccacaatgtcccagtgtctgtacatttttatttcgagcatgaaataataataatgacaggcaatttaaaatgatgaccgctatttttgtgtttccttgagaaatggaccaattttctcatctattctggcatatggcatagtgtgtgtgtgtgtttgagtgaaagagggagagacagagagacagatagagagaaagaaaggaggggtgcaagaagagaagaatcacacagatgattcacacaacattctgccctcactaaaggaacagagaatctaaaagtttaaagtcaactcctctaggatatagtttaaaatagtctgatgtcaagggatgggcaaaagtttattcagtgtctacgtgccatgcaccatcttaggcaattggcatggtataaaattgctatggcaaccactattgccttaaacaatataagattaaaagggtttctttttttgttttgttttgttttttgagacagtgtcttgctctgccgtccaggctggagtgcagtggcgtgatctcggctcactgcaactgccacttcccgggttcaagtgattctcctgcctcagcctcccaagtagctgggactacaggtgcatgccaccatacctggctaattttcgtacttttaatagagacgcggtttcaccatgttggacaggctggtcttgaactcttgacctcaaattatccgccagcctcagcctcccaaagtgctgggattacaaccgtgagccaccgcgcctggccttcttttgtttttaattttaatttttatcaaaacaatactcatacttggtgaaaataaaataatgtggaagaactcaggaaaactgatattttcccattcagtctgacatatggtcatttcttctgattgtttccatatttaattctttggctagttattttcataaatgtagttaatataattataactctgtatcctgatttttcatttatggtcattatcaattaactcatgagaaatgaaaatttatctcacagtaatctcttccttctcatcctcttcccagtatttcatattatttttaacttttccattagttagtttcatactattaaataatatggttaaaattatttgtttccatcaactttctctgcatctttccaagttggaaagtgtcctcactcctctacattcctcttctccctcacattgcatcttccgtcagctctatattatttcacattgtcaaatatttattaacaattagattatgtctgaaaatttcaccaaaattcttactttatccatggattgactctaaatctgaacatgaataatctttacattactatcacgatgtaaatgtagtttactgcttggtcgagtagtgtattaggattacttttgattttctattgtttcaacgccaggattcttgagtcacatttttttaaaaaagtattcctagcattaaaaccaaatatattttccttttcctcactatttcatttgcctaaataggtatgacattttcatttgcttgttaatgtaccatacttttataatagggtttttatttttctgaagttctttttgcccctctcttatttgagagaagagggtcatttcagactttttttttttttttttttttttttgagatgcagtcttgctgtgttgcccaggctggtctcaaactcctggcctcaagcaatccttctgactctgcctcccaaagtgctgggattacaggcctgagccactgcacccagcccaggcttttattatctcctcaataattaccagtttttgatcatacattttactgcattcagacttccttcctggtcccttctgcttctggctttagtctggactgaagttctctaaatctgctgcaaatgtcatcctgaagattctcatcattgttttactggtttgaattcacggattcttgaatttcaggtcttcctttttctttttgctttcaatgacactggagtaatgtcctctagtacctaagacaagttgcttgcaaatcacattttctgagtgcttgcatgctttaatctctcattatattggccagacagaattttcagtgtgaaaataattttcttaggagtctttaaagcactctactttttgttttgttttgttttgttttaatagatggggtctcactctgttgatgaagctctgtgcagtggcgtgatcatggttcaccacagcctcaacctttcaggtttgagggatcctcctacctcagcctccccagtagctgggactataggagcgcaccaccaggcccagctaatatatttttatttctggtagagacatattttgtttactagcatccgctgttactcttcagaagtctgatgacagtctgattcttattcatttgtaagtgaactgtcttgtctctttgaaagcttctttttaatgttttgtaattttatgaggctgtatccaggtacaggccctcttttattcattgcactgaacattctacctggttttcagttctagaaattttttttccttcttttcttctgaaatttttattaataggataatgatgttaatggattgctcttctaatgtctcttttttattttgtatatttcatatttctatctctttgacatcatatattctgagagatttttccactttaattgtcaatccttcaattgaatgtctaacttcagtaataacccttctgttctctaagagctctttcttcttctctgtccgattttgtagaacatctgtggcaactatggaggtgcaccctcagatctcccttcaagcagaatctgctagaaatgattcagttaactgacagcttccaagtgtggtatgcttggaatccctgctgcgttaaatccatgccctcgctccctgggaagccccagccaatgaatgagcatggtggagactccagagcctggtggtttctgtcaattgggataccccaaagtgctggctgagattttcttagagctacactacactctggagctcttcctttccagtcctctttccttcccctcttctttcacagcctattagacctgcatcacagtctgaaagtatattcctctgctcactcctgttccctctcgcctttatcttccaaagtcattgcccccagtacatctcttaaacttattgtcttagcttttgcttcctagggaactagaactggcagagcatcctatcttgctttacgaacatacttgcttcctacatctctctatttcacttatttttataacacccaatacatctaacaggggacatttaacctggtgtagtgaactagtgggctcaaattgcactgtacgaagccgaaattaactagacaaaaagatgtcatctgtacgtcacaaaggtaaagggggagactgggtgcacttttcccccaactttccagaggcggcaacatttttaataattctaaaaaatgaaaaaattggcaatattagatgaaagcatgactttcttccatctgctactgcatacaattttccgattttgtggcaagatatgccacagcctcattcaaatcatttgcaccaagaatcatgcagtgccttgcacttttagttatcccagcacttgcccaagtcttgttttgccactggattttaggacttttgaggacagggactgtgtgttatctttagtgcctcataataataacaataataagagctgagccattgtttatcatgtgctaattatatgcctagccaggtaaggtggtaaacacttcgtatctattgtttcatgtgaaaacacaaaatctccgagaggtcatgtaaatggcccaaggtcccacagttaggatgaggcacatgtctgccttcctccagaatctatgctctctatcatatccaatactgcctccccctgtacctgacacacagaggacactcaatagctgtcaatccattggttgagttacaactgctattaactatagacaaataggtaatagaaatctcatttactgtcctataatatgtgttctatagatttgtgatggggaacgaatgaatatgcagggctgtggaagcctcatacattctcaaaaattatcttgctaggagaaagcacatcgtttaccaataccaaatcctttattttacatgaagttccctgacactgtgaagctctagtagtaagtgcttttttatctttgaaatataggggtggggggaggggggagggatagcattgggagatacacctaatgctagatgatgagttagtgggtgcagcgcaccagcatggcacatgtatacatatgtaactaacctgcacaatgtgcacatgtaccctaaaacttaaagtataaaaaaaaaattaaaaaaaaaaaagaaatataccttcttgttaagaggcagaacatatgaagtctcttattttccctcttacagcatgtcatttagggactctgtgggagaggaggtagtgtgtcaatatatgagtgcttgctctcatagagaaaaccagctctatttatctaagcttctccccattcccctggagaagtaattaaaccaaatcattgaccccttctggagtagcccaggagtcggttttatttatgtgaaagtaaaggatctgggaaaaagaaaatgtcattggggcaaaatcagaataaatccgtttacatggaaaatatgcacaggagatttgacagcatattttgtgatctcttttttccaatgttcagaaacatgaacttttataactacaaaggttatcccttttgtccttagaattcctttgtgattatacatagctcaccgggggttgcttgtcatgaatggttacaatttttcactcagctgttgttttaacagaggctcagggtttgctcaggaggtgaatatgtgactctcctccctcccccaacaatagcatagttatttaaaggcaaaattcccctgtttttctcctaatcgtttctaccaccataaagccgtaacatgcacattcacctcccttacttcttctcttcagaagatactggggattagcagtcataaccccagaatataaagtggtgatcccagtctttaaaattgggctgtgacatggataagagtctggcatgcaaatcatctttggaaaccaaggctgactagtgcctaagcaccatttcagttagtagcccatctaagggactatgggaaacatataagctgatactcttgatgccagatactaatgtttaggttatctctttggaagtgttatatcacctaatccagagccaatcaaagtgtttgatttttctcaaacctgacttaatacaagcaagactttaaaagtttaaaacattttggccgggcgcggtggctcatgcctgtaatcccagcactttgggaggccaaggcgggcggatcacgaggtcaggagatcgagaccatcctggctaacacggtgaaaccccgtctctaccaaaaatacaaaaaattagccgggcgtggtggcaggtgcctgtagtcccagctactcaggaagctgaggcaggagaacgccgtgaacccgggaggcggagctttcagtgagccgagactgtgccactgcactccagcctgggcgacagagcaagactctgtcaaaaaaaaaaaaacagtttaaaacatttttctgaaaggtggaattgaattgatctggaggacaaagagacggttgcccagtgaatcagaatttctacaaatgtttatcaattacttaccacctgtaagccactgggttggatgccagggatacagtggaataagtagaataagacagacatggccactgccgtcatggggcaatggaagacaatcactatataagtaaacatgaattatgattgatgtaggtcctacaaaggcaaggtttgggagctatgagactgagtaacagagggatgcaatgccacttgggtgatataggggagtctttcctgagaaggtgataacttaggctgagataagcaggagttatccaggggaagagtgagaggcaagtagtacagcctgtgggaaagcccagaagtgagaaggaaccgggaagccagtgtgtcttcagagcagagcctgaagttcttcacttgggatccccaggaagtctttgaaaatcagataattgtctgaccacagagagtgaaacttggttatacagcatttgcaatccacttgctattaggcatgcagtaaataagcagccatttcccaatgtgccatagcacagcatggtggtgaaatgtagttctctcctccagacacacctgcagtcataccaaatgttgtgtatacatggttattcattggagcattgactattctagcaaaagactggaaacaactcagtgtctctctgtaaggaactggttaaataaatcaagatataaccacacaatggagtagtatgcagctgaaaaataatgataaattatttacagacttagatgaaaggatctccaacatataacattaagtgaaaaaataagatccagaaaaatgtataacaagtgctaccacttatataaaaaaaagtaaaagtaaagaatattcgagagcataagaagacaatccacagggtacaataatatttgcaaaagacatatgagatgaagggctattatctaaaaaatacagagtggaaagatattctatgttcatggattggaagaatcaatattattgaaatgtccatactacctaaagcaatctagagattcaatgcaatccctataaaaataccaatgacattctttacagatgtagaaaaaacaatcctaaaatttagatggaaccataaaagacccagaatagccaaagccatcctaagcaaaaaagcaaaactggaggaatcacatcatctgacttcaaattatacttcaaaactatagcaaccaaaacagcatggtactggtataaaaacagacaaatagaccaatggaacagaatagagaccccagaaacaaatccacatacctacggtaaactcgttttttacaaaggtgccaagaacatacactggggaaaagacattctcaataaatgctgggaaaactggatatacataagcagaagaatgaaaccagaccccatatctcaccatatatatgaatcaaatcaaaatggattaaaggcttaaatctaagacctgaaactatgaaactactataagaaaacattggggaaaaactccaggacatcggtctgggcaaaaatttcttgagtaatacccaataagcacaggcaacccgatcaaaaaaatggacaaatggaatcacaagttataaaccttctgcacagcaaaggaaacaatcaacaaagtgaagagacgacccacggaatggaagaaaatattggcaaactatccacctgacaaggcattaataaccagaatatataatgagctcaaacaactctgtaggaaaaaatctaataacctgatctaaaaatgggcaaaagatttgaatagacatttctcaaaagaaaatacacaaatgacaaacaggcatatttaaaggtgctcaacatcactgattattacagaaatgcaaatcaaaactacaatgagatatcatttcaccctagttaaaatggcttatatccaaaaagaggcaaaaacaaatgctggcaagaacacaaagaaaagggaacccttgtaccctattggtgggaatgtaagttagtacgacccctatggagaacacttcggaagttcctaaaaaaactaaaaacagagctatcatatgatccagcaatcccactgctgggtatatattcaaaagaaaggaaattagtatatcgaagagatatctactttcccatgtttattacagcactattcacaatagccaagatttgaaagcaactaaagtgttcatcaacagacaaataaataaagaaaatgtggtacatatacacaatggagtactattcagtcatagaaagaatgagatactctcatttgcaacaacatgaataaaactggaggtcagtgtgttaagtgacaggcacagcagacaaacttcacatgttctcacttatttgtgggcactaaaaatcaaaacaattgaactcatggagttagaacacaataatggttaccaaagccttaggagggtagtggggtgagggtgggggaaaatggggatggctaatgagtacaaaaaggtagatagaatgaataagatctagtatttgatagcacaacagagtgactacactcaataatagtttattgtacatttaaaaataactaaaagagtataattgtattgtttgtaacataaagaaaagataaatgcttgaaattatggatatcccatttaccccagttattacacatcatatgcctgcatcaaaatatctcatgtaccccataaatatatacacctactatgtacccacagaaattaaaaatcaaaattaagtatacaaagaacccttgaaacccagcaaaaagaaaatgaacaacctaattttaaaatgggcaaaagatcggaacagacatttcaccaaagaaaatatacaagtggcagatatgcatatgaaaagatgttcaatgtcatatgtcattagggaatgcaaatttaaacaataatgatataccactacacaactatgagaatggccaaatccaaaacgctgatgacactaaatgctgacgagaatgtggagcaacaggaactctcattcatttctgatgggaatgtaaagtgacacaacagtttagaagtcagtctggcagttttttagaagactaaacatgcacttaccatatgatccagcaattacattctttggtatttactcacgtgagttaaaaatttatgttcacataaaacctggcacacagatgtttacagcagctttattaataattaccaaagcttggaagcaaccaaaatgtccttttgtagattaatggataaataaactctagtacattcagagaacagaatattattcagcactaaaaagacatgagctatctagctatgtgctatgatttggatatttgccccctgccccaatgtcatattgaaatttgatccccaatgttggaggtggagcctaataggaggagtttgtgtcatgaggcagatcccccatgaatagatgaatgacctacctgggtggaggacagagtgagtgagttttactctattagttcccttgacagctggttgttataaagagcctggcgtctcctgttcccctctctctcttgctttttctcttgccacgtgatctctgcatgtctccttgccttcctccatgagtggaagcattctaaagtcctcaccagaagcagatgcttgggccatctttgtatggcctgctgaaccataagccaaataaatctcttttctttataaattatgcagcttcaggcattcatttatagcaacataaatggactaagacaccatgtaagacatggaagaaacttaagttcaaattactaagtgaaagaagcccatccgaaatggctacatgctgtataattacagctctataatactctggaaaaggcaaagctatagagacagtaactaagatcaatggtttccaggggttgggggatggagggatgagtagacagagcacagagaaattttagggctgtgaaattgttcaatatgatactataatgatggatacatgccattatacatttgtcaaaacccacagaatattcaacactgagagtaaactctagtatcacctatggactttgggagataatgatatgtcaactgtaacaaatgtatcattctggcagggatgttgatagcgggggaggctctgtgtgtggaaggggacaggagatacataggagcccctttttactttccactcaattttcctgtgaacccaaaactgctctaaaaaataaagttgattgtttaaaacaaaacaaagtagagaatatatttgcatttggttgcatttatataggaaacccttgaaagttactcagaagactaatagaagcagttacctatgatattggaggtatggggcagatggggatggtggtaggaggctaaccttttattttatacctttttttaatagtctttaggcttatgagacatatgaatgtgtcatttattctaaaattaaattatatgaagtgggcactagagttaaacacatcatcttgattcctgactccgtcatttattagctgtgtagcattgtaacattacctaactcttcagtgcctgactttcctcatgagcaaaacagggctgataatagtttatacctcaaaggaatgttttgaggattaaatgagctaaatacatgtacagccactaaatcagtgttcatcatataataactgcttaataaatcatgaaggtagtcatgatgctgctgctctctaaaggcatgtaatttttcctatgatacctgtggttttctctgatgattgaaattcctggtggaattatgagtaatttttattttctttgttatacttaaagtattttccaaatatttataaagatcatgcatgtgtgatgagaaaaatccatgtttttttcattgtagtaagaacatttaacacaaaatctaccctcttaacaaaattttaagttaaaaatacagtattgttaaccagaggcacaatgttgtatagctaatctctagaacttaatcatcttgcacaactgaaactttatatttgataaatatcaatttcccttttctatctacccccagcccctgaaaaccaccattttactctctgtttgtatgtacttgactattttagatacctcatacaggtgggatcatgcagtatttttctttctatgcctgccttgtttcacttagtataatgtcctccaggttcatccatgtggtcttgcatggcaatatttcctccttgtgtaaagctgaataatattccattttgtgtacatatcacatttttcttatccattcattcattgaccaacatttaggttgcttccatatctttgctgttgtgaataatgctgcaatgaacatggaagtgcaaatatctcttcaaaatcctgaatttaattattgtagatgaatacccagaagtgggattgctggctcatatggtggttctatttttacttttgtgaggtacttccatactgtttttagtaatgatgtaccaatttacattcccaccaacagtatacaaggattccaattccaatttctccacatccttgccaacacttactatcttttttttttttttcagtaatagccatcctaatgggtgtgagctgatacaggattgtggttttgatttgcatttccctaatgatcaatgacatttagtatcttttaatatacatgttggccatttgtatgtctttggagaaatgtttactcaagtcctttgcccatttttttgtttttgcaattgagttgtgtgagttccttagatattttggatattaactctttatcagatatatgatttgcaattattttctcccaatctataggctgccttttcattttgttgattatttcccctgtcgtacagaaccttttagtctgatatagtcccacttatctattttttattttgttacctgtgttttggtgctgcatccaagaaatcattgctcagaccagtgtcatgaatcttttcctccatgttttcttctaggagtttgatagtttcaggccttaaatttaaatctttaatccattttgagtttatttttgtgtatggcatacaataagtttattttaaaaaaataaaataaaaattgtccatctttagtcttaaactctgcccactgggtcttgcctttacctgtgccctgcctcctgcccattaaaacagcccgatgcactcacccatgtgcactctccagcttttccaaaaattgcccttctggccacaccctttttccttggttcactgttgctccgcataagtcctatgcctggctttagaattctaacttcaaccctagctctttgggactaatgtttatatttgtttacttgaaccttgattatacttaaacataggtatgaattccatctagttttgtccccaggaaaccacccctgatgacaagctcttggctgtcaccatggctttgccaacgctggctgtcccctaagtttgggaatgggtggtgcataggaagttaagataatttacattttatgcagaatatataatttttggcatgataaaagagttggcatctgggcatgagttccaaccaaagaagtattaaatttataagagactcatttgaatttctaatgtgacatgataagcatgccttcttgtaaaaacattttacagaaaaatagaatagcatgacgggctggcggtacagacaattctgtcaacaactgctggagctgttccatgcagcattcaagaattccttgatttggaaaaaacaaataagaaacaagctatacggaagtgtaaggacgacagagccatgtgctgattgcttggggttttaaggaaaggacgggagtagggtgaactccctactagcctaaggtgaacattggattcgacaatcagagagaactcatcttaatgattggtcctacccaagatctcaaccacattctctgcatttccaagaggcaaagaaaatgagctgtcactaatgtgttttatgttaactatcaataggcggaatttgtgaaccgtcgcatgcttagcatccaaaataattccctttaggctgacataggaaagagaaaagaaaagataaaacaaaaagtgaacatttttgctggtttgaaaacatttatagcctgattttctagccaccagcatagaaatatttatttctcagtatcatttttatgtttatagtactttccaaattttctacagaaagcttaactttaaattgggaatggggctgagcacggtggctcacacctgtaaacccagtaatttgggaggccgagacggatgaattgcttgagcccaggagttggagactagcctgggaaacatggcgaaaccctgtctctacaaaaaaatacaaaaaattagccaggaatggtggtgcccgcctgtagtcccagctattcaggaggttgaggtgggaggatcacctgagcccaggagatcaaggctgcagtgacctgtgattgcactactgcattccagtctgagcaatggagtgagaccctgtccaaaaatacatatatacatacacacataaataaattgggaataggattttctttttctatgtattttcccctaatataaatgcaaacccaaacattataaaagcaaatatgtatgtttttatttgtgtgttttctcttcctcctctttctgctcctcctccttattctttttttagtgagttgtagtaaaagtagcagaaagtgtgcttagagaatcataatctgtagaattggaagtcacaaaaattctatgttgacacttggctaataataatagcaataataatcaatcaacagctttaaagtgctctgtcgatgtccctacatgacacttacacgtggactgagcaattggttttgctttatagctatgtcctaaggggcctccataaaaaagaagcaaaaagaaagacacaaaagagaagaagaaaggaaatgtcatttaccatgtatttagtgtatacaaaccctgtgccagatatgttatatacctgaattcatctgttctcctcaaggccctatgaatgggtgctagtgtcccagtgatggtgaggaaggagatgatggtggtgctggtggtaatgattaccagttttgaggctgtctgtaagctaggcactatactctcttcattcaacctgtattcattcaacaaatgtttgttcagtgcccatactgtgtgctaggccctattctaggcacttgagatatatcaatgtacaaaacacacaaaaattcttgctcctatgaagctacatttgggggtgaaagggacactagacattcccagataatacacatataagtagggaactgagagaatatgttagaaagggatacgtgctgtggaaaaataatagatcagaccacagcaggtcaggattgtggcatggggttcaggatgcaatttttaatcaagtggtggtagtagccctgactgagaaggtgatacctgaagcagctaaagagtttggctggccggcgggtggctcatgcctgtaatcccagcactttgggaggccaaggtgggcagatcacaaggtcaggagttcgagacaagcctggccaacatagtaaaaccccgtctctactaaaaatacaaaaattagccgagcatggtggtgcacgtctgtagtcccaggtactcaggaggctgaggcaggagaatcgtttgaacccgggaggcggaggttgcggtgagccaagatcacgccactgggcaacagagtgagactccatctcaaaaaaaaaaaaaaaaaaaaaaagagtttggccacatgagtgtcttggaggaaagggctccaggcaatgggagcagccagcacaaaggccctgcaacaggaagatggctggagtattcgctgaacagcaaggaggccagcatggctggacaggggagagaggtaactggggccagatcctgcagggcctttcagggcaatgaaaggagtctgtcttctattctgagtgaaatgctaagtcattggaaagatatgagcaggcaagtgacatggtctgatgtacattttaaaaacatcactatatggtatatatacaccatagaatactatgcagccataaaaagaatgaaatcatgtcctttgcaacaacatgagtgcagctggaggccattaacataaacgaattaatgcaggaacagaaaaccaagtaccacatgttctcacttttaagtgggggctaaataagcattgcatacacatagacataaagatggggccaatagacactgaggactactggaggggggcgtgggctgaaaaaccacctattgggtactatgcccactgcctgggtgatgggattattcagcccccaaacctcagtatcacacaatatacccaatgtaacaaacctgcacatgtaccccctgaatctaaaatgaaagttgaaattatttttaaaaaataaaaatatcactatggctgttgtattgaaataatattctcccttacatgtataatttagtgtgatcattttctgaaattcctataattctcattttacaagcaagaagtcgaagggtagaaaaatcaagtaatctttgagtaagtggtagagccaggaatcaaacccaaaccaagaattgtctgaattctaagcctgaactcattttatgactgccttgaaagaacaacttctaggttcccattagttcatgacaactgaaacatatgtttcagacataggaagaagcagcatgttctatctggcttaatagatggagggcaacaaaaataataaattaatggactaacttagcaaatgagtaatgagttcctcctatgtttgtagacaccgtgttaagtattggaggggcaaactcaccccttagatagcttatagtttaagaagtgaaagatagatattgacaaatatgtgtgataaagtattattgaaacaattttaaaagaatctataagctccagtgggggccaaaatcaaagtgatcaattctaagatggaggggatggactgtggtatgtgactctttgcagttgggaaaactttttctctcatctgatgtcttgtattgcctagtttacagtctcatagtttagttcaagtggcttaagaagatcttgtttttctcttgaggtgctttccaggaaaaaaatgtaagactttctcacttgaagcatcctctctgggtcttaccactttgccatcttgctgcattggagagtcctttggtgcagtccttccaaaagcccctgccaatcatcagggagggagcgttgggaaatgaagacatggtctgtgggcaccgagcctatcctgggtcagaattcctgattctacaatttactaaactgtgtaacacttggaaatccttgtaccctcctcatctgtaactcaggcataaaaataccacttcatagcattgtgttaaataaaacagccaaggcaagatgagcctgattcataacaattgcctgatgagtgtgagctctttgtgggattattttagcgacattatcttcccacaccagaatttgtggcagtgctgaactggtcattgctttggtcaacatttatagctatccctcccttggaggaggaactccagaaggctggctgctggctttatttattattcctgctggaagggaggaggacagaaggctggggaatcacaagccccttgctgggatttcacctcagctggttccatcagtagcctcaccccagggattacataaatattttgtgttcccagaacctcactctgggcactgtcccaagagagctcagtgtttagaatgctgtgtcctcagcagtctggcttcagactttattagttaagagaaactgcagcagacagaagccctcttttgagtgtttctagggagataatgagcccatcaccatcacaatcatcaataagcattggcttaacatgtcctgtctccaggacagtttgctagatgcaaaaatgattccatccttggggtcggcctagtgtcacttacttccgctccactctggtcacactacttaatatttgatgaccctttgacatgagacagtgaggacaggcatcagccctcaatgttggagatgactgctccctgatatagtcaaccaccaaattcatgggcttgaggatgaggcagaacccagactgctcagcagaactcataagctcccctacaaagagtgtttttgtgatttcctgggacacacctggaaaagcagagtcatggcccacacaggtgggaggacctacagaggggggtcttctgtaaacataaacatacatagactatccctatggggcctggagctcctgatctaaagcctggaatagggaaaaggagagcaagagagacaggtaagtcagtaaatacaaggcaatgggatatttgcagtaacagaaaataatgtacaaaacactcagagagcacaagtggcagtttatcctgatcccaaaggggcctaaaattcctatttataggaatgtagcttggtgagacctagaaaataagtagacccctgatgctttaaaaaaaaaattgctgaattgcaaaaccctgcaagggcaatgattaagcctatttgacttgctttatatcataactatcatggagttgaaagcatgtgaatattgaatatggtggaactcctgcaatagtaaagaaagggacatttgcaggcagttttgggtgacgactgggacagggtatgaagtgtggactaattggttgagtgctgactaggataaagtcatctctccattctccagaataatcttcacccatcttgattaggtgatttggggtaaatcaattaaatgttgggcttcggcctgtccacaaagttggaatttggcagcctatcctcccttacagaagcatcaaggagctgatagtcttagaaaggtgctttgtgtttccagaaagaaagttgtttgaacatctgaggtcttatcatttgcatggtgtgactcaataaaggcatcattatacttggggaagaaaaccagagttgagacacgtgagatgggagaatgtgttcaagcatgtcagaaatagacgagagggtcattgtcagaaaataaacccctggagcaagcgtggcattggaacgcatacctagaatggaggaatactcaggtaatcttctctttagatccctctgggctaattccaggagctacaactgagaagggcagtcaaatttggacaggcttcagaggaaagttgttgagttgattgaagggctggaaaatcatacctatgagagaaggttaaaggagatgggtctagcaccaatgaacagtgtgactttagacaagtcacttaggctttgaggagctctgttcactcatctgtaaaatgaggacagtgacctggcaaagcactcaggtccttccaggtctcacaatatttttacagtccaggaggagaggaagccaggcagtaatttgtcattcatttcaattatatgcctgttacaaatctctgtcttccttacaggagatataataagagtaaaaaggctgggactgtaggtacagctactttgctgaagacaaaacaatgccatggaaggctttccccaattaaacagagcagaattcgaaaaataaatgtagctaaccttcaaagtttttgttaaaattatattttggttctcatgtcttcagaaattagaggccaaccctcccacctggagccccttccccttgtcctatccatgctggcataagaccttcttgtttcctcctcttgggttgggtgggatgggaataatttatctgctctcaaaagagatgccagtaatttgtatgtgcatgcatggattacaggtcatcccaggacgctaaatccatttaaaagcagaagagaaacacctacaaaaaagtcccaccctttcaatcctgttaggccattcagcagaggctgcctgccagctgcagtcggtttgtatccaagaagcccaataaggtgatctgcctctcatggtccttgacctaatccctccatgctccacttctatttggaagagccaaagattgggagcaagaatagacaaaaagcagaacaatctgaggcaatagttggaaaacagaaccctagggcctacggctcccattcctcactgccaggttcaaaggcacagggtcatgttgcatggagtatgaaagcctaggatcatggccgtgctgatttcacctgcagggctaacacccaacatccaaatgtccaccttctagtagtgctcttactctgaactgatgtattcaaccttggctgcacattgcaatcacctgaggagcatttttaaaatgccaatgccccagccccatctgtggggaattaaatctcttgagcaagtgggttccagaaggaattgccttacatattgactgtgccatgaaccactatattcttccagtggcaaattaacttaaaacacacaaaacatcaggagaatcacaaaggaagaaaaaaacctagcttataataccatgtccctaacatacaatacactcccgtaaggaaaatggatgtgctgcagtcaagaataggccaaggcagacatctggtccagcatgactcagaaagtttggagtgcaggtgcacaactccacacgttatgtaaccacgtcatgtgaggctcattatgtaaccactccacttgaggcacattaggtgatcacccacgtgagcttgagcttggctcagagccactattgacgtaaaaggtctaactaccctgctgacattgtacatacggcttgtgtccacagcttgtttgggcccacggctcgatcatgcccagagagagagtaaaaaccatgtcaaaactctatgattccttgactgtttttccagctacctgccactggtccacccactctcctcagacctcagcttgggctgaaagctgacacttgccatgacaatcagtgtcatgaacaggatcccagagtgagtgagctttttgtccccgcagcttccacgtcagccatgtggccacaacatgggttgtggtacactgtgacagctatgatgtgaggatgggctccagtggagacctgagcggtggtagatgggtaccccctgggcatggagaaggcactgaagcagctggaagcacagaacaccaagaagtagcgagcctttgctggcagagttggatgggtgtttttgactatgctacacaaccagtacctgagggatgcagcacaggtaagggccctccaggcacaggtggggtgcctggaggcccaactacacagctcagaaaaagaattagatgctgctgtgaatggggcaggcagggcgcctgaaggcctggctacagagcttggaaatggaattagaggctgctgtgaatgcaggacagggtccgttgtctcagccggagacccccacttggtctgagtctgcaccataaagaaggggacgctgcctcacccacaggggcccccccaacatgggagaaaaggaggccccagtgagtgacatgttcacagatgtggagagatatttgattttggcctgggttgactgagagaaaattgataagcagcccaatgaagtactcttaactttgtggagacagagcagcaattccagaaaatgcccaaggggaaggacattgctgtgtgaccctgtcccacccgggtgcttcagctcaaagactacttgctgcagccaggtagaaatgtagagcttttcctgtttgattagggaactggccgaggtgcctggcttggggggacactggaagaccagaggccacatgtggaattaccaatctactggtcccctaccagtgtacagcaagtgctgggctgttagacaccagtgcagatacattctggggggatattttacatggcttggcagctgtgccatctatcaccaacctgatggaccacttgacagaactgggacagtatcactatgtcgtggacttggctaatgcattcttttccagaaagccaggaagtttgccttcatgggaaggtgacaatggactttcacagtgttgctgcagggctatgtgcatagccctaccgtatgtcatggtcttgttgatgatattatgctaacctctgattctcttgcagatttagaagcagtaatgcttcccttgtctaaaattaagatgatgacactgagacagcctttctagcagctaggtgggctattcaacagtcacaagccctatgggtaattaaccaggggcgcccatttaaactcgatgtgcatgtgaccacagatagttttggctggggcctatagcagcacttggagcgcttgagaacaccagtaggcttttggtcccaaataaggaaaggaactgaactccagtattcattgatagaaaagcagttagtaattgcatatgttgcccttcaggctcacaagagcgtggcaggacagactacagtcatcaacttacctgatagtgggacggatgcattcatggataataactccctggacagggaaagcagttagcaactgtatatgctgcccttcagtctcatgagactgtggcaggacaagctatagtcatcatgcagatgacctacctgatagtggatgggtgcattcatggataacagttaatgaccccctggactgggatggcacagacatccactttagcaaagtggagtgcctacttggagcagcagagcacactgagtacaagtccccttgcagcagagttgcaagaggtcttgggacctgtggtcctaatgcaagataaggccacggggcctgaggcacccctagaccctgagccttcaccatctaaggaaaggtgtccccccattcccaatggtgcgtggtacacagatgggtctagccgaggtgctgctgctgcctggaccagaccactgttgcagtccaacctagtactgccaccctatgttttgaaactgggtgtgggcaaagtagccaatgggctgaacttagagcaatatgaatgaagatcaccaaggaagtgacacctatgacaatccacaccgatagctgggcagtttattgaggcttaaccttgtggttaaccttgagattaacatttgagttagtgggctggggaaggcagacccacccttaatctggcaggtaccatctaatcagctgccagcgaatgtaaagtaggcagaaaaatgtgaaaagtctacactggcctagccttccagcctacctctttctcccatgctggatgcttcttgctgttgaacactggactccaatttcttcagttttgagactcagtctggctctccttgatcctcaagcttacagacagcctattgtgggatcttgtgatcatgtaagttaatacttaataaactcccatatatatcctattaattctgtccctctagagaactctgactcatacagtagggaaataaaaacctggcttagtgtataaagcaacattggggtaacatcaccatggggtggttgcctgctataacctggagttgttgctccctgtattactgctgtggcctctggttacacaattccaccctgtgggtgtgtctccccactagaatactcccttagcctagggggtgggatgtaaggcctatgtgttgaacctgtgtgtctggggcctgtgtgcccagatcctatgtataaggcctatgtgtcagaccagtgtccaaggcctatgtctccttcggcctaggggatggagtgtaagaaaaatggatgtgctgcagtcaagaataggccaaggtagatatccagtacagcatgactcagcaagtttggagcacaggcgcacaactccacaagttatgtaactatgccatgtgagcacattaggtgatcacccacatgagctggtgcttggctcggagccactattgtctctaaaaggtataactaccctgatgacgttgtacatatggcttgcacccatggcttgtttgcacccacagctcgcttgcacccaaagagaggaaaagccatgttgaaactgtctacaattccttcagtgttcttccagctacctgccacttgtccactgactcccaatggacctcagttagaacctaagaactccttaagaaattctcttcttgtggagatgctgtttcttcactcctatgttaagcattcttttgtgcagtatccattgattacctgatccatatgaagaatacctaccctcaatgagttgtctgtaaaaaaaaaaatagtggcagattaatgttgatatccacctattgttgctgtttctcccaaccattgtgattctgtcatagtgcttggcacttagtagaagctcagtatgtttttgataactgacggacaatctttgaccttgcccctgaaaatttcagcccaccagaggcttagatggtattaaggaaatttattcagaatttagaatggtggtagcagtaaatcaatgtttcacattcataggggctactggcggtagaatgggtttacagaatttcatttccatctacagttttcctgccctatttcacctgtcagacaaagggctcacatttgtattctctctgcaggatgttttcaccttgtctgcatatgcatcattaaatagttcaagatcaattgcagagtagataaatagtgaaacagtgaaaatctctttcagagtttatggcaaatttcagagctgggttctttgattccagttatacctggattattgttgctgtttagcatacctttgcagttcccctgtaggtgctgggtgatggatggggcaggaacgcaatttatcaaagcattatgctggcaaacagatcgcaagacacataatgccactcatcagtacccacttacaaacctgtttctcactcctattcatcttgttcaagcttctgcctctacctgaaaggcttcactcacaaccaccctcttcattcacttctggcaattttaggttacctccttcagaaagtcttccttgggacctcggagtcctgatggtatccactgtttctccctgtgaccacacctaccattgaatttgaacttattgaagaagagagcctcactatagggaaacggaggagtgaaagaaagacccagggttctagcctggtgacttctgtagcaaggaagatagacttttctgttcactaggggagagagagaaaacattttttctcagaacatgtttggatggtggctagacaattatatattgagtttatatattgatcaaaaatgtattaagtgtctataaactgttaagtgctgtgaattcggaaatgagtaagcttacagtgactccctcttcctttggaatgccttgtggtcatcctcaactctccaggccttccctgacatcctagggcttcacctcctcacctcccccttgcaacacagtgctggcctctcacttccctcccctgtttttagtctcttttctccaaccaattttgcaatcagtgttcacactaatcttcataaagggaaaggcttgctctcgccttgcgcttgctcaagaatctataatggctccctgttagtttttttttttttttccttaaaggcctttttgttttgttttgtgttctgtgtttgtttttcttaaaatgcctttcctaaaatgcctcattggctgactgcatccaaactatttaacttatatctacctactactttccttctcgccccatctacccaacacagattgttcactccagtttagctggctatttcccttcctgtcccattagcctgcccacatccctcccactttcctcattgcgcatgccagcatgtggctttgtacagctcctcactcagcagacaatgccctcctctctatgctatgccagactttctgcctgtcctcaaggcatatcccaaccccacctcttccaggacctctaccccaccactgcaactcccacttgtctcttctttcctcggttttcttctgcactataagctggtaccatgactccttatggttccctaaaaattgcatactcctgagacaacatatactatttcttttgcattcttcactttgcctatcacattgtatccagcaaacgtgttgatgctcatcatctgttaagaaagaaaaccactttgggaggccgaggcaggtggatcacaaggtcaggagatcgagaccatcctggctaacatagcgaaaccccgtctctactaaaaaatacaaaaaattagccgggcatggtggcgggtgcctgtagtcccagctacttgggaggctgaggtgggagaatggcatgaacctgggaggtggagcttgcagtgagcagagatcgtgccattgcactccagcctgggtgacagagcaagactccgtcttgaaaaaaaaaaagaaagaaagaaagaaagaaaacataccttattcaccttaatagatagggttgttataaaaggccagtttgaaagggtataaaacactgagaaacaagctctgaattcatgtagggaaaataaaattaggccatgtaaaggaagaatcatgtatatgataactttgatatacttaagatcttaagatacttgttagagcaattattttgataatgctataaataataagaacagtaaactatagccattatttcaatatgattcaacacacttaagagcatttaatgagaatgtaccatgtggcagccttgggacttggtagaggacctcaaaagggaataaactataagcagaaaataactgtatcaggtagttatattcaggtagttatatatgggtaatattataatagtgatagcatttttaaaaatttactttggcttatagtatatggaatgactcatgaaatccggaccttgatagaggatgcaggatttttgaaagggagaggtaggaccttgtagggtactggggggtgagaggaaggatagaatagagtgatagtgctcagtggaacaaattgcatagaatttgaaagtatggattatttcagacaatagtcagttatatgatatttagttggaacatgaggtattgggaaaagggaaagagtatcagaaaatatggagggttagaaaggttcattggtgccagattgtataggcctgaaggtttgaacattttacataagaaaaaaagaaactattgaaagttcttgagaaagtcttgattgcaaattcttcaaaattttgcaggataattctctttaggaagtcagtgaagtaaaaacttggcctaaggcaatgaatttcctttttgtttgaaatgctagacttgaaagaaatatgtcaaataaaactgaatagtgttgaacatctcagatatccaggagtttgttctctaatgtgtggaactttgttgaaatgtataatatttgtatgttctcaccattgtcatacaagcaaatggcatgcttttgagaatgtagatctcctcagatgtttcctggctagtacaggatgtactttcatttggaaggttggctgtctggagccctaacttgggttcacttgcaccttgcagggttgaaatgattttaggtgaaaggtggccaccgtctctaacaggaacagttctttccacttttagcaagagtgcccactaatgtaaaagtaaatcagggagactaaaatcaaaaggaattaattgtcaccaacaattccatttgcatttatttattcataattagtatttactggaagtggcagcttatgctcattttctctggatcattaaaatgtactcatctgagccataaacaaagccagcaatgcccaggaatcaactggaacaattcagttagtgataattgcatcacagctcccctgtagcatctcgcaaaggttcatttgattacagttactaatggcaatcctggcacatggagggtatttattagactagtggttcttgggtttctagccttagatttgagggggaaaggacactgctctgcaactgctctccctcaaaagcatttcaacaccttgcctaaactggtgagaatacagtaatataatagtggtaaaatgattagaaattgattttgccttacggttcacggaattgactcatggcatcagggccttgatagaagatgccggattttgacaaggagagagaagacattgcagggtattgaggaatgagggaaaaggtagagtaataatggtaagagaagcaaattgcctgggatttgaaagcatgggatgaaataagcagttatttatatgtctagaaaatatattattactgtccaattttaagcacgaatgctttaaactttaaggaactggtcttacctgagtcccataaattatattttgagagccatttatcagataatcgataaatgaaaacaaaatcaaacaactcaaatgaggcaagaaagagagctgaaggaatgggtaagacacagtcaagagcatgttttggagagtgccagcccccaaaggctgggcttgtggttcttcttagagatgaacaatcttgaatcttctatttcagattcttggctggaaacaccttatcttagagtccctcaggttcagacctgacctaagacacatgttatttctttacaaccactgagtctgttagtgttgtacacatattaaatgcttaatggtttgctgaacaaatcttcatagatacttcaactcacctatttaaataaagctgaacctgaatgaagagatctccatgtctggataaggtccatggtttgtttccaaaaggggcaaaagttggatgcagccagagattctttgttgatttgttcatagttatctattttttgaaggttggtttgtttgttgtactatgttttttatacagctgaattgattgcaaaggtaaaataagaatttcctttcccagggctatattcattcttcccaactgaggtggaaaattccagtattagttttagcagtacttgaaccatcttctccctaatatagtgcttctagggaacatggggaaattcttaagcctgggtagccaatatgaaagatccagaaagaatcaaatataatgagaatgtctgaaagaatttgttctctcaagcaaactggtctatcagaaggactaatagcttgggcctattttgctcaccattttagaggggctacttaatctcctagtgcctgagtttccttgtctgtaagataggaataataggccaggcatggtggctcacgcctgtaatcccagcactttgagaggccgagggggtggatcacttgaggccaggaattccagactagcctggccaacatggtgaaaccctgtctctactaaaaatacaataattaggcaggcagggtggcacatgcctgtaatcccagctactcaggagggagactgaggcagaatagcttgaacctgggaggcggaggttgcagtgagctgagatcacaccactgcactccagcctgggtgacacagcgagacaaaaaaaataaaaaattaataataataataataataaagagtgttgtgaggattcaatgagttacacatgtaaatacttggaagcgtgcctggaacatagtaaatttttgattaatgctagttttcattatttttcttaatctaattttttctgaacttgtaaaatacatttacacaatagcagtcacctctcctgggggatttagaaatagtacccactatttattgagcatttattatgttccagtcctctggcacatgtctactttgatcctcacactaatcctatgagaaagttattatcatcagtttcggtaaagaaactgaggatcagagaaataacttggccatacctaataagcaatggagcggggatttgaactcccaccctactgggctagttctctaagatcctaaagaaactgctttgtatcccaacatgaaactgaactcagttaaaaataagcacacgggctaaagacctcttttccctgacttatctctcatagcatagattgcttggtgcctctcagagaatttccgtttaacaccctgagattagttggccttgtggctctgatcagtggaggtctgtttaactcaagtcacatgtgggtattttcactccaatcataacgtcagttctaaatctgttggtatgtcacaaaggcacaagttaaaacccaggaaaaaacttgagctgttactgttcccaagtagaaacatccttagcagcttatctgaacagaaggccaatctaaaaccttggaggtttgcccagccccggtttcctgtctaactgaaagcagagagcccagacacagagccaagaagttcacgcttgtgggatcagcaacctaaatttgagaattcggatcagtaagaccaactgcagcctgcagctagagcggtgctggagtcatgggcccgatggtcccaagggtgcaaggaaaaacttatgagatgactaaggtaattgttaggaatgaaatcaaaatacaactaggcaaaccaacttcccaactggcagaggagagagaaatctccctgggattatttttatagattagtctgctatctttagcttccagaaatgattttttgctgtgtgtgataatgctggtactgacgtgtaccgagcacttaccacatttgtgatactgcgctaaacactttacacactttacttcaatcatgagtgattacaactcaggtatatggacatgattgaaaagactggtacacagcttcagagtttccatagagggtgtcgttttagcagaatctttactaaaatgagccacccctgtccttaagagctgtatcacctcacctggctaccctgttttctagcacaaggtcaccttgagtcaagatgttcagttttgttgtcactgtgccatggccatgactgtgggaataaccccatctgcttaccttgggagatggaaactttgacgaactcaaggtccttccccagatacttccagctacttcccagtgatgcctcctgctctggctaccctaaacctacagtcaaactatgtctctctgcagctgaaaaccccccttaattgcagtaaacaggataacatctgtgggaagaaaggcaactatctcttcacatgttgttttcttagaggggaagctttcctggataaccaagagacttcatgtctcattggccagcatttgatcatgtacccatttctaaatccatcaatcacaggaatgtgactgccgtgtttatcttggactaattgggatctgcccctcagccggggatagggtcaacttcccctgaatcaagtgaatagaggtagatccccgaataaatcagagttaagaaggaagggctggtgagactagacacagtagagcagccatcagtgtcctacgcaggcctccgtatttcacggaggtagtttccctccctcccacctcatgccccagatgaagtcttattttcccttaagtattgctactctaggtctgggtcttgctgttcccccaaaagaaatatccctcttcatattcccaaccactcttatatctacctttattacaacatttacatattttttcacgcctatcttcttttacacatatctctcctagttagactatgagatcatagagaccatgtgttactcatttttaaaatttccagtacctagcataattcctgggataaagtaggtgcccaataaatgttggattgatatgatttgtgaatttagtttatgaaagtctatttcagcattacttagaattggatagaacaagtttggttttaaaagtgggagaaaaaggaagatgataatattgtttcataatcaatttttaacctgcctaattcaaaaaaaaaaaaaaggatgtaagggagcaggggtgctgtgtgtaatgtgctgtgcttaatgttgcttttcttttatttcccacagcacacaggacacggtggggatgcagcatcttggacctcatccgcctgtgctctaattcaaagacaaatatgtttcccaacttgcccaaggctctggcagggaaaactcagatccccaaactcaggtcgttctagtgcagcaataaccagctgggttttcagcaacttggatggagccatctgtgttcccagcccacataaaaatatgcacaagaagggtgcaaatcagcaagtccacagcttccagaggccccagctgggatgtgccctccctttggggactaatgaaaggtaaatccagtgtcaaaagacagagggccagcagcaagactatggagctaagtgagtccagactctggtcccttttctgactttgcctgaaatagagcccatctggctccctggccactgtgcttgtgtgaagggcactgcagtgcatgctgaatgcctggaaaattaccagaggtctcctgcctctctctctgggggcaccaggaactggccacataggaactctcttctctgatgctctgcattcctctgactgcctggtcaacccttaagctttcacataatgagcctggtgagcccaggtggtcaggaatagaggggctttttgtgtcttggtcttaaagaagggagcccctcagattttcccacatactcccccttcctttcctaccactccacatcacagaagggaatttagagtcgtcttggctctccggctaagacagaggacagtagattccacatgaaaagccaaattaaatgggggtgctgttactcagccacccaggtgcagatggcttttggcagcccagtactgggcggtgattgagaagagtctgtctcgaagtcattacagttaattgtcacagagttacagactcatctgcaggcaaagagccagctcaaaatccccagggaattttcagatggattaataaacaaaatggcatatgtgtaaagcagctgattctctacaaagaaatgatagtattatttctttactcttcattcctggacccaggactattttacagtctctttcacatcttggaaggcatttgtccaacagggctctgagtcaggggaaagtattttcttccttgtttttatctagtagcacagacactttcactatggggttagtgcatttttcatggctcctggttcatctcagaaaaatgcacatcaacccagccatcctgttgactaagtggcattcactaagccaatattccacatagaaacactgatgcggtcttaacaatggtagagtaaatggcatcaccacctgtctacatacgtaaaacaggtgcacagttgggagctggagccatagcctcattgatatcatagacagaaacaggatctgttcaatagcactggtactgaggagaaaagcagcacagtactggatcctgcacatcacttccttttccagtttctttgatttttctgctaaagtttatatgattactcctgagaagcaggaattgcctcagaaagttatcctgctctttggcataaccgccctgctggctcaccctgccccacaaactctgccagcccagtgtagaggaagagagctgagcatctgctaaagtccctccatcaccagtgatctgtgcctgaatttgtcgttccttgctgcttgtaaatttcatttcctctaagccttctctatattacatagcccagagaagtactggttaatgaaaaaatgaaaagcttgactttacaaatgaagaggaaaatgcactctttaaaaaaaaagttgcagctaagtgaacttatatgtgtgcaagaaaagaaaattgtttcgagctgtttaagagtaataattacattacattaccgtgttactgtctgaagatattcatattttgcttttttatttttttggtggagtgttgttcagttgcccaggctggagtgcagtggcatgatcttggcctcccgggttcaagcaattctcctgcctcagcctcccaagtagctgggtttacaggcatgcaccaccatgcccagctgatttttgtatttttagtagaggggtttcaccttgttggcccagctggtcttgaactcctgacctcaggtgatccacctgcctcggcctcccagagttctgggattacagatgtgagccgctgcacccggccttattttgctctttagtgctatttcctgtttaaatttctcagtgtgactcaagagtctatcatactgagttcatgctcccagtatttaaaactgcatgaaaataatgcagaaaataatttgctagcgttgacttgctcccagaacttaaactgatcaagcaggacatctgaggaataatactttttagcagggattggcaaactttttctgtaaaaggccagagtgtaaatattgtaggttttgtgagccatacagcctctgttgctgatattcaattcagtccttgtaacacaaaagcagtcatagacaacgcatgaagaaatggtgtgtctgtgttccagcaaaactgtatttataaaaacaagttgcagattagatttgactcacaatttgttgatctctgctttgtagtaaagccctgataaattttcttcttgggttaagtagtgagtgggaacttgccacatcagagtcattttggggagatggcacatccccacatgagagccagcatggaaaaatttggtttatttctcctactttttaacagtaagtgacaattttgcagctattttcagcttacaaggaacatattaaccacttgaacttccaattccatgagataatgtcagcataatgcagattattccttatactagacttccagtttctgggaatagcaggtacattatcctactgaaatgctgaatataatacaaaaagcatctaccttaaagcatccaggagctaacaagatagaaaggaattacctgacctaaatgggaggaaaatattaaggaatcacataaacaacttttgccctgatatatttgctgatcctgcaaaactgaacttccttttgatgttttcatgggatgctcagtatttaaagccaaaggctacataagtctgaaagtctactaagaaattgtcgatacaataaacttgaacctcaaaggaccaatcccaggagtgaaaaagaatcagaagtgacacagccttcctgcatataagcaggtggctttcacattctctggtgggtcaaggactctcaagccttgaatttggcttaagtggtagttcctccagatatctttcagaagcaaatataaattctttctgaaggaaggcaacttcagttcatcctgggccttaagtacccctataaatgattttgtaaacacaaggaacaataatatattaatagatttttttaataaaagaggtacataagtaaacaaaacaccatgatgtcacctaaatttgaagatataatggctgccattttttcaaaactgatgaaagatatcagagaagtactacaaaccccaaatgggataaatacaaaggaaatcacaattagactcaaacaaatttccaaatacttcagctactacaattatcatatacaagttatagagcaagaatgtttatgattcttaaggaaaaaaataaagatcagcttagtagcagaaaaccataacataatcacaggtagatttttctttgaagaactaatagaacatctacaaagggaaaatagaaaaatcaaaaaattttaaatttaataaatatttttagtagcagattagacataccaaaagagagaattagatatcagtagcccaatttttggagaagaggtgttcaatatttcacaattagcaagtacctaataaatgataagttaacttccttggacctaaaattccacagacttctcaattcatggccaactttgtggttaatatgtgtttatattgctaaggataagaggaaaatatatcttgttttttctattttcaatccagttttggtgctacattctgcctcttaactaaaagctcttcaagtaaccaggacattgatacctttgtcctgtttaggattttggtcttatggtcaaattcacttgatctgccgtggctgaattcaagtttttaccttcagtttcagtttgttctaacctctttttaactaatttcactttggctgagttctgcccagatgccttcacaagaaccccgagggttggcttgacaaattcaataggattttcgttgtttcctataatagacaatatgacactaattccaattacacttcccctcttaatttggtgttatgattttcatgaatctaaattatctctatattttaagccccataaggcagtaactatgcattagatttaccatttgctttctctattgctcttcattccctcttggattgctaggataactttccttctgtccaaagaattcctttaagcatttactttattgtgggtcccctggtgatgaattctgttttggcttatcgctaaagatacatatttcattttcacatcagtgatgttttccctgaataaacaactctaggttggaatttttgtttttcatgttttcttttgccactttaaagatgtcattgcattgccttctggcttctatttctctttggaaaaagtagctgtcagtcttattgatgttcctttaaggataatgtgtctttttccttagatgcttttaagattatagtttgcagaaattttataatcatgaacctaattgtgatttcccttgtatttgtcgcacttggggtttgtggtacttctctgatatcttccatcagttttgaaaaaatcgcagccattgtatcttcaaatattgcttctgcattattatctctctccttatctctgtacctccaattatatgtatgttagactttttctctgtgttctgtatagccctcatgatgctatttttgcattttttggtctttttgctcaatgaagttcaattttaatattttaactgaagtattttctagttcacaaatccccttttttgttatgtctaataagcggtttggtcctaatttcagttgtctcattctttggttctagaagtttcatttgatacttttattttattattattatttattatttttgtacctacatagtaggtgtatatatttacagggtacatgagatgttttgaaacaggcatgcaatgtgaaataagcacaccaaagagaatggggtagccatccccttaagcatttatcctttgatttacaaagaatccaattacactctttaagttattttaaattatacagttaggttattattgactataggcaccctatcatgctatcaaatagtaggtcttattcattctttctaactatattttttgtacccattaaccatccacatctcttccctcccctcccaccatccttcccagcttctagtaaccattcttctgctttctatgtccataacttcaattgttttcatttttagatcccacaaattagtgagaacatgtgatgtctctctttctgtacctggcttatttcacttaacataatgatcttaatgatctttagttccatccatgttgttgcaaatgacaggatctcattctttttatggctgaatggtactccattgtgtatatgtaccacattttctttatccattgatctgttgatggacacttaggttgctcccaaatcttagctattgtatatagtgctgcaacaaacataggagtgtagacatcttttcaatatactgatttcctttcttttgagtatatacccagcagtgggattgctggattccactggtagctcaattttcagttttttaaggaaactctaaactgttctccatggttgttgtactaatttacatttccactaacgtgtttgggggttctcttttctccacatcctcgccagcctttgttattgcctgtcttttgaaatataagccattttaactggggtgagataaatcttattgtagtttttcatttgcatttctctgataatcagtgatgttgagcacgttttgatatgcctgttgtcatttgtgtgtcttcttttgagaaatgtcttttcaaatcttttgcccatttttgattggattattagatttttttatagagttgcttgagctctttttatattctggttattaatcccttgtcagagagtttgcaaatattttctcccattctgtgcattgtctcttcactttgttgattacttgctttgctgtgcagaaggtttttaacttgatgtgatcctattcatccatgtttgctttggtcacctgtgcctgtgggtattatttaagaaaactttgcccagtccaacatcctagagagtttccctcgtgttttcttttagttgtcgcatcattttaggtcttagatttaggtctttaatccattttggttttatttttgtgtatggttagagataggggtctagtttcattcatttgtatatggagatccagttttcccaacaccatttattgaagagactgtctttttcccagtgtatgttcttgacacctatgtcaaaaatgagtttactgtaggtatgtgaatttatttctgggtattctattgtgttccattggtctttgtgactgttcttatgccagtaccatgctgttgtggttactaaggctctgtgatatgattcgaagttatgtgattcctccagatttgttctttttacttagaatagctttggctattctgggtcttttgtggtttcatataaatattaggatatttttttctatttttgtgaagaatgtcattggtattttgataggaatttcattgaatctgtgggattgctttggatggtatggacattttaacagtattgattcttccagtacatgaacatgggatctctctcctttttgtgtgtgtcatcttcaatttctttcatcaatgttttagtttttgttatagaaatctttcacttttttggtgaatttaatttctaggatttaattttattagcatctgttataagtgggattactttcttgatttcttttcagaatatgtgctatattttcagaatatatgcatattttctatatgctatatcagtagcatatagaaatgctactgatctttgcgtattgattttgtgccctgcaacattactgaatttgtttattggttctaataggttttttttttttttttggtggagtctttggatttttccagatataagatcatattatttgcagacaaggataatttgacttcttcctttccaattcagatgcctttcatttttttctcttgtctgattgctttaaataggacttccagtactatggtgaataacagtggtgaaagtgggcatccttgttgtgtttcagatcttagaggaaagaatttcggttttctccattcagtatgatactagctgtgggtctgttttatattgcttttattatgttgaggtattttacctcaatacccagtttgtttagtgtttttatcatgaagggatgttgaattttatcaaatgttttttcagcatcaattgaaatgaccatatggtttttgtcctttattctgttgatatgatgtatcacattgattgatttgcatatgttgaatcatccttgcatcccaagaataaatcccactcagtcgtgatgaatgatctttttaatatattactgcatttgatttgctagtattttgctgaggatttttgcatcaatgttcaccggggatattagcgtttagttttcttctttgatgtgtctttatctgcttttggtatcaggataatactggcatcatagaatggtttggaagtattccttcttcctttattttttgaaatagtttgagtaggattggtattagttcttctttaaatgtgtggtagaattcagcagtgaagccatcagatcccatgtttttatttactggtaggctttatattagagcttctatcttgttacttttattggcctatttaggttttgaatttcttcctggttcaatcttggtaggttgcatgtatctaagaatttgttcatttcttttcaattttccaatttattgacatatagttgctcatagtagccactaatgatcctttgaatttctgcagtatcagttgtagtgtctctgttttcatttctggttttatttatttgaattttctctctttttttcttagttagtctggctaaaggtttgtcaatcttgtttaacttttcaaaaaaacaactttttgtttcattgatcttttgtattttttaatttcaatttcatttatttttgctctgattttattatttattttcttctactagttttcggtttggttttctcttgcttttctagtttttaaagatgcatcattagattattcatttgaagtttttcctcttttttgatgtaggaatttatagctataaacttccatcttagtactgcttttgctgtatcccataggttttggtatattatgtttccatgattatttgtttcaagaaatttttcaatttccttcttaatttctttattgacctactggtcattcaggagaatattttttaatttttatgtatttgtgcagtttccaaaattcctcttgttattaatttctagtttcattccattgtggtcagagaagatgcttgatattattttgatttgttttaatgttttaagacttgttttgtatttaatatatggtctatccttgagaatgatccatatgctgtggaaacaaatgtgtattctgcagctcttagctgaaatgttgtgtaaatatctattagatccatttggtctatagtacagattaagcatgatgtttctttgttaattttctgtctggaagatctatccaatgctgaaagtgtggtgctgacatctccagctattattgtattggtgcctatctttctcattagcactaataacattttctttatatatttgagtgctccaatgctgggtgcatatatatttataattgttatatcatcttgctgaagtgacccctttatcattatacagtgaccttctttgtctcttcttacagggattttgtcttaaaatctattttatctgatgtaagtatagcaactcttgctctttttttgtttttatttgcatggaatgtcttttttcatccttttattttcagtctatgtgtgtatttataggtgaagtgtgtttcttgtaggcaacagctcaatggatattgtttttccatccattcagccagtctctgtctttcgattggagagtttagtccatttacattcaatgttattattgataattaaggatttactcctactattttagtatttgttttctggtggttttatggtcttctctttcatctttccttcctgtcttcctctagtgaaggtaattttctctggggatatgatttaattgcttactttttattttttgtgtatccattgtatgttttttggtttgagataatcatgagatttgcaaatactatcttataagccattattttaacctgataacaactggacactatttgcataaacaaacaaacaagcaaaaagaaaactaataaaaactgtatgccttaatttcatccaactgcttttaactttttgttgtttctatttatatctttttgtacggagtatgtcttgaaaagttgttgtagttatcatatttgattagttcattgtttagtctttctacttaggataagagtagtttacacaccacagttaaagtgttacaatattctgtgtttttctgtgtacttactattaccagtgagttttgtttcttctggtgattattgcttcttaatgtcctttcttttctgattgaagtactctcattaatatttcttgtagaacaggtctagtattgataaaatcatctctcaactttttttgtccaagaaagcctttatttctccttcacattggaaggatattttcatcagatatactattctagggtagaagtttttttttcttcagcactttaaaaatgtcatgccactcgttcatggactgtaaggtttccactgaaaagtctgctgccagacatattggagctccattgtatgttgtttgttttttcttgctgattttaggatccttttttatctttgacttttgggagtttgaatattaaatgccttcaggaagtcttctttgggttaattctgcttggtgttctataaccttcttgtacttggatattgatatcttactctaggtctgggacattctctgttatcatctccttgaataaaccttttacccttatctctttctctgcctcctctttaaggccaataattcttaggtttgcccttttgaggctattttctagatcctataggcatgttttcattgttttttattcttttttcttttcttttttttctttttttttttattgagacagagtcttgctctgttgcccaggctggagtgcggtgacatgttctcagttcactgcaacctgcgcctcccgggttcaagtgattctcctgccttagcctccctcctgagtagctgggattacagacacttgccaccatgtccagataacttttttttatttttagtagagatggggtttcatcatgttggtcaggctggtctcaaactcttgagctcaggtgatccacctgcctccgcctcccaaagtgctgggattataggcatgagccaacacacccagcattttattattttttcttttgtctcctctgactgtgtattttccaatagcttgtctccaagctcactaaatctttttctttttttctttcctttttgttttttgagatggaacttcaccctctttgcccaggctggagtgcaatggtgcgatctcagctaactgcaatctctgcctcctgggttcaagtgatactcctgtctcagcctcttgagtagctgggattacaggcacccaccaccatgcccggctaacttttgtatttttagtagagacagggtttcaccatgttggtcaggctggtctcaaactcctgacctcgggtgatccacccgcctcagcctcccaaagtgctgagattacaggtgtgagccaccacacctggcccaagctcactaaatctttcttcggcttgatcaattctgctattaagaaactctgatggccgggcgcggtggctcacgcctgtaatcccagcactttgggaggccgaggcgggcggatcacgaggtcaggagatcgagaccatcccagctaaaacggtgaaaccccgtctctactaaaaatacaaaaaattagccgggcgtagtggcgggcacctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaagaaactctgatgcattcttcagtatgctaattacattttttagctccaattatatttttctgcttggttctttttatatcaatctctttgttaaatttatctgatagaattctaaattccttctctgtgttatcttgaatttctttgagtttcctcaacacagctatttcgaattctgtgtctgaaaggtcacatatctctgtttctccaggattggtccttggtgctttatttacttcatttggtggggtcatgttttcctggatggtgttgatgctaatagatgttcttcagtgtctgggtattgaagagttaattatttattgtagtctccactgtctgggcttatttgtggctatccttcttgggaaggctttctagatatttgaaagaacttgcatgttgttaactaagctgtatctactttagggggcaccccaagcccagtaacgctatggttcttgcagactcacagaggtacaccttgatggccttggacaagatctgggagaattctctggattcccaggcagagactcttgttctcttcccttactttctccaaaacaaacagagtctctgtctctctgctctgagccacctaaagctgggagtggagtgacacaagcacccctgtggccaccaccactatgactgcactaggtctgacctgaagacagtacagcactaagttttgcccaaacactgttgtaatcactccctggttactgctaatgtttgcttaaggctctgggactctaatcagcagatggcaaagccagctaggcctgtgtttttcctttcaggatggtgaggtcccccaggccctggatgggttcagaagtactgtctaggaatcagggataagagtcaaaagccttagaagtcttcctttgtgttctattgcattgtggctgagctggcattcaaaccaccagatgcagtcctttccactcttccctccccttaccaaaagcagaggagcctcaccccatatctacccaccctagaccaccaggagtgttgccagactaccagatagtgttcctttaaggcccaagggctcttaagtcagcttgtggtgaatgctgcctggcctgggactcaccaatcagggcagaggcctaccctctggcccatggcaggtccagaaatcctatctgagagttaagtcctagaattggggaccccaagagcacgcctgatgctctgctttgctgtggccatgctggtagatgaagccagaaagtctcagaggctcaccaagtccctcagtgtagtacctgggtatcgctgctggtttttcagggcccaagggctcttcagttagcaggtgatgaatgcttctaggactggatccttctcttcaaggcagcaggttcccttctgacccagggtgtgtctagaaatgtcatctgggatctggggcctggaacgaggaggagagtcatgactctgtccaatgccctatttggccagctatggctgagcgagtatccaagatggaagacaaaatcctccccactctttcctctcctctcctctcctcaagtggaaggaaggggtctcttttggagccacgagttgtgcagcctggggttaggggagggatgatgccagcactcccttggctgtcccagcttttgtctcagtatgttgcatgcccccacagtccactgtctctgggcctagttcagcactaggactcacctaagagttgcagtccttattgcctagactgcctttcaagtttactgaagacacagagcactgtagccctccatggtgaggtttgcaggcactcaagttctgacagctgggactgattcccctctgcctagggctggtttaaatgtgccctctgtggatgggtgtcagctgagtttggtctggttttcctttctgctgtaacaagacagcactgagttcaatgtctcacagctgctgtgttctctctcccccagtgctctctgcaccactctgttgctgctgcgggttggggaggactggtgtaagcgattcaggactgtttttctctgtctcttcagtgcctctttcagcaatatgaagttaaaaccaggtactttgagtgctcacctgattttttggttcttatgaaggtgttttttctgtgtacatagtttttaacttggcatccttgtaggggtgggaagaagatctgtggagccttccattccaccctcttgctccatctctcatttgatgctgttatagactttagttctctggtgaaattttccctcttgatgtctgtttttctttcttaaaaaaaatttgacacgtgattgtacgtatttatgaggtacagtttgatggtttgagacatgtatgttgtataatgatcaaatcagggtatttagtgtatccttcacctcatgcatttatcatttctttgtgataagaacatgcaaaaggctctcttctagctattttgtaatatacaatgccttgctgttaaccattgtcatcctgctatgcaatagaacaccagaacttatttcttctatctaattgtaactttgtaccccttgaccaacctctccccattgtctgctcccctgtttcctccctagtctttggtaactactgttctactctctgcaactatgaaatcaattcttttcttttctttaagattctacacatgagtgaaatcatacagtatttgtctttctgtacctggcttatttcacttaacatgaggtccttcactaccatcaatatagtcacaagtgacaaaattttattttatttttttatagctgaacagtgtcccattgtgtatgtatactacatttactacattttctttatccatttatcggttattgaacacttgggttgattccgtgtcttagtgattgtaaaatgtgctgcaataaacaggtaacacagatatctctttgtcatacaaatttgattcccttcgaatatacactcagtaatgggattgctagattacgtggaagttctatttttaacttttaaaggaatcttgataccatgtccctagtggctgtactaatttacaatcccactaatagtgtgtaagtgtccccttttcttcacacccttgccgacacttgttttcttatgtctttttaataaaatccgttctaactggagtgaaatggtatctcactgtggttttgatttgtgttttcctgatgattagtgttgttgagcattttttcatgtacatgttggccaactgtctgtcttcttttgagaaatgtccattgaggtcttttgttcatttttaagttgggtttttttgttttgttgttgttgttgttgccgttcttcatatattctggatataaccccctgtcaaatgtgtggtttgcaagtattttcttctattctgtaggttctctcttcactctgtttcctctgctgtgcaaaagcttttcagtttgatatagttctatttgcctatttttatttttgttgtgacatctatctttcttgagcatattaatcggttttctaaaagtccatatctcataattctaatatctgagttaactatgaatatgtttctcttgtcttgtttttaaattctgtttcttgatatgtatagtaatagtttattgaatgtacagaatttttaatgagaaactgtagacaattagaattatgttgtctttacccagagaaatttatcctatcctttacagacagctataggaaaggagatcacattgataaaagcaaggagtgagctgacacaagtctgttgtaacctttgtaaggctttgtatatctctggcacaccaactgagagcctagggctctgactaaagctcttcctccttggcagatcctgcagagctccatgttctatctcctaaggagatatccccatgagactgccccaaattcttttttgtttttcacctgctttctgctttaccttttaaccgcttatctatgcatcttacaaatttaacaacctaggtgaaagcgaatttaacacttctaggtgaaacaacagatttagcacctctaggtgagagccagagtatcctcatgctctcttctctcagagatcttgggtcctcaggtcctgtctcccttggcagtcctaaactctaattttttttctctctatgagactgctgaaagcttcactggctctgcctcttaacatccaccttctgctcaattctcaaccttttttcttgcccaaaattagtaaaatccctgaatgtgacacagaggatatcagggtcctctcaattagtttctctcttctctgggatattggctactcacatcctggatgtcctggctgctctttgatgccatgtaagacatatgtattttgtattttatatggattttccaggtgttttcagtaacagacttgttctgctacaagatactctatcatgaccaaattagaatgtttcctataatagaaatatataatttatctctttctgcttccatctttccaaaattggcttttggttctttctcagatacatgagaattatcttccaatactacttaaatgtttaatgactttgacacgttaaggctgagcctccctagttcatacttctgattatatccagagtttcaaataagagaatgtggctgtcacatatttcctgagttatgaacttctgatctaatgtctgggaagacatatttccttaatctgagttttcaagcttcaggttaacctctgctaacttccaagttttgcagatgtagtgaagttcttcctgttgctcagaagtagagtttccttatttattctgcaaacatttatttgaccccaacaatttcttggttatttcctttttgagcctacatgtttgctataaaattcctcaaaatgaggaaaatatgagacaattctatataaatctgttcatataccattactattttccctgtcttttgtgattcctttaaaaagtatcttttaactatatttggaattcatccaatgatgcccatttattacaactgcattaggcattattaagtcaattaaaatatataattcagtaggcagtgcattgagcctaatttaaaaggcatatattggagccataatggattgctgtgttgtcagatatggcagttcttcaactgttgctgataaagatgaaactcttttttgaaaagtaaaagacatctgcagctgctttgaaagtcaactgacattttgttaattagcatttatttacaatagttgaataacaatatcaaactacagtaaggaatgagcagttaacatttaaaaaaatgctggtgacattaagtttcatcatttggcatctagttaaaaacacagattctttcaggggtatagaagagaaatcactgatgtctgtttaaatgtaaaataaactggcaaaggaagctagagctgccagagagggcttaagatgtggccctgggtcttagaatggaatagacgtgcaaaccattagttgagtgtccagttaggcaagaggggaggataagaagaaatagaagaaattttttccttattattggctttttaaacacataccaaattatcactggaattttgtcagtcagcagattccagatgactaagatgatcaaattaagatgtcacgttcaactcatgtcctgcagtgtttcaccatcaacctctgggtttgaaacaagcagggagtaagaggaaagagaagagcctaattttatcaggaacatgttggtctataaaaattaatatcaggctgatccaagggtagtgagttatctcagttgattgttcacggtcacagatcgaagtccttgttctacgctttctcccttcccactactgtacttgactagtctttaagagaaagaaagagagagagagagagagagagagagaggaaaatgcccacagtattaattttttgtttttttcccctccctaagactcctagaaaatttaaatgtcaaaactaaaagtaagatactgttattaaaaataaccagtggtatgttaccaaatttccagttgatcttaaatgctgttattaataagtaagtacataattttaccataattcatagagaacttcatttgccacatcagtcttcatcccctgtaattggtactaatgctaaacatttgttaacgaaagagaaaaaataaattcttccactagtttgcctttttcctttccaagactgaaaaatattccattacatgtataaagcccgttttgtttatccatttatctggacagaccattttgattttatgagtgtttgggcaaaaatgtgaccaggatcatcttccttcagaaaggactttggtagctcatgttaggagctagggaggtgggggagcagaagagcaccccaggaaaacttagcactgggtggacaaagccttctcagccatttcgcctccttgtacctcttggtgatccagcactttttgcgtattgctctttcttcttctgtatcaagcatatcattttgatagcaatgccctaacccccaccccaaccctaagctctcattctgacatctcagtgtgatgggaaggtaaataatatctactgtaccctaagcaaagcttagattttgatggttcaggatttttgcacccttgagatcagaaaataatccatttttattcatctatttcctctttctctcttttctgctccttctctccctctttcttcccctcttttatttcccatactcatgatacttattttgctgtgatatatgtgagtctatattctttccatgaaatcagtggctaatgcaaagaaacataccatttacctaaataatttttctactgtaaaaatgtttctgagaaattctgctttttttttttcttcatttggctttgtatcttcagggctccaaatcctaggggaaaaaataatagtgagacaccaaataccacagcacaatattgtatagttcaataggaatttgaaataataaaaaatctggagacagatacaaccacttacatcaaacttctcggtaggttctcaagacatgtatctttctgaagaatcatttcaactcaaaatttgctgtaggtaaaaagagcacatgacatgtccatccttctctttagaaaatgaagaaacataaatcaacttgagtttcttgcctccagaacagtgtgaaagattacattggaaatgtatgttctccccaacctaggcagctttctaattctctcttaagaaaaggaaattagtgattttgatcagaaacagtctcaagcccacatcccaaagcaaaattttttataaccaaactgtccctagaaatacatctaccatgaactagatagtctggttccataacaaagaattgtaaaattttagagatggaagtatcttggtccaaacctctaactggatgtttctcctctagttaacaaaacagaagttatatcacaaaaagagtagggactgtgtcttacgtgacacatgatcattgtagaatactggtagtagtatcgccgtgtttcagtggtttggaagtgagaggaaagacagagagaaagggagaaaggagaggggagggaagtagggaagaaaaaacaagaaggtgagtattggtattgtttaatatatatatttttgccaatagccttcactatttagagtagctaattaagttatctcagccaaccacttataaagatactaatattccatacttagggttgaggaaattgaagttcaaagaatataagctcatatatttttagcacactggaggaaagaggcattgataggagagatagaatttgtttttaacaggacatgggacaagagaaagcctgtgagtgacagatgcacacttagtaaatgcttcctacctttgactacaggactgtaatgaagagatcatagttaggccagtgagttacatagaccctgttcatggctctggattagtgttgactgaagttaatttctttcctatctgtcagaagtggcaaaggaaaaagtgatagcaggaaatagagtgttttccctctgtaagttctaattattacactaatgtctccttgaaccttctcaccaattgtgggatgtaacagattatagaattataatagaaaatggcctaatattgttgatgctaaaaagcaggaaaacatcaccttgattggggcagtgtcatacaccaagatgtaagtttttattgttctgattttagcttctagaacaatcagtgctatgactgattgggctaataactgattttaggaaaagacaaaatctcctaagtgcattttgtctgcagtttgtaagcaggactttgctgacacatcctttaaataatttagaaaaagtgaaaggctctcaaattcaccagcatctcttgcctcaagacacacaattctcttctcagggtctctaagacaatgttctgaggcttcatgaagacttttctgaagaatgttagacaaatcatttaacttctttttgcctcagttattttccattataaaatgagaaagatggactggtctccaaggcacatgccagctccagccctttgtggttcactgaaaggtcagtgtatggagtgctggatttgttcttgattcttctgcaccagtgcaaagaattatacataaattttcatcatcatgatcatcatcatgatcatcatcatcccaacaaccacatctgttatatggtaataactgtgtgtgtagtatttctaattctcgctataatccttgaagtaagcattattttctccaatcgactgatgaagaaattgcactagtttaagagtcatttaatattgaagatcaatttgaatatgaggcctatatgacattttcaaagctgattcaccaaaaaagtttttaatacatatatattttttgcttaattcttttctttattgagggatatttcctgaggctaaattcactagagaataattgtattttcaaagataggaggatgaattcttttccaaggcagcacaattctcactccatctatcatgcagttcctgaatgtatcttcccacgaacagaatgagccactcctttctaatatcttttttggaccctgcctgaatttctggcacagcacctgttacactttatggaatgtaatcattatctgcctatccccctcttattggattctacctgtgaatccttaagaagattactgttttctatactgggggagatttttaaaaatatttatagttccattagttcaatactacttgatatatagtaggtatttaaaaaaaacaaccttaaatgaatgaatgaaatgttgataaatttactttcacagtattgtataaatttaaactacaagcaaaaataatgagtgtgttttatgttttctacattcccatcagcatggtaggctggcagggaaaatgcccttaagacttcattcctttcctagtcccacactctatgagatatttgcaagcactgtcccttttagtttgggaaatcctctcagttctatttaacttcaaaccagcaaccatgatatgatttctagcatttctgcttcatctctattctatgttctccttcttcccttattccttcactattgacagccagttggatggtgaaacattgctctacagtttctactgacaagatcataaacattggagatggaaatggtcaccatcgtctctcaggttataccattatttcttgattgatctgcattagacattagttattggatctctgctgaagttgggctgtgattcatctcttggccctcctcctccctgtacacttattatttatattttctctgttggatccacctaacttattttcccatcagtatgctttcttaatttataccctcaatttgttgaggagcacatactcaagtaacttcctacgaagggtgcatgaaagataggtttttaacatactggtatatctgaatatattttattattgggttaatcacttggcagagcattatattttagattgaaggcattttcaacctcatgatttaaagacgttgatcaattttcttttagcattcacagttactgttgaaaaatttgctgctaagctggatctcatccatttgtatgtgacctttcccccacccctccagtcctgctcccactgctgcaaactatgatctcacaccctatacttcactgagatatgcttagatgtgtataactcttcactaacccttcctggtgcccggtagtttcctttagtaggaatgttgtgactgtctagtgtctttgcgcaggtgtcaccatctgagtaaggcctttcctgaccaccctattaaatttgcacacctgccccagcattcagtgtctcttcctttcctgcctaatatttgcccatagcacatatcaatctcttaatttctgaataacttacttatgtttttttccctcttccttcacttcagcaggaattttggtctattttgttcactgttgaatgccaagaactctgttcagcacctcgtaggtatttaataaatatttgtttaaaaatgtttctgcggggagggaacttagaggacgggtcaataggtgcagcaagccaccatggcacatgtatacctatgtgacaaacctgtacattctacacatgtatcctggttttccttttttttagaagaagaaattttaaaaaggaacactaggagaaacactgagataatactctaatttttgaaataaaatcaaattatgtagtacaaaaagtgtttttgcttcttatttaagaaagaggcaataaaagcttcatctgcatgtgtaaggctcattagctctcaggttgagtgtacaggcagctgtccatgaggagagctggctatcaccctgtgggacccccaaatgagagattggagaattatttacactagggtgcagacatccaagtttctgcatgctcagagatagttcattgtgaaaaacaattaagatacaaaattttatttagggttatgagtaaatatctttaaaaataatatatgtctgtcatcccagcactttgggaggctgaggcgggcagatcacgaggtcgggagatcgagaccatcctggctaacacggtgaaaccctgtctctactaaaaatacaaaaaattagccgggcatcgtggcacatgcctatagtcccagctactcgggaggctgaggcaggagaatggggtgaacccaggaggaggagcttgcagtgagtcgagatctcgccactgcactccagcctgggcgacagagcgagactccatctcaaaataaataaataaataaataaataaataactaaataaaataaaaataatatatgtgtatagtaggggggtgtgtggagagagagagagagatgggggatgaagggtagagaatgagagaaagaatagaaatcggaagtgactccactgaaatagacagtagtattattggtggttatttttaatccccatattttcctgtatatttcaaatttttatattattgtaaaaatttacaataatataaaaattaacaaaatatgttttcaagatgctgcagtgaggattatgtatgtgtgctgggtaatgtgaactgctcatgtgaatatctattcagcacttcctcttcattccaagtttctgattctcctcgtcagctttctacttttttttttcactttttaaccatttggaaataccactttaatgtagatctgggtttatttagaaatcttatatttgatagaggtgttagcatttctgctacctaggcaacaaaatatggttctgctgctaacatcttttcatttttagcaaaatgaaatcttaaaaatcttttaataaacttgtaaaaataaaagccagacttaaatatactccttgccttaaagaaaagaaacatgggggtaataagtacaatgggcagcatataggaccatgtttcttggagaatgtagaacaagtttggagagagaaagaggggcgcacatttcaaaataaaaccaaaacaattcagaaataccaattaaatccactactaattttcaaagtttgactaattgcttgaagagcacactgatcaactacaaatgttgcatcttaaatatatttagactcacatatactattttttagattatggaaatattgcaccttattatagaaaacatgaaagtattgaaaatgcatataaagactccagctaaaatactctatcctaaatatcagagataatctctctaggatgcagttttgaattctacacttttacttaaaaattatattgtaaacatttatcatacaattattaatttcgtcaaaatcagaattcttcagaaccatcaacatactatggtctaactgctccaatacaatttctcatttcatttctttccagtttttgatataataaaatgtaaagaacattctggtgcaaaaagggttgtctgcatctctttgtcattcctaatgacagaattctagaagaggctcctgaagcctgatgcaaaacactctccagcaagacagcagcactgcatgcccccgccgccacctccccccatccccaggttacatgacagcgtccccctgaccctctctagccctgagttgacaattcaataggtcaaatgtgatgtttagacttgtgagatttgggaggaaattgcacttttccccatctttgttgaccatctgtaattccgctataaatcgcccgtgccctttaacccatttttttctatggaagtgttagtatttttcttacaggtttgtttaaaaaaaaaaaccaaaaaaaaaaaaactctgaaaacaaatgatattaactccttgactataatcagtgggaaacagtttttcaaacttgtcatttttatatgtcagtgatactttctttttagtttaaaaaaggatagtattgatatacacactttgaaacttcctgtcatcgtatctattgatcttttccttgcccaaaggatccttctcctaagagtcatccttattttctctgtatatttgtgttgtttcattttctacatatgttgtattatttagacatcgctggaattgatgattgtgtgtgacctatgggataaggtaagaatccagcttgatattttccatattccatttactgagtaatctgtcccttcctttgttttgtgatgttgcctttttagcattcaagccattatatataatagagcatttccttattcagggctattctcttttacccatccatactgtggcaatgctaccctttactgtagctttgcaatatatcttccgtatggtgaaacaagttcaccccctcttattagcttgcatttccaaattttcttttgctgttctaatgtattcattcttccagcaaaactcccaagaaaaaaaatctcattgagatttaccagattgcattaaacctaaaaattaatgtgagtaaaattgaaatctttataatagtctgcacagacacattgtatgtcttttttaagccttattttatgtttcttgatatagccttgtagtatttttcacaaggtctgacacatttcttactgagcttgtatttctaggtgttttatatttctatttgtattgtgaaagagatttttcctcatcagattttccaatcattgctagtatgtttgaggcccatttgtacttagattccttcatcttgctgaattctattttaatgatcttctagctgattgtctagagtttttctaggtatatatattatcatgttgtctgcaaataataactttgttccttcttttccagtggtcacacattctatttctatttttttctgtgatcaaaacttgtaaaaataatattaaacaatagaaaggataacagaaatcctgttttgttcttaatattaatagaaatgtctctagtggcattttcccaataaataatagtatgtgctatcagtgtaaaatattctttaatgtgttaaggaattattcttctattcatggctagtaaaaagacttttccctttaggaatgattgtaatatttttatcaatgcctttcaaaatttaatgatcatatggtttttcttatttgatctattgatacaaccaaagtgatattttctacttggttgtggtagattattcttttcaaatatttttaattcaattgactgataaattatttagagtgtttaaatatattcattttttcttttattctatctttattaagttttattattattaataataataatggcagttgggataatttcacaatctcataccatgttctgctgcacttaaattcttacacaaattttctcatgtaattcttataataactttacaattagatgtaccattatctacattttgcacataaggaaccaagctccagaggggatcttaactccattaagatcatatagcttgtgagggggggggcctgtctgtacagcctttgctacatagtattggggaattaaaaatgagttgggtagctttcctgctgtgcaatggaatagtacatagaataggaaaaatctgcttcttgaaggtatgaaaggacagatttctacatgcacaggaggcaaaatgatgctgtgaaagaacattggctttgaaaccagacaaatgctggttcaaaatctagctctgtctgttacttcgtagcactcaatagaaactaatcattataaaaacatcttatccaagcgccatctttgacaacattttccatctgtgcctggatcattttctaattttttttcccataacatcctgttgccccaggaagtaatatatttcatctagataatgaaaagtattatttcatattcatgtgtattattctctgatagtcttaaaatctctgtggctgctgtcctgtccccttggtctttggtatttaattgtgtgttctctttttatcctaactagattttccaaagatttttctattttttcttaaaccattttttttaaattttagaataatgtagttggctgaatattggctctccaaaaatgttcatgtcttaattttcagaacctgtgaatgttgtcttataaggcaaagatactttgcagatgtgattagattaagaatcatgtgatggggagattatccagattttccaagtgggccccgtgtgatcacaggatccttatacgatgaacacaggaagttcagacagaggagaaagcaatatgacaatagacacaaaaattggagtgatgtagctacaagtcaggaaatgctgtcaccctctagaagctggaaaggacaaggaatggaatcttcctggagcctcccaaagaaaccagccctgccatcactttcattttagtccccgagactcattttggacttctgacctgtagaactgtaggaaaataaatttgtattttaaaccactaaatgtgtgctaacttgttactgccacactaggaaactaaaaccaatagttttagattaacagaaaaattacaaagatggtacagagtttccatatcccccatacccagtttcccctattgtcaacatggtgcatttgtcccaaggcatgaaacaatattgatccaatatcactaactaaagtccgtattttatttagatttctttcgtttttacctgatgtcctttttctgttccaggagtgcatctaggaaactatctgtgtttagttgtcatgtgtccttgggttctttttagctgtaacactttctcagactttcgtcgtttttgatgagcttgatagtttgaggaatgctggtcaggcattatttaaaatgtccctcaactgggatttgtctgatgtttttctcatgattaggctgaagtatggatttgggggaatgatgatcacagagacaaagtgtgttgtcctcacattatagcaagggtacatactgtcaacgtggcttattgttgacgttgaccttgatcacctgactcaagtagtgtttgtcagcttctccactgtaaagttactctttcccttcctttgtctattgttttacagcaaaaaaggcgctttttaaaacttgtcagttccactctttttctgctatatgattaattaatttcttactttatgttgattaattctttctgtcatcgttgtggttccttttttgttctttttccaacttcctgagttaaatcctaggtttacttattgttattttttaatacataaagcatttaaggacatgtgatctccatttagcaaggagttattagtttgtttatttgtttgttttgttttgacttttgtttgtagagacagggtctcactatgtcactcaggctggagtgcaatggcacaatcttggctcactgcaacctccacctcccggcctcaagccatcctcccatctcggtctcctgaatagctgggactataggcgcacaccaccacacccagctaatttttttgtacttttagtagagacggggttttgtcatattgcccaagctagtctcaaagtcctgggctcaagtgctctgcctacttcagcctcccaaagtgctgggattatagccgtgaatcatcccgactagcttagtttgtttaaacacttgttattagtttccatgtttataacatagcagtaaaagtgtgtaccttatataacttctgctatttggaactttgtcaggtttttctttttcttttgacatacaattactttctgtaaatatcccgtgagtactttgaaagaagttatgttttctgtttgcaggatataaactagacattaaattctgcagtggatgagaatgtaactgtttgacttaccattaaatatctagcccctagtactggacctgatacctagtaggattgcattaaataactattgagtaaatggctgcaaaatttcaacagtcccagttgcaacaaccaaaaatgtctctagacatggtcagctgtccccttgcagacaaaatcattcccgattgtgaaccactgctctaaaatgatatgattattcacagaaaatccaaaagaatctcctcaaaaagtattagaattaatatttgaattcagcaaagttagttgaagggtataaaattaatatacaaagatagcattcatatatagcagtagtaaacatttagaaaatgtagttttaaaataaataatatcaacaatagcaattaaaattataaagaataaatctaacaaagtatgggcaagacttatgaagaaatttattaaaatgtaacgagaaacattaaagaagacctaagaacagagaaaccatgattatctaagagaagattcattatcattgaagtgttgtttcttccccaattggcctataattacaattcgattccaacaaaaacctaacagagtttttgtgggacttaactgattctaaaacttatattgagaagacagcataaatatagttaagccacttttgtagaagaataatttggaagccttgctatatcagattttaaattttattctaaagccatagtaatcaagaatgtagacagagatagacaagtagaatcaggaaataggataaatatttaatatttaatatatagttctacacatacatgaaaacttgatataggacggaggaggcatttaaaacagtgggcaaaagatataatgtgctgagataactgactttatgttttaaaacattctttttatttactctctttgtcccactggaaggtaagctccatgagagcagagatttggtgtgttttcttcacagctgcatctccaatgtctagaataactcaggcatacagtagttattcagtagatatttttgaactactaaatgaaaaatccattttattagttttcattgcttttcctattattatataacaaaatatttacagtttctatgaaggtttggaaaaaatgtttctctctctctctctctccccctccctccctctctctcttcctccctctctgtctccctccctctctctctctctccctccctccctccctctctctctctgtgtgtgtgtctgtgtgtgtgtgtgtgtgtgtgtgtgtatttctttcccaagagcccaaggaagtcactgaaagctagatatagcaaaatggtagctcaacaccagatgcaattatttaataataaactctaaatttgtttgcccccttaataaaactctatattccaatattcaaaattattaaacaaagtaaggaaattgttgtttatttcaaagatttttgtatgctgcagatatcacaggttccctttaaatatttatattaaaatatggttcaacccataaagccataggaatatgtctgttttgccaagtaaggtagctcatctgtatctcttatgagaattttaataaaacaagtattaaggcttctttcagacagttccaacagcatgattctaatttttggtgtcctttaaaatatcaaattactcctggctatgcttccttacagaccaccaaagacaatggaacttagccagctgacaaggatatttataatcaatcatggcaccctccaacagttccctctctcacacctattggtctaagagagtttgtctgagagaatcaggtgacattggatagttcagagcaaatccaagaacccacctgggaaattgagccaatccacaggtctctcaaaaagcattcatttatgcttcattaagcattcattatgaccaagaatttgtgggttcctatcacttgtcaggcactaccacatcattaatattgcggagtccaagagttatatttgctattatcatacaaagtctgaacatctcaaccagctgaggtattaagttcaaactctgaagcagtaaatagcggcacagtgatttggcaagtcttaaaatggctctgtgaacctttcagttgagtgcaaacacctggtatcaaggttctccttcatcttgagacccaacaaccctcctccccatactgtaccccaggcccctttcactccaccactgcaaactctcactctctggcaaacagcccagcctcactcctggctctggaggctggcttttgttctgacttctgcctcaatctagaagaccctccacttcctctgtgtccatccaaatcctacttttcttcagggctccgccactctgactgtgttccccccatcaaatgtagggcactccaacagccctgatcccaagtgtgaagctgtggcctcagctggacatcctgtctggtcttggttagcggaaaggcaacagaatgaatgtccactccaggtaagaaacctcttcattttatagaccaagaaactaagatatagaatgattgagtgactctttctaagaaacaaagtggttagcgtgctagaaataggaagttggtgggcatagtgaaaaacatttgtttctctaaagggagaaacatctgaatgtaaatcccgcattgacaacttactagccgaggaaattcagggaagttactcaccttcctcaatcactgctcccatactataaattgacaaggataatatcttctttgcaatattgttgtgaagataagatataaagagataaaatatctgactcatactaagtgtaactgtgggaacccacttctttcttaattttactaccctgcttctctacaagactgtaatctgcttgaaaacaggatctatgttgatcctacattctatagtcccctacgttctccataacagccaacacacagtgcacagcataaagtgggagcttcagaaatactgttttttcctttttctttttttgagacagggtcttgctctgtcacccaggctggagtgcagtggcacgatcacagtccattgcagcctcaccctcctctggggctaaagcaatcctcccacttcaccctcctgagtcgctgggactacaggcacatgccactacacccagctgatttttgtattttttgtagagatggggttttgccatgttgcccaggctggtctcaaattcctgggctcaagcaatcctcctgcctcggcctcccaaaatgctctgattacaggtgtaagcctccatgctcagcccaaaaaacacttttttaaatgaaaaagcttgttttccggaaggacaacattcacttaaatgaatgttctctcaaagaacaactatgacttaaataaacaatgaatttaagtctattatcttgttttttccatttttattgctctatcatacacttatcttttatatacattctcttatatgacaaattattgtgtaaacaaataaaatgttagtaatgaatgagacttctaccctataagagggtagtattcttggataaaatgtaggagcttatatagttttaatccatgacaaataattaagtgcttcccaatgctaatttttattttagtactaaaactccaaatatcagagccgaaaagatttccagaatcatgccaaagggtagctcctaagtttactctggcgcaatgccacttacagggtgagaaaaagttcatgatttcccattgtgtgaatcacgtgtacaaagtccttttgtccaagtggccttgtcatgtgagaccgctaagtatctttcacttggccttccaatcacgtccaaagtgtcatacccccagaagcaatttgatgtatgaataatggaagcctgaactgaagctcaacagtttgtaagaattgtactgtgcctagtgaaccaaatgcagacctctccaaagctcgctcagaacatttacaagatgaggaaaattcaaattaagagtcaaaggcatttcagggctgagaggtaaaaatagaatactggtcaggttattggaggacaaagaacaaaaagtttattttgtttgagaacagaattggaattagaatggagttcatctcattttaggacttgctcattttaccaaaaagaagtaaaagcaaacaaaaatttattagagagtagaaggtaaaagaattgggatttgatttctcacatggcatgggaataaaaatgtgcaagatttttcctgttttgaaaaattatcaaagggttatttagtgggaatctatgttttaaatttctgctttaaactacatcactttaaccttctaagcctacccgattcccctgtagctgtggaatcacatgaacccacaaaggcctgtgtctacttgttttactctgcagattctcaatcagccttcatgaatgcttgttttgacactttccttttagcaattctgtgtgcacttccctagctcctttcgtccactaacaaatcttcattagacttcgttagacctaagcttttcagccacttaaatgcggaaaactacatattttagaatattatctaggtcatctacctgccagaattacatggtaaatttctcaataaaagatacaattcgacatacctcaagcatgtatatgtgttaaagtgatattcttctaaggaaaatattagcaggcatctatacggttgttgggggaggggaagagttctatttttctttaagaatttcttgagaaggagccatattccgagtccttattacactctccaacagaaataggtgagataaaaagaaattgtgagcagatgagatatccctccaatgatgttaattatggaagttatttctggggcctcttatgaaatcttttcacttgatttcctggctaacagagtggctagatctaaggctactttatgagctgagtgaaagaaacacagcacaggtcttccagaaatctctagaagggccccaaacattcctaatcatctagtcctgtcccattacccaggaggtttcagggaacccagatcctctttagaggtgcccttgggaatattggtcttattgatttaaaaatgatggcgctgtggccgggcacagtggctcacacctgtaatcccagcgctttgggagggcgaggtgggcagatcacttgaggtcaggagttcaagaccaccctggccaacatggtgaaacctgtctctacatctctaccaaaaaatacaaaaatcagcccggtgtagtggcaaacacctgtaatcttagctacttgggaagctgaagcaggagaatcacttgaaccctgaaggcagaggctgcagtgagccgagatcaggccactacactccagcctgggtgacagagtgagacttcatctcaaaaacaagaaaaaaaaaaagatggtactggaatttctaaagagagcagtgatgtggatggagaaagtgatgctttttgaggctgcatatattgtcaaagaagattgaggaagcatcactggaccatctcaaagaatgatgtttgagaagcttatgcatattatggggaggggacacagagaccctggtatctcccactggcttcattcttctttacctatttctccttgataataaacttcccacctctctgacagtcagactgaaaaacgtacttcaccacagtttgaagaacagatcatgctgtattatcaaaaggtaaattccaggaatcatatgtgttttcagagttctgttttgttgcacttcttagaaaatgcctttattcctcctttggttcactacatggagctaagaccactgctattcttttaatatttgatatttgaatctgatcatatgagttttcattcctcattatagtttacaatgtgctttcttttatttaacaatatttctcaaacagagataatcaaagatgtgatgggggtatgcaacatgaaagaacagagcatcaatgtattgttcctgccggcgagacacttgaaacgttatttatgtagtaaaacaaacacacatctattattaactacaatgtataattcacatgaatttctcagataaaacataagacttcaaagaaagtcatgcctgaaatttgcagctacgagctttacctacagtcttctaaaagcactaaaggtgcttggtagaaatttgagttagcataggtaaacatttttttcgtattttacttccacccaaaaaaatacataatagataacatgtttactgttattacctcccctttatggaacagaaaactaaggcttagggggtttgacttcactaggtaactttgccactttctaattgacagagccctttctgcccacctctccatgagtgagttcttcatgagtaaaatttccctgggctggtaggctgaataatagccttccaaagacatccatatctgaatcccaggacatacgaatatgttactttacacagcaaaaatattttgcagatgtgatgaaggtaaggattttgagatggggagattattctgaataatctagataagcccacgtaactacggggtcttggtaaggggaagatcagagtcagaaagttgttacatctaaggatagaaacagcagtcagagaggagagaagagatgctatgctgttggctttgaatacagaggaaggggccacaagccaagacaggttggcaacctctagaagccagaaaaggcaaaggagtggattctctctcaagcctctagaaaggaacacagccttgattttagcccagtgtgacccattttggacatttaaccactggaactataaaagaatacatttccgtaggtttaacccactaaatttgtggtgatttgttacagcagcaataggaaataatatacctggtaaggctatgccagtccccacattctgttttctttcatccttatgcccactattagtattgccttatggttttattttagtgattttaatttatcatagtactatatacagagtttttagttccattaaaagtcccatacatttttagtttcattaaaagacaaatggaccagtggctgagaatgtggagaaattggaacccatgtccattgctggtgggaaggtaaaatggcataactgctgtggaagagtttggtgggtccacattagattcaatatagaattactgtatgatccaggaattccacgtctggttatatacccaaaagaagtaaagcaggtgttcaaacaacaacttgtgcacaagtattcacagcagcactacactcaatagccaaaaggtggaaacaacccaaatgtccatcaactggtaaatgaataaacaaaatgtggtgtatccatgcaatggaatattactcagccttaaaaaggaatgaagtactgatacattctacagggtagataaactttgaaaatattatgctaagtgaaagaagccagttacaaaaggccatatattgtgtgattttatttataggaaacatccagagtcagcaaatccttagacagaaagcagattagtgattgccagtggccaggaggagtggggaatggcaagtgactgcttaatggtacaagatttcctttggggttaatgaaaatgttctagagcaagacagtagcaatgtttacacaacattgtgaatgtcactaataacacattttatgttatgtatatcttaccacaaagaaaatttaagacaaatagagctaaatgtttgtaaagtcaataaagcatcacactcctgcctcctctattccccctcccccaccaccaatttctaactaactcccagttttacagtccaaggacttccatttaaaagtgaatttttgataactaatgattttgctatttgctgcgtatttccaaataacatactaaattgcatgtctcaaagacagcaattaactttcccaagaccacacagctggtaagttttgaagccacgatttgagtgcaagtccttaactctaaatctcaggaccttataataataaaaataataccaagaaaagctaaccctaatatagcagttactatgtatggtaggtgaatagttgctttcagagatatctatgtcctagtccctaaaatcactgaatatattagattggttggctaagaagaattaaggttgcagagggaattaagtttgctaaacaactgaccttaaaacagagaggttatcatggattttctggctggcccaatacaatcacccagtgaaagaagggaaaaaagtagaggagggaagaagaaggaagaagagaatcagagggagacatgacaacagaaaaaaaggcacagagagatgcagtattgttggctttgaagatggaggaaggggaccatgagccaagaaataatgagtacccttaaggagctgggaaaaaaaggaaatggattcctccctagagcctccaaaaacaagcagtcctgcctgctgttcagttttaacccagtgagacctgtgaggaacatctgacctagagaattgtaaaatagtaaatttatgttgtttatgcctctaagtttcacataatttgctacagcaacaatagaaaactaatacactgtatgtcaggaattgttctaggtgcttatatatattaacttatttgatgcttataaaaactctgtgaggtatgtatgttattatcccatttttctgatgagaaaactgaggcacagaaaatatttgagcagacactttacagaagacagtgtcaataggcatatgaaaagatgctcaatattaatggtcaccagggaaatgctacttcaaataatgagatactctacatatgcattagagattttgaaattaaaaagacagtatcaagtattggcaaggctgttgaagaaatggtgctctcacatattattggtgtgggggtaatataaaaatcactatgaaaacattttcacaaatttttaaaaaggtaaacatatactcattgtaatacccagcatgcacctgtagtcccagctactaaggaagttgaagcaggaggatcacctgagcccagaagttctgggccgaagcgtgctatgccgattgagtatccatactaagttcagcattaatatggtgacctcctgggagtgggtggaccattagattgcctaaggaggggtgaacctacccaggtcagaaacggagcaggtcaaaagtcttgtgctgatcagtagtgggattgcacctatgaatagccaaggcactctagcctgggcaacatagtgagactttgtctttaaaaaagaaaaaagaaaaacatccagcattcttactcctgggtattttccaaagagaaataaaaacatatgttcacacaaagacctgtatacaaaagttctgagcagctttattcacaataatccaaaaagtccatcaacatgtcaacatacaaattttggtatattcattaaattaaatgcttcttaacaatgaaaaaggaatactgaaataggaaaaaaaaagtggatgaatctcaaaaacgtggattcagtgaagctgggcatggtggctcacacctgtaatcccagcactttgggaggccaaggtgggagaatcacttgagcccaggagttcaagaccagcctgggcaacatagagagaccctgtctctaaaagaatacaaaaattagctaggcatggtagcatgcacctgccatcccagttacttcagaggctgaggctgaggattgcttgagcccggagatcgaggctgcagtgagccaagattgtgccactgctgcactccagcctaggtgacagagtaagaccctgtctccaaaaaaaaaaaaagaaaaaaaagctaagtgaaagaagtcagacacaagagtattatatgctgtttaattccatttatgtaattatggtattacataattaggtagaagagactaacctaatcaatagcaatagcagataaatgtttgcctggtttgagggaaattaactgcaaaggggtacaaggaagcatttagtgtgatagaaatgttacaaaggtataaaaatttgtcaaaagtcacagaaatgaactctaaaaatgagtacttcttactacacataagttatctctcaataaaatttattttcaaaaaatgtaccaagtcacacagctagagttatagggctgggatttgaaaccaggcagtccaactctagtgtctgtgctctcaccagtagatagctttctatccatgctatttgggcactgtaacaacccaaataattgtccctaattgtaagggtcaaaattctttggcactccttccatcgagatgttcgggtctaatggccgggcacggtggctcacgcctgtaatcccagcactttgggaggccgaggcaggtggatcacgaggtcaggagatcgagaccatcctggctaacacggtgaaaccccgtctctaccaaaaaaaaaaaaaaattagccaggcgtggtggtgggtgcctgtagtctcagctacttgggagtctgaggcaggagaatggtgtgaacctgggaggcagagctttcagtgagccgagatcgcgccactgcactccagcctgggcaacagagcaagactctgtctcaaaaaaaaaaaaaaaaaaaatatgttcgggtctagttctccttcctgtgaatcttgctggtctgtgaccacttttttttttttttattatactttaagttttaaggtacatgtgcacaacgtgcagattagttacatatgtatacatgtgccatgttggtgtgttgcacccattaactcgtcatttaacattaggtatatctcctaatgctatccgttcccccttcccaccccacaacaggcctgggtgtgtgatgttccccttcctgtgtccatgtgttctcattgttcaattcccacctatgagtgagaacatgcggtgtttggttttttgtccttgagatagtttgctgagaatgatggtttccagcttcatccatgtccctacaaatgacatgaactcattttttatggctgcatagtattccatggtgtatatgtgccacattttcttaatccagtctaccattgttggacatttgggttggttccaagtctttgctattgtgaatagtgccgcaataaacatacgtgtgcatgtgtctttatagcagcatgatttataatcctttgggtatatacccagtaatgggattgctgggtcaaatggtatttctagttctagatcccagaggaatcaccacactgacttccacaatggttgaactagtttacagtcccaccaacagtgtaaaagtgttcctatttctccacatcctctccagcacctgttgtttcctgactttttaataatcgccattctaactggtgggggatggtatctcattgtggttttgatttgcatttctctgatggccagtgatgatgagcattttttcatgtgtcttttggctgcataaatgttttcttttgagaagtgtctgttcatatccttcacccacttgttgatggggttgtttgtttttttcttgcaaatttgttggagttcattatagattctggatattaaccctttgttagatgagtagattgcaaaaattttctcccattctgtaggttgcctgttcactctgatggtagtttcttttgctgtgcagaagctctttagtttaattagatcccatttgtcaattttggcttttgttgccattgcttttagtgttttagacatgaagtccttgcccatgcctatgtcccgaatggtattgcctaggttttcttctagggtttttatggttttaggtctaacatttaagtctttaatccatcttgaattaatttttgtataaggtgtaaggaaaagatacagtttcagctttctacatatggctagccagttttcccagcaccatttattaaatagggaatcctttccccatttcttgtttttgtcaggtttgtcaaaaatcagatggttgtagatatgcagcattatttctgaggtctctgttctgttccatttgtctatgtctctgttttggtaccagtaccgtgctgttttggttactgtagccttgtagtatagtttgaagtcaggtagtgtgatgcctccagctttgttcttttggcttaggattgacttggcaatgtgtgctctcttttggttccatatgaactttaaagtagttttttccaattctgtgaagaaagtcattggcagcttgatggggatggcattgaatctataaattaccttggccagtatggccattttcacgatattgattcttcctacccatgagcatggaatgttcttccatttgtttgtgtcctcttttatttccttgagcagtggtttgtagttctccttgaagaggtccttcacgttccttgtaagttggattcctaggtattttattctctttgaaacaattgtgaatgggagttcactcatgatttggctctctgtttgtctgttattggtgtataagaatgcttgtgatttttgcacattgattttgtatcctgagactttgctgaagttgcctatcagcttaaggagattttgggctgagatgatggggttttctagatatacaatcatgtcatctgcaaacagggacaatttgactttctcttttcccaattgaataccctttatttccttctcctgcctgattgccctggccagaacctccaacactatgttgaataggagtggtgagagagggcatccctgtcttgtgccagttttcaaagggaatgcttccagtttttgcccattcagtatgatattggttgtgggtttgtcatagagagctcttattattttgcgatacgtcccatcaatacctaatttattgagagtttttagcaagaagagttgttaaattttgtcaaaggccttttctgcatctattgagataatcatatggtttttgtctttggttctgtgtatatgctggattacgtttattgatttgcatatgttgaaccagccttgcatcccagggatgaagcccacttgatcatggtggataagctttttgatgtgctgctgcatttggtttgccagtattttattgaggatttttgcatcgatgttcatcagggatattggcctaaattctcttttttggttgtgtctctgccaggctttggtatcaggatgattccggcctcataaaatgagttagggaggattccctctttttctattgattggaatagtttcagaagggatggtaccagctcctccttgtacctctggtagaattcggctgtgaatccttctggtcctggagtttttttgattggtgagctattaattattgcctcaatttcagagcctgtttttggtctattcagagattcaaattcttcctggtttagtcttgggagggtgtatgtgtcgaggaatttatccatttcttctagattttctagtttgtttgcatagaggtgtttatagtattctctgatggtagtttgtatttctgtgggatcggtgatgatatcccctttatgattttttattgtgtctatttcattcttctctcttttcttctttattagtcttgctagtggtctatcaattttgttgatcttttcaaaaatccagctcctggattcatggattttttgaagggttttttgtgtccctatttccttcagttctgctctgatcttcgttatttcttgccttctgctagcttttgaatgtgtttgctcttgcttctctagttgttttaattgtgatgttagggtgtcaattttagatctttcctgctttctcttgcgggcatttagtgctataaatttccctctacatactgctttgaatgtgtcccagagattctggtatgttgtgtctttgttctcattggtttcaaagaacatgtttatttctgccttcatttcgttatgtacccagtagtcattcaggagcaggttgttcagtttccatatagttgagcagttttgagtgagtttcttaatcctgagttctagtttgattgcactgtggtctgagagacagtttgttataatttctcttcttttacatttgctgaggagtgctttacttccaactatgtggtcaattttggaataagtgcggtgtggtgctgagaagaatgtatattctgttgatttggggtggagagttctgtagatgtctattaggtccactttgtgcagagctgtgaccactttgaccactagaatgaagtggaaatggaactattccatttccaggcctcgcctttaagagactagcagcttgacactggtctctcaaagccctgggatgccttataagaacgcccattacctagcttgaacaccacatggagaggctctgaaacttcatagagtaggagagggggccaactgagcccagcttcctggcaccctccaaaagacaacagatatgtgagtagaaatgtcttagatcctacagaccagacaactcactgaattagtattactgaatcaatccagacaagaccacagggggcagtagaattagccagctgagccctaactcaaatcctgacccacagaatcatgagatataataagaagatactgttttaaaacatttcattctcaggatactttgtcaggaagcaatagttaactagaaaactgatcaaagggcattcccatttctgttgccactgagatatttcaattcttcatgataaactttctttctagtattccagatgtgataccataattttcccacttaggggcttaataaaggatgaacagctgaaagaattatggagcccattctcactagttacatcaagtctgtaaataaacagtaatgtcaattcagaaccaccagcatcctctgctcaggctactgtatctggactactgttatttattcaccacatttaaggtaaggtataggcaattctcagcacacctagtccaaaaattaaacaacctcaagtttttgtgtagcagtcagatacttatataattcttcttctatgaaagtcagtcttttctgatataccaaatcacctactggatacaggtaagaaattggatgcatcagaaagaagatattttttgaaacgttgggcaatgtctgactttagcatctgtgttaatgcacttcagtaagtataaagtactgatgcttcactttatggggttggaactctgcttagctacaaaatgccagctgtccctatggctccagttgcttactactcaagaatggagtcaatgtacaaaatagaactatgcacaaactggcagagaagcccttgatagtactgtagattcaagaattgttgagactatactattgcctttcagataaaaatgcttccatttgctataatttacaaagtgtattctcatagaatcagagtttttaaaaatgtatttctttgtttattggttgtttatgacaacccacttatctatagtctgataaaacagtgtcaaatgttaatacttaaatgatctgctaatactattagtaatgccagattatgccactccctgcataaaacccactaatggccacttattgcaagctatttaccacggcctcgaaattctggcatgatctcctgactgtcaacctccttcatctgatattgtcttccccttcactattctccagccacagaagcctttattaggcacttattttgtgccaggccctgcgccaagttctttagatgcattatccgatttaatattcataacagccctgggaaagagataatatcattgccattttgtaaataaataaagacccagaaatcatgtaacttggccaaggtgacataaatactgaatattggagtcagttatttaacctctatatactgattcaacttccaaatgtgtatcttccctgaattcagaccatatatccagctgtccctctgatatctccacttgaatgtctagcagacatatcaaacataacctgctaagtaaatccaaattagaagttttggtttcccctttcatcctcatctttccaatctcggtcattggcaccacccgcttgccaaagacaaaagcttcagtgtcatctttcattgctctcctgcccacatttaatttctcagcagcttttatcatgtttctcttgaaaatataaccagtatctgcccactgccctccatctctgttgttgctaccctaaactgggccgtcttcatctcccacatgagcttctgcaagtctcctaataggcctcactacttcctctcccgcctcatcacacgtagcctggtggtctttagaaagagttgtcacttaccccttaaaaccctccagtgatttttttcccacaacgtgaagaatgacagccaaactcctgaccacagcctttgtaatcatacttgatctggcatccctgccagttttcagcctctcattgtttgttattattgctgctgttgtatgggaaggggaacccagaggcagaatcgtgtcagtcatattccttagtttgtggagcatcagcatctttgatccacataagatccctctcttgtatgttggttggttatcttgtttatttccttttatccaaattccccacctgcatttcctcacctactgtaagcagcctaccattttgtttgtaggtgttactataaattttatattgatgttttctatatttttagtttatataaatgatattgtgtaataaatcacattttgcttcttgctttctacacatggtgtcatgaagatccatctaagtagcatttttcatctagtccatgtcttctcactgccgcatagtactgtctggtgcatccactgccttttgacaattcctcctttgggatggacaccaggttagattggctcccactcacaaacagtaggcatcccattattgtagtcatgtgtgagaattattttgcaacatatatcagtgggattgctgggtaatcttgtgtatttaatctgaaaatgtactgtcaaatagctctccagaaggcctacagcctatgttcttaccagtagtgcataagggagccaatatctgcacccctcaatacaaatatccaagcaatttgatccaagtgaacattaggcattttccaactttctgagttttgtcacttaaagaggtgggatgtttttgatagctaatgaatttgagcaccttttatgtgccataacttaggtttcctcttctctaaattgcctgttcatggcttttgcctgttttttcaactagtattactttttcttgctgattttacaagaacttcttgtaaatgctaggtataggtcttttattgtataggtcttttattgacattagacagtgaaaatattttctgccaaactatcatctgtctgttaagtttttccgtgttattccatactgaatagcaatcttttgataaaattggattcacccgtttatttttattttattttttcttgtgatttgtgctcctgaatttttttaggaagtcctttctcactaccaagatgcaaatgatgagggttttgtatttttccctttctatagttgacctctttttttcccttttcatattgcttgggaaactgccaatgttattttaacagtagcagtgacagtgggtatcttttttttattcccaatcttaaagggactgcacattgagtttttccataagtacagtatagaactctactatgttaaagagtcccttcagttccttctatattgataggcttatcctaaataggtattgacttatttatgttttatcaaatgttttttccacatcaactgagatcatttatttttacattagactagttatgtgatgaattatgtggctagaaacgttttgttaaaccatcctttcattccagggatgtaaaggataactaatcttttattaaggattttttttctctatgaccataagtaaaatatacctattattttcttttgtgtatgttttttgtgttctttctatctacttatatgtcaaaattacacttgcctcacagaacgatctgggcaattcatttcctgtgttctatgcttacttctataagatagaaattgattgtttcttgaaatactggtaatactaatgtgtaaaaccatctgtgcctgggatttcatgtgatggcttgtctttcagataccatttcagttagtaattattggtattttctggcctatttaaattttccatttcttcttatgccaattttgacagcttcctttttctaggcatttgtctattatatataagttttcaaatattataattctcttttattatttttaaaaatctttgttgaggctgatgttatttctgctttttaattttgtgtttaattttcattatctctcttgtatcttttattaaataaacattttattgaagtataatatacatacagaaaaacatatataataggtatatagctctatgaatttttgtgtatctctgtgacatacatatctataaataaaaattatggatcaagcctacatatgtgcacaaaaatgcatgtataaaaattatcacagtaacaatttacaactgagaaaagtgaaaataatatcaacatttatcaacgatcaataacaggatggataaagaaatgttagcatatttatattatggaatattatacaacaataaaaaataataaattactaccacacacaaatatatggataaaacacacaaacacaatgttaagccaaagaaaccaaactcaaaggagaatgtactatatgatttcattcatataacctttaacagaggcaaaactaacttatggttatagaagttagaataatggttaacttgtgaggagggggacaggggctgggaagcgcatgaggaagggttctatggttctatggtttgatctgggtagtggttacaaagatgtgtttactttgtaaaaattcagtgaactatttgtacacttatgaattgtgcccttttctatgtatataatatgctgcaatcaaacgtttataagagacaatgactgtcacaacaaaataactaaaagccttaggagtatcccacacatggtaagaacattccaaacaaagtgacttcaagaggttgaaaataaaggcattagcaaagagatacaggacaaacactaaacaacaaacaaaaaaaggagtggtcatattaaaattaagcaaggtggaaagtaaggttaaaagtactcaaaggacacaagggagcataatatgataataaaaaagcacaacattgtgaagaagttctaacagtcataaacttacttaaaccaaacagcacgggagctaaatatacacaaagcaaaccaattaggaagctattttaaattcaactaaagtgtgagatgtctctatatttctttcagaatcaaagaatactgtactcaaataaaaacaaggagaaaaacagattaactaatatatcaaaaataaaaagtaataaaatatttagaataactttggtacttttagtactttccaactttgcctaattttaatattatcactcccttttccctttttgtttgtttggtatttgccttgtgtaaaatatacaattttcatatgaccataaaatatttatcaaaatcaatcatatatatgtatatatatgcatgcacatacacacatatatgtgtatatacatatagtagactttataaattgaggctataaaataacccaattatattaagaataaataataaaatgttgaccaaaaataaaaagcattaactatttagaaattaagaaagacatttccaaatagccattagatcaagaaaatttcaaagctaaaattatacatgctatagaagcaaataaaaggaacacttcatagatgaacttatgagagacagccaaagatatactcagagatctgaaaaaatagtcataatgccattaagatttcaaatgtaaaagactggaccccgtggtgaaacccagtctctacaaaaacacaaaaattagccgggcatggtggcctatgcctgtaatcccagctactcaggaggctgaggtgggaggatcacttgaggccaggaggttgtggctgcagtgagctgtgattgcaccactgcactccagcctgggagacaaaacgggaccctgccaccctccccccacccaaaaaaaaacccaaagaacaaaacaaaacaaacaaaaacctcattaatttaatttaatttaaataaataaataaataaataaaagatgaagaaacttggtacctgtccagtaaattaatgaaaaatggaaagccgctttaggaagagagaattcatagaaacaaaacttgaatttaaccaaatgagcaacaaaaattagcagatgataaattaatccaaatgctggtatttcaaaggacccaataaaatacataacctatcacaaacttattttaggagataaaagaaaaaataaaaacgtagaggatcgggagtgagaaaagagacaaactacaatacaggagaattttttttaattacaagacggaattatatgcaactccatggcaacaaatttgtgaatctagaagaaatgaataatttcttagtaaaatgtgaatgaccaaaattgacccaagaaaaagacatgaaaaactttgaataggccaattaccacagaagacactagaaaggttaaaaagacctttcactaaaaatgttacctactggcttcatagctgaaatctaacctttaaagaacagctagttcctatgttattcaaatgattctaagtcagaaaaaaatacagaagctcttgactcattttacaaaaccagtacaactttaatacaaaaaaaagttgtattaaactttttaaagaaagtacagaaacagataactgtaatttcatttatgtgtttggatgcaacaattgtttttaaaaattagcaaat

SEQ ID NO: 1273 - DNA, 2301 bp, Homo sapiens
cccttgagattttacctagagataccgaaagaaaagataacatctgaatacaagaatcgcgttgcatatttgctgcctccatagggttgttgtggtagcgactgattttccacccctcccagtttggtggtgtttgtttgtttgtttgtttgtttgttttaagtaaaatgtcagaaatgcaaaaatgctgcatttatttcccttaagacattgaaaatagtggaagtttgcagatttttaattcttcgtaggtctgagctggcactagactgctaccaaaggggtctgttccacacgctaatttcaggcttgcggaccatcagcaaactgcaatgaaacctgtgggcatgaatcttccagagtggtagaatctcattcccatatgcccgccaagtttccaggtgtagctgggaaaacccaaatgttccctggatcccgagatggctaataagcactcaggcctgctacaccaccgaacagagccccacagccagagaggcacacggcctgcttcacacagccgacaaccccgctggaaacaaccagtgctgggagccaaggccaaactgatgcaaaggcgctactgagccagagcccttctgcaccgagactaccccaggcatgcaccgccctcccaaaggtccaaaacgatgcaaaggcgctactgagccagagtcgtgcactgagactaccccaggcatgcaccgccctcccgaaggtccaaaccaatgcaaaggcgctactgagccagagtcctgcattgagactaccccagacatgtactgccctcccgaaggtccaaaccaatgcaaaggtgctattgagccagagtcctgcactgagactaccccaggcgtgtaccaccctccggaaggtccaaaccgatgcaaagccactattgagccagagtccttctgcaccgccctcccgaaggtccaaactgatgcaaaggtgctactgagccagagtccttctgcaccgagactaccccaggcatgcactgccttcccgaaggtcccaaccaatgcaaaggcactattgagccagagtcctgcactgagactaccccagacgtgtaccgccctcccgaaggtccaaaccaatgcaaaggcgctattgagccagagtcctgcactgtgactaccccaggtgtgcgccgccctcctgaaggtgcgtgtgggtcgacaagggtgcacaagcggcagggggctgcatagcaaggtctccttcagctttgttttaattatttttatagagacagggtctcactctattgcccaggctggtcttgaactcctggattccagcgatccttccaccttggcttcccaaactgcaatgattacaggcatgagccactgcacccggccaatctttgtatattgattttgtgaaggctctttatgtattaaagacattcattcacaggccgggcacggtggctcacacctgtaatcccagcactttcagaggccgaggcaagcggatcacctgaggtcaggggtttgagaccagcctggccaacatagtgaaacctcgtctttactaaaaatacaaaaattagccggacatggtggcaggcacctgtaatcctagctacttgggaagctgaggcagaaaaatcgcttgaaccccagaggcagaggttgcaatgagccgagattgtgccactgcactccagcctgggcgacagagcgagactcttgtctcaaaaattaataaaaataaaataaaatgaagacattcacagttctatatactatgaataaattttcctagtttgtcatttaacttcttaattcatggtgttttgttttttcagtttttttttttttttttgagatggagtttcgctcttattgcccaggctggagtgcaatggtgcaatctcggctcaccgcaacctccacctcccgggttcatgcgattctcctgcctcagcctcccaagtagctgggattacaggcacccgccaccacacccggctaatttttgtatttttagtagagacagggtttcaccatgttggccaggctggtctcgaactcctgacctcaggtgatccacccgcctcagcctcccaaagtgctgggattacaggcgtgagccactgcgcccggccgagggttttaaagatcataaatagggtaggtattaacaatagttactattatgatatgtgttatgacttcataacagggaaaatcttctggtcaagctgctcctgggcatagccaacgagggaagtgtcctctggcaggaaccacagctctgggaggaagaaaaggaagccgactacag

SEQ ID NO: 1274 - DNA, 14942 bp, Homo sapiens
actctttcatcattgtgtctgtggatctcacggttccagttctcagcatggtttcccctgggtggttgacccttggtactgcgtcggttatagccagccctgtaacccatctctgggtgtcctggggagactgtatttcactgtttccatcttccgctctgctcttctcccagcctcttagtctattttagcttcttttctgtggtatttctgtctctctctctttttaaacttcgtcccccaaatatttattgagcagctattccatgccaggcacgattctaggcactgggggtagagtggggaccaaggcagagcatgcgccagccttcaaagaatgtttttttctttcttttctttttttttttttgagacggagtctcgctctgttgcccaggctggagcgcagtggtataatctccgctcactgcaagctccgcctcccgggttcacgccattctcctgcctcagcctcccgagtagctgggagtacaggcacccgtcaccacgcccggctacttttttgtatttttagtagagacggggtttcaccgtgttagccaggattgtcttgatctcctgagctcgtgatctgcccgcctcggccttccaaagtgctgggattacaggcgtgagccaccgcacctggacattttttgtagttttagtagagacagggtttcaccatgttagccaggatggtctcgatctcctgacctcgtgatctgcccgcctcggcctcccaaagtgctggaaatgctcgccaccacgcctggctactttttgtatttttagaagagacagggtttcaccatgttggtcaggctagtctcgaactcctgacttcaggtgatccgagggggcttcctttataagcagaattcaccagcagccttggtcttcccacccaaaaggcctgttgctctgccctcccacactccttcaaatggcaatgcagatcaaccagcaaatgcagcctggcaggggtgggggtcaggaacgcatcccagtcaagggacagggaacctgggcaccagacaagaggcgagaaatgtgtgatctagggagaaagagacacaggagccaaggaggaagccgctcgcagtcattctcagcatacatttattgagtgctcactgtgtgccaggaagtaagccaggtgctagaaacggcaaaggagcagggaagaggcgggtcagccgctgggttgaccctggttaatacagggtacggattaacccttcaggctcccttccgagggcctgggcggggtcttggggccgctcctgcccaggtgttctttccagcaatggaaagggattcagcgaggtaagacgcttcccctctcctccattcagagagcggcacacaagaaatctacacagtcttcccaacatgtacacaccctgacatgcccggatgcatctcacacttagataaacacacacgcacacagtcagaggcacggtcccgcagctgtatgaggatgcggtgtacaggtgctgcctacgtgaccgtgccttgagtcgccccactcagcagaaacctcactcagcagaaacttgtccaccagtgattgattatctcgagcagctatttggccaagtcttaccaaaacgtgaaagccacaaaagaaaagtgaacgagagaagagtttcttaaggctttgctcggagagggcttcggagaagggtggggtcagcagatacagaccttactttttttttttttttttttttttttgagacggagtcttgctctgtcgcccaggctggagtgcagtggcacaatctcggctcactgcaagcttcacctcccgggttcatgccattctcctgcctcagcctcccaagtagctgggactacaggtacccaccaccacgcccagctaatttttttttttcgtatttttagtagagatggggtttcactgtgttagccacgttggtctcgatctcctgaccttgtgatccgcccgcctcagcctcccaaagtgctgggattacaggcgtgagccactgcgcccggccctaatttttgtatttttagtagagttgaggtttcaccatgttggtcaggctggtctcaaacccctgacctcaagtgatccaccccgcccccgcttcggcctcccaaagcactgggattacagggatgagccacctcgctgggaccagaccttactttcttgacttggccacaagtctgtcctgctcagagctgctgaaagtggctctcctgttgtatgggcttgggtgtggtgtggtggccctttccctgtcccagctgccttcttcctgggcactgaaaacgatgctaccattgtttttttttttttttttgagacggagtctcgctctgtcgcccaggctggagtgcagtggcgggatctcggctcactgcaagctccgcctcccgggttcacaccattctcctgcctcagcctcccaagtagctgggactacaggcgcccgccactacgcccggctaattttttgtatttttagtagagacggggtttcaccgttttagccgggatggtcttgatctcctgacctcgtgatccgcccgcctcggcctcccaaagtgctgggattacaggcgtgagccaccgcgcccggccaaatgctaccattgttaagtgccaggcgtcccaccatgcgggtcttcactgcgtatccacgtagctgcaccacgcaggcattctttcctcccttttgcagatgatggcaccaaagttcaagactcgcccagggccaccaagacagtcctctagactttggtcttccctccttgcctcctcggcctggggtggtggcgcctcggtctgagaagggtcgaggtctgggtgctgctagtggccctggctcagtctcagagctgcccggagggggtgaggatggctaacttaaggagcacaggcagaggcttcctgctggcaggaagagggctgagctgcggaaggccacccaggtggagtgtgctgcacctccttcagtggccttcaggagctctgtcctcacccagggattggggtgagtcagggcatggggaaacaggctcacagagcccacctgctcaccctgaccaccccaccccaggggaccccaggctcctaactctcagaatcccacagtctgtattggcggaagacgggctggcacccttgagttaggcccccagtcgttggcacagataaggggagctgctgctgaaggagcccgacggctgattctgtggaggcttctcagagctcctggcaggagcccctcaccgcaggaggcccacaacccctcccagctgcatatcggctcacattcacgcggctgccacacaagtgcgtcggaaactccacttggctgaacgtgattgtgctgctgtctgggacagtcttatgcacgtgagcccaatactggatgtcccgccattttcagccctggggcctatggcaaagtgacgcccccctcggagtgcacggcaggcaaggaaggtttaaacggaagttctgaccaggacgatgctgggtgcaagaggggacggggatggagcaaaacagaaaggatccaccagggcctgcaaccacgtctttggccccggtgaggggtgggaccttgtgtataggtccaggcagcagcagctgcagacagaggcctagagggtttggagaaggccgaccacaaagacacgcctagaccccagagtctagtgaggagagggactgggggcagtgtttcggcagcagacccagacccagactcagacccaagcccccctcctcactgatcaaaaccccaagggcagggagcccttcctgctccttcccgccagagcctggaggatgaggggcagacgggaggcccggccactggtgcctgctcctttgatcagctgtagtcccttccccttcacagggcacttgtcttgctggttggggtcaccagggattgctcccccaagtacccatcagcctccagggcccaaatgattccatgcagtagctctctccccctcttctgagaaggctcttggctcccagaaacggaaaccatgcctgggcctgctccccttccttgggctgtgacccccctgccacagaggccccccccccgccacagaggtcccccctgccacagaggtccccctgccacagaggcctggtggcccctgagctgctgctccgagtggaatgtcctggtctagaggcccttggctgctccagtgtcttaagacccatatatgagtgctggctctgaccttgaacaagctcctccatcgctccaggcctcgtttttcaggtgtatatgatgatagtatctctaggcctcgtttttcagttgtaaagcagggatgatcatatgtgtttaactcccagattgttatcaagtcaaggacaacaataggaaaacatgtcacctgtcagctccacacaaggcaaagtaggatgggtgacccctgactagggggtgggagtgcagggggcacccgacccatctggccagccacagcctctgtaccctgctcgcattttcaggcctcaatccccaagcactgttggccctggactgtttccccccctcaattctgtttctcaatgcctgcttcttcccagtaagtgccacaccctgagggtgggtgggagagtgaggcagcactgcccactttggctgggactgggcactgctggggacagcacgggccacgtcttccccatctcaagactggctttttggctaggcattgtgactcacgcctgtaatctcagcactttgggaggctgaggtgggagaattgcttcagcccaggagttccagaccagcctgggcaaaatagcaagaattcatctttatgaaaaagaaaaaaaaaattagccaggcatggtggcacacacttatagtcccagatacttaggaggccgaggtgggaggatcccttgagcccatgagttggaggccgtggtgagctatcagttgcaccactgcactccagcctggatggcagagcaagaccccaactcaaaaaaaaaaaaaaaaaaaaaaaggcggccttttcccagctggcagcaccctggctagttagggtttctccgaatctgcaactcctgtgtgatggcgggtctcaaatgctggcagcagagtcaccggtcagcggcaagacctggagtctccatttggaaccagcacccgggagcctctgctgggggtgatcatggagccgcacgtggaggctggtggctctgatggttcgagccgttcctcggcagcacagcacacccgctcctgaggagccacggagctcatgagcgttggcaaagtgctgtcagtgctggctgtaaggaaacaggcttgacttttaactcagcctttcccaaacttgactataatactttcttgaaaatcagaataaccactaacatcacaaaacgagtgttctcaggagtgggcatgtttatctcgttctctttttttttttctttttgagacggagcctcgctctgttgcccaggctggagtgcaatggtgcgatctcgactcacggcaatctccgtctccccggttcaagcgattctcctgcctcaggctcccgagtagttgggattacaggcgcacgccaccacgcccgattaatgtttatttttagtacagacggggtttctccatgttggtcaggatggtctcgaactcctgacctcaggtgagcctcctgccttggcctcccaaagtgctgggattataggcgtgagccaccacgcccagtctttttttaaatatttgagtgaaataaagcctaggagatatgtgttccaggcgcccaagctgttaatgtggagcttgaatgtggcctggacctgccctttcctcttctcctttcatccccctccctgccgcccacatcctgaactgctctgagcctgcagaagaacccagcgggaatcttcagggttgtggaagggtgtagggatggaaagggaccaggattcgcctgtttggctgggaaaatcggtagaggagggtggctcacacttctaagatgtctgcacaagcccagtttgtttgggggttggggaggaaggtcttttcctggcccactgtccctcccgagtcagcagtcccccagagagacgaagagcagctgggcacggctggagctggtcggtggcagagaatcttgtcctgccttttcttctcaagctcaaaataggcacatgcagctattaactgatatgccagaaggggcatcccttacccggaggaaaatggatttattgctttataaaaaagaagtctaataaaactgaagagaaaataactaaaaatccaaacacaactcacccctctaagcacgcccaggaggtctcaagacacacttctgggggcagtcaaggtgggcgggttggtgggccaggcggacgggcctcccccgtcatcagctccagggccccacggagcccgccggcagggggtgctgtgggcctgtggccttggacaagctcctggccccacgccaggatggctcctgggcactggcccagctgcaggcctggcggctcccgcctggtcagtggggataagggctaactcctagagcccaccccgaccccacacacacctcggacccacccacgtccccaccccggcctggacctccacgtctgccggccacagcctttcgtccacctccacaaaagcagctgtgtgtatgtacggggtgccctggcggcggtcctcaaattcccttcaggtggcagacagaacgagggtgacagtgaaaacgtgtccgcggcattggccctcggggaggaggcgaggggtccacccagcccgctaaaccctctccagggcataagccaggtggggcttctccaccggcctccaacgggtgggcaggccctggacaggcgacagggggctggaattacaaaggaattagcaccgacaacaggaagcgggtccttccttcctcaggcagcctcaggctggccggggagggggtgggggccaggcgcgggcgagacagtgcaagcctttgtcctcaggcaggtacggctgtgggcatgcagccgaggggcaggtggcaggcaggggatggcagccccctctgctttggcaagaggcagaatccagacactggcgggagagcgcctgcctgccgggcgttcctggctcctgctgcaggcaccacagagaccccaggccccgggtccccggggggcggcagagcaaagtcagggcagcccctgcgttcggcaggagaaaacgcgcgtgtccggggccctctcccgtccttccaccacagagctccgaggcagggccccgggagggagcgtgaacgctggcacggagacggcgaaggtcctgggggtgcgtggggtactctggaggggcaggacaggggtcagtcactgaagcacaggcaggagaccgcagttccgaggcggcagccactacacgaaggcctcctggttggacgagccgttgattttgaggaagagtttgtcatcctcctgcctctgctgcagctgccgctccagctggcgccggtagcagatcaggtagagcgggaggcagaagcccagcaggctgagaaggagcagccccacgttcacctggggaggcagggaggccgcgcatcacagggcgtggtggtgcgccgaggctgcagacccgccctccactcgggtttgggaaaggggagaaggtcacggggtggaagggggaacgaaacaggaaggcccacgaggtcccatatgccagcgtcccggttcccaactcttcacaggccatgtggccaccctcagggcctgggcccccaggaaacacgggctgatctgaacctctgggcttggaacaagttcctggtacctggtgaggaaatctggccctcggaggtggggcggggacaggaactgtgttctttttttttttttttttttttttttgagacgaagtctcgcgctgtcgtcattcaggctggagtgcagtggcgcaatctcagctcactgcaatctccgcctcccgggttcaagtgattctcctgtctcagcctcccgagtatctgggattacaggcacctgccaccacacctggctaatttttgtatttttagtagagacctggtttcaccatgttggccaggctggtcttgaactcctgacctcaagtgatgctcccgcctcggcctctcaaagtgctgggattacaggtgtgagccaccgcgcccggcccaggaactctgttctatttctccccaaatcaggtccagagaggacatgttccttttcctgcctagccaccattcacaaagggactcttaaccaatcctaaccaacgctcccacatgtcctcggggccctgaagcccccgagggggaccttgcagctcgcagttagcagaagggggcaggcgcccatgacccaccatcccccgacccctcttacccacagagggtctccctggagaggacccatcatggccagaaacagcggctgctgcagaagggcgaagagcgcgctgatcagagactgcagtcccgtgaggctgccgaactgggtggaggggtacctgcagggcaagcgacagctcacagccatcctgcctcctgggctttgcttggccccaggtgtctggtgaccccgggctgcaccgttggtgccagagaagggtggggtgccagccctcggattccttcctgctgggcagttctgtttttttttttttttttttaagatggagtcttgcactgtcgcctgggctggagtgcaatgacacgatctcggctcactgcaacctccgcctccccagtccaaacaattctcctgcctcagcctccctagtagctgggattacaggcgcccgccaccacatctggctaattttttgtatttttagtagagacggggtttcactacgttggccaggctggtctcaaactcctgaccttgtgatctgcctgcctcggcctcccaaagttctgggattacaggcgtgagccaccgcgcccggccctgctgggtggttctgcaaagtgtttctctttggaccagctccaggccccagactctggggagggcccaccccactcagctgtgcccagggcctgtgggtgtctggctgagccgagtggaaagcgtggtgccagcggggacctgcggtttgggaaacaggcccagagaggagtgtggaggctgggcttggctctgcagtgccctcgtccagagaagcattgagtaatcgcggaaactcagcaccacagatcccgcccccctccctcagaccctgccaggacagccacagcttcctccaggcctggggaggggcaggcggagggcaagcggagctgggattaccccaggggctgttgcgggaattgggagagagttccgggctaaatcttagcacatgtcaggctctgctggcccagaggtgggaaaggaatcccagcaacacatgagctggtcccacatcagagactgtggatgatgatgtttgagtttcagtttttgggtcaaggcctgagccagagaagaaggaaccactgtggttccttttatgtttctggggcttcttggaaaaagatacaggtttcattttagccagggctggagaaagctatggccagagctgggcgcactgaggctctggatgggcccgtctggtgtattctggactcagtcacccatgttgctgcccgtgatgagggcaactggaacttccgcatttagcttcaggcagccagaacctacccatccttcccagtgagcagccagggccagccccaggactcggctgtagtggcccctgaggccataatgagctgcacaggtgcctgaccctggctgggggaactgacttcgtgttgaatgccaaggcttgtgagcacccaactgtctgcccactgacctgcttcccacgaggtatggcctttccctgaaacacccagcagaaaccctggtacctgtcccctgaagcaggaagatgagcccttctgggacaggctgaccctgcctcagagtctcagtcccaccagcaacctccccccggccattcccacaccctcgcccaccaggccacctgcggcttccaggacttacacggcagcgtacaggcccccgacagcggagtggatgaatcctcgcacgattgtgtgcaggatgaaggagaggatctgggggaggaaaaggcgactgtgggcataaggccttaagggaccgtcccctcagcccccgccctccaattcctgggggccctcaccccaggggcagtgtcagcctggagttggatcaaccccatcctccggagccaattgtgaattttcagaaattttgcaagccagtcgttaacacagtcattttttgtttgtttgtttgttttgttttttgttttgtttgagaagaagtcttgctttgtcgcccaggctggagtgcagtggcgtgatcttggctcactgcaagcttcgcctcctggattcaagcaattctcctgcctcagccttcggagtagctaggattacaggcccacgccaccatgcccggctaatttttgtattttttaagcagagatggggtttcaccatgttggcccggctggtctcaaactcatgacgttgtgatccacccgcctcagcctcccaaaatgatgggattacaggcatgagccactgcgcccagcctaaccgagtcattattaaaaattaaattataggctgggcaaggtggctcacgcccgtaatcccagtgctttgggaggccgaggaggtggatcacctgaggtcaggagttcgaaaccagcctggccaacatggcgaaaccctgtctttactaaaaatacaaaaaattagctgggcgtggtggtgggcacctgtaatctcagctgcttgggaagttgaggcaggagaatcgcttgaaccaagaggtggaggttgcagtgagctgagatcacggcattgcactccagcctggtgacaaagtgagactctgtctcaaaaaaaaaaaataataataataataataattaaattataagccgagaatggtggctcacacctgtagtcccagcactttgggaggctgaggtgggtggatcatatgaggtcaggagtttgagatcagcctggccaacacagtgaaaccccatctttactaaaaatacaaaaattagccgggtgtggtggcgggcgcctgtattcccagctactcaggagggtgaggcaggagaatcgcttgaaccggggaggcggaggttgcggtgagccgagatagcaccactgcactccagcctgggtgacagagctagactctgtctcaaaaaaaaaaaaattacataaatttatgactaaataaataaattatattaaagtaaaggtaatgaatactcaaaactctgaaaactcatcacttcctggcctggtgcagtggctcacacctgtaatccccacactctgggaggcctgggaggatcacttgagcccaggagttccagaccagcctgggcaacatgtcaagaccccatctctgcaaaaaaatataaaaattaactgggcttggtggtacgtgcccgtagtcccagctactcaggaggctgaggtgggaggatcacctgagctcgggaagtcaaggctgcagtgagccaagatcccaccactgcactcgagcctggctgatgggagtgagaccctgtctcaaaaaaaaacaaaatgaacgaacaaaaccatggaaaacctcatcccttcctaattattttacttggttcactagagcctgtgcacgcatcaggctttcctttttttttttttggagacagagtcttgctgtgtagcccaggctggaatgcagtggcacggctcactgcaagctccgcctcctggattcaagcaattctcctgcctcagcctccctagtagctgggattacaggtgcatgccaccaagcccggctaatttttgtattttttgtagagacggggtttcactaggctggtctcgaactcctgacctcaggtgatccacccgcgttggcctcccaaagtgctgggattacaggcgtgagccaccgtgcccggccaggcttttcacatctactgtagaaataccacgtgtcactgtgactctccagttccacagtcagtggcaacacatgggcagctggaaatcagccacggtgagtgcatgtgcaccgtggaagtcggcaaacactagaaccagggccctgctgacagacgtgtatgggcacagcactgagcaagaggttgctgaccacggcctcgagctgcctttgcccacctcggactgtgctccagggtctcccaagcctggtcacccggccctcccagcaggtggctgccctctcacctccctcgtgaagtgtttcttcgctttttgttttgttttctttttgtggtttgttctgttttgtttggttttgttttgggacggtctcgctctacaccccaggctggagtgcagtggtgtggtctcggctcactgcaacctctgtctcctgggttcaagcgattgttctccctcagcctcctgagtagctgggattacaggcatgtgccaccaggcccggctaatttttttttttttttttttgagacaaggtctcactccggttgcccaggctggagtgcactggtgcaatctcagttcactgcagcctcaacttcccggggtgcagtgagccgagattctcccacctcagcctcctgagtagctgggactacaggtgcactccacaacacctggctaatttttatttttagtagagacagggtgtcgccatattgcccaggctggtcctagtaaagttctgtcgctgtctgtgggaggccccctgcccaggaaggctgctgctggcggactccgccaactccgagaggcactttttaagagccatcctcttggccaccaggtccctgtggtcgccttgtcttctgtacacagccctgccatcccgctcagcagccaggacctgttcccaggaatgtgggtggtgggggggcaggggctgctcttggcagtgttgaaagagggctgtgcccagtgcccacacacacacacacacacgcacgctgtgcaggcctccccacctcaaatgccttgttgcctttttacaacttttctttcagtgagacctacataaaacaaaaagatgactgtccccactgagcactgcccctcgactggacaaggcggttagggcaaaggtctgccagtcttgcagagaaagcagcccaggaggccagggagggccggagggatgcagcaccccctggggccggcacaaatgttccacggcccgctgcgctctgcacgcccagtgttggcacgtacacacaacagttcccacggtggggcacacctgggtgttcaacgtacctcaaggcctcctgtaaaaagggagggactcttacttccctcctggacttgacccaagatgccatctggactcaggctacacctctctggaaggaaaagccacacttgcgtccctccaccatttgtaaatttagggattgggccaaaacctactgctagaccactttcacagaccagtgggtggagccaggcaggtgacaagggccaccttactcaaaatctctgtcaaaaatcaggttccagaagcctcaaaagtttggcaaagaaattcagtttttttttttttttttgagacacagcctcactctgtcgcccaggctggagtgcagtggcgcaatctcggctcactgcaacctctgccacccggattcaagcaattctcctgcctcagccctcctgagtagctgggattacaggcatgtgccaccacgcccagctaatttttgtaattttagtagagacggggtttcaccattttggataggctagtctcaaactcctgacctcgtgatccacctgcctcagcctcccaaagtgttttggttttttttggtttttttttctgagacagagtctcactctgtcatccaggctggagtgcagtggcgcgatctcagttcactgcaacctccgcctcccaggttcaaatgattctcctgcctcagcctcccgagtagctgggattacaggagtgtgccaccatgcccagctaacttttatattttctgtagagacagggtttcaccaagtcgcccaggctggtctcaaactcctgagctcaagcaatccacctgcctccacctaccaaagtgttgagattacaggcatgagccaccggcctggaatgaagcttttgaatccagatatgaagccaccatcaaggtcttcctccactctgttcagtgtagaaaccccgtgagactctggtgacaggggagcagatgctcccaccaacaccacagattggccagatctctttggacgtcagattccagctgcttgagccgatacaaaacaaggaactctacagcgaccccacacacttccgggaaatggcatgatggtggtatccacggttatgcaagacgcccccaaaaccaagacatgccttccggggaggagtccctttgcagaagacaatccaggtgtccagctcacctgcagcagcaagcacagagcctggcagggaacaggccctccgcaaataacaaagggctggtgggctgctcggttgagtggaatgaatgaaagtcatcatctgagctgggcacggtgcctcacacctgtaaaatcccagcactttgggaggccaaggcgggtggatcgcctgaggtcaggagttcgagactagcctggccaacatggcaaaaccccatctctactgaaaatacaaaaattagctgggcgtgatggtgcgcacctgtaatcccagctactcgggaggctgaggcaggagaatcgcttgaacccaggaggctgaggttgcagtgagccgagatcacaccactgcactccagcctgagcaacagagtttgactctgtctcaaaaaaataaagaaagtcatccgctt

SEQ ID NO: 1275 - DNA, 1775 bp, Homo sapiens
aatgcagggatgggtaagagttaggataccaggtaaagtgtcagaaaagatttagtaattaatattgtttcccaagagttttataaatttaaatacatttaattatgtatatataatcatacatatttatatctaaatatatatgacatgtatccatatataacataagatgcacaatatgtaaatacacatatatgtgcatgtatgtgtacatatgcacatacacacgtttatgtatgtacctgcatgccttgatatatttacagtatgcatatcgtatatacagtatacatatatacatatatgacgtatatatgtacacacaccatatttacttaaagtttgaaacagacaaaatacagttaactttagttagatatgcttgtgtgcggtgggaaaactataaagaaagaagaggtgaaatggtaaacacaaaattcaagcagttgcccttaggcagggagaagggcaggactggtgattcagagggagcacgagaagtggaaaggagcttttaagctggcagatttctttttgaatgtttactttatatgttttaaactagacatgtcttttatactattcttttatgttattctttatattattcactattcacaattaaacaagattaaccttaaaaataattcttatgattttagctgttaaagaaatatacttggttagtttagtgtttcttaaatacatgtagaatagtgttgtgggaagtcagggaccccgaacggagggactgactggagctgcagcagaggaacataaattgtgaagatttcatggacatttatcacttccctaagaatactcttataatttcttatgcctgtcttactttaatctcttaatcctcttatcttcgtaaactgaggatgtacgtcacctcaggaccactataattgtgttaactgtacaaattgattgtaaaacgtgtgtttgaacaatatgaaatcagtgcaccttgaaaaagaacagagtaacagcgatttttaagacagcgataaagtctgactgcctgtggggtcgggcaaaaagagccatatttttcttcttgcagagagcctataaatggacgtgcaagtaggagaggtatcactaaattcttttcctagcaaggaacattaatattaagaccctaggaaaagaattgcattcctcgggggaggtctataagcggccgctctgggagtgtctgtcctatgcggttgagataaggactgagatacgccctggtctcctccagtaccccaccctggtgaatttgaggtcagactggttctctgctctcgaaccctgttttctgttgtttaagatgtttatcaagacagtaggtgcacagctgaacatagacccttaccagtagttctgttttgccttttctcctgtttccccagaagcatgtgatctttgttctcctttttgccctttgaagtatgtgatcttgtgagttactccctgttcttggaccccctccccttttgaaattcttaataaaatttgctggttttgtggctcaggtgggcatcatggtcctaccgatatgtgatgtcacccccggtggcccaactgtaaaattcctctctttgtactctctctcttatttctcagactggttgacatttatggaaaatagaaagaacctacgttgaaatattggggatgggttcccccgatagaatagaagcagcagtttgtaggaagtttcacttgtctttcttttctattggagttaagtcttttttaacttaattctctataat

SEQ ID NO: 1276 - DNA, 1754 bp, Homo sapiens
tgaattttgtatagcaagttatactcattgtgtcagaacaccttataacctggaccccatctgatcttgggttgcctagaatccccagggaccctcattttctgagcccttcacaggacgaaggttctcaccaggtgaagtagaagctgaagacgggctgagtaagctggctctgctgcagcatcccctgcattactgtaggggaattcccctctgccatgtttgggtaggccattcccaggatcccgtcaaagtctgaatagtaaaaggggtcgctgggctcattctcactcaggccaaactcctggttattgacaacgatgttatgaacctatggcaagcagacagtatggcttgacaattcaggtgcacaaattgcatggcttcccagactaatgtgcacagggtatggaatccagaaaccctcctggggagagaacatcagcttctttcatgcagaacccaaccacaagggtgggagtggagggtgaaagagcaacctttctcatcaggtgtgtctcggaaaaaagagtgtggatgttggagaagtggaagaagtttttttctggagttatagtttccacttccatggacagtgaaagaattgaatggtttcatactgaacaatctatgtgcaagaatgattagaggaattgtaggtgtttgaactaaagaaataagaaaatagtaaaaaggcttgtcttcaaatatgcgaagtgcaactgggtggaagaggcaatagacttatctgtgtgtttccagagggcagagttaggaccacacagcaaagctgcaagaagacacaacaactttagcacaacataaaggcttcctgcagtcaggactgctgtggaagcgatttacgtcctgggatgaaggctgaattagtctttgtgttccttccaacactcagcttctgggaagcttggacctaattagtaagcatgggtttctctaatagtgtaagactctagaaaatgggagccaaaccacagaccctcagaggctatgaaaacattacttacagtcacagtgtcatagcccaggaacacactcaggctgccactcccataggatagtccataggtttgtccatcgtttctgaaggtggaggacaggctgggattgaacctgttgtgattggctatagaaagacagaatggaatattcatttcatttgcagttttccaaaacacgtgaaggctacttatccttgatggattgggctcatcagaccaaggctgggatagggcatcaccctagatcttttcttgtagacaaactgtgctagtcctagaaaagtctatgacacactttgcccaaattccttccagctgaccattccctgagagaaagattgcctcagacttaccagaaacactgggccacagaagggcgctcaggggaaggaaaggaagccttagtctgtttctgctgtctgtctccaaaaaagtcagcacttctgaaaagtggtgctgaagtgacagactgagagcaatttctcaatgttccaaacagaaggaggatacgtgatggacaaagaactctggacttagaatgattcacctgcactcaaatcccagctccactcctctatctgctcccctcatggtgtggagggtggtagtgacatactcacagcagacttggctctggcagtagatggagggcagctacagattggaggaacccgtatcaaagaggactaggaaattttggggtggtgtcccagtgctgatctccccaaagtagaa

SEQ ID NO: 1277 - DNA, 5751 bp, Homo sapiens
gactgatcactcattttatttcaccttttagtgagtattcattccaaatgacggtcaagaagatactatttttttttttttactttttatttgggaataattttaaacttataggaaggttgcaagaataagaatagcacaaagctcatatatcccctttacccagatctttttttttttttttttttttttttttgagacagagtctcgctctgttgcccaggctggagtgcagtggtgcaatctcggctcactgcaagctctgcctcccgggttcatgccattctcctgcctcagcctcctgagtagctggtactacaggtgcccgccaccatgcccggctaattttttatatttttagtagagacggggtttcaccatgttagccaggatggtctcgatctcctgaccttgtgatccacccacctcggcctcccagagtgctgggattacaggcatgagccaccgcgcccagtctcctttacccagatctaactcttaatttgttgctccatttggtttctatttccgtttcttcctccccttcccctccgccatcccccccgcacaaatagacaatttttttctgaaccacttgaaggtaagatatatatcataaccttttatgtctaagtaattcactgagtatttccgaggaataagggtaatgtctttcataaccacagtacagctaccaattgcaataaatttttcactgatgtgatgcctttatctaatcagctcttcagattccaggtgacaaaatgtcctttacggcattacttttcccctccagtataggatcttgtctagtgtcgggtgttgcatctgagtgaaaaaattaatgtctataagggtatttcctaaacatgtgattaataatcatactaaagtgtattatgcattacagctttcaaagtgttttcttgtttctttattattaaatatatttatttttcctcatagcaaatacttagaatagtgcttaggttagcatagtaactaatacttagattggttcgtgcatcagaatttctagcaggtctcatctgacccatctgccctttaggattcctcacatggagaagaggcttccatgtcctgagcacttccctagagaagagggggtgaaggagatagggatggaccagtctacctgttgagaaagagacagagaagtgggtctcagtatccgaggttcctgggttgacctgcagacatcacagggccaggtcctttccttcctagcagtgctatttgtcaagacccctgtctgtctcccctgacagaaacattgcggtggtgggggttgtgggggtgcatccagcatgaattctccttatcgttttgactcttcctgttcccgcctggctctcattgaacccacttaatcttcttcctgatgagttggcccaggcaggcccagctttccctttaacaatttgtcatcttatacatcaccagattccaaactctctcaattctagcaattctgctttaggataagaaaaaagcgtgtattacttttgcaaacaggtgcaaagtaaattggtaatcgtactgaagtacattatgcattgcagttttttaaagcattttcttgtttattgtagttatctggcctcataacacacacttgaggtagatgtggcacatgtgatctccattttgtccacagaggaactgtggtttaggaggtggcccctcaccaaagctcacacctgtcttctctgattttgcatcttatgctatttccacagggctgtgcttcctaatcagtttgttaataaaactcagtattgtgcatttggtaggaattggtttatacaccattcaagaatagtaaacatttacaccctagatttttaatgatctgagacagcaccgaagtatataaaaaagttaggctcctgagcacttaattcttcaaggaaggggatggaggaaaatctctatctgcagagataatagcagcttaagggtatcttaaatgggatgcttctcaggactcttggagacttagagctagtggtgtttaataaccacagtttacatcactcagagtcatggaatagttctattgcataaacagagcattttatggaaacttagaaaccctcactgctgcaggacaaatgctgtacaaaatcgaagatgccaattgtctagattattttcccctaacaattttgtatgaaaaatttcaaacatacagaaaagtgaagatcattgtacagtgaacagctttattcccacctcttccactcccacctgtactctcaccacccccctacccccacatctagattatgcagttgtaacatttttctacgttagttttttgggtttttttgagacggagtctcactctgtcacccaggctagagtacagtggggtggtctcggcacactgcaacctccgcctccagggttcaagtgattctcctgcttcagcctcccaagtagctggaactacaggcgcccgccaccacaccctgataatttttgcatttttagtagagacagggtttcaccatgttgaccaggctggtctcaaactcctgacctcaagtaatcctcctgcttcggcctccaaaagtgctgggattacaggcgtgagccaccacgcctggcctctacattagttttatcacataaatccaggctatttttgatatactttgttaataaaatcattaagcatctttgatgttttggatggaaggcaccctacagtctcttggtggctgagtttccttttatttttcagaatccctttgaaccccggcaacatgggacagagctgagagcaagggccttgattctcatactcaagcctcccgacagcccgctgcatgcgccaggcttcacgttgtactcgtttgtccagataccatgaaaaccctggtcgggtgtggtggctcacgcctgtaatcccagcactttgggaggccgaggcgggcggatcacgaggtcaggagatcaagaccatcctggctaacacagtgaaaccccgtctctagtaaaaatacaaaaaaattagctgggcatggtggccggtgcctgtagtcccagctactcggggggctgaggcaggagaatggcatgaacctgggaagtggagcttgcagtgagccaagatcgcgccactgcactccagcctgggagacagagtgagagtctatctcaaaaaaaaaagaaaaaagaagaaaaccttgataaatattagtatggggatacattgtcccctcccccctttttctctcagttaaaaatctgtcccagaatgaggtttggcgggacatatggtttggcgtgcttgtgggggctggcagggtgaggtatgtatggtagtgtagttatctggcatcttatctgctcactggaaatgttgggcactgaatagattagtcagagtttccagaaatagaaaataaagccatataataaatgcagaagtcccctagttaatgtcagctgttgtgtgatatctgccctaagtcattttattgcctttgtaagattcttaaactgtttatcattatccctgccttttttaaaaatggaagcaacatcttcctaaagaggttgttatgagacattagaaggcctgctttcatgcctaatagttatcaaaactgaaattcagtatagcagtgttgaaggtgaaagaaggtttgggtacttttaggtagcaagagagataattataagctttcaacccaaggtcaagataaatataaatctggaggaggaaaaaaaaaaaagaagtctagcttctcattagtaggacagcgttctcattttataagaccttaatacccaataggaaatggccgtcaattctgttcatttcatattctcacagcctgtctctcaggtgggagaacacagctaattcttagggtaagtgtcctcttttagaataaaaccttaccaaaggagagctgaaatgggttgtcccccaaggctgggagatgtgtttggttccctttgcctcacttcgacctttctgaaatcaagaaacaaacaaaatgaaatcgacttgtgaaaggatgtcaaaacgacatggcaaattcagttggtttgttcagaattttcttcctgtatttcctttttgaagttacaacagtcattcaggagcacgtccagaggagaagagctgggagggaggacgggtggcttctagagtcaaggctgggtttgcctaaccctgaccctcacgggggtgatgcggatgttccgaagaatgcattagcctttgactttaaggaccgcgaggagagttttcttccgaatcaagtgaatgcgggtgcatcaccctgtcttcctcattccctgtgtcagggaatgcatcggtagcctaaatgactttccctggaactgaagcatgtgttggctctactgtggtgctttaatgtttcctgaaatcctccatttggaggatagagtgcccaggagtgagagaatactgtgttattagaatgcttgttaagagggaaaaagaaaatagagcattaacagacaggcaatgttccattcccccgaggaagatttatgtgacctagatgaacggaactacaaatcttggagggacaagagacttcagaaatggcaagttcttagtttgggaggctaggtattgaagtttatccaaattaatttggaagtttagatcagttgcaatcaaaatccttatttgattgacagtggggatggataaaatggagtttggatttgaaaatctacataggaggaggaagtaatagtatatctattttattatacgtgtgtgtgtgtataactataacaattagaatatcataacactgttaatagaccataaagtgacaaactaccccaaaacaaatcccattttcacataaaaatttaatatatgataaaaaagccttcacaaatcaaaggggaatgaaaggcaagattattcatcagatagttaggtcttcatcttacaccggaataaattcaattgaactgaagagttaaatatgtattacaaaaaaaaaagccagcagaaaaatcaatagatcatatcaatcactcctctagaaatggacattatgaaaagtagatgtcagtatggaaaaatacttttactaccaagtgatataaaatgtggattgaagaaaaaaggtgaaatgactggcatgctttattgccagttggtttagggggtcaggtgtagatatttttgttacttgttttccaagatctgtgatgtggttggagtaattcaagagaaatgtatttataatatgcatgctttaaggtacgtctattcctacttttaaaagtggcagatttgtgttttttaatgcataaattagttgaatgttcatccatccaaagagggatttcttctgatagattggggtgattagctgaaagactcagttcctggagaagagaacactagtggaaaatgcccaactgttaggggaatgaggaacaacagtgctgttcactgcattcctaacgccggcttatcagagttttgttttctgtttcatacacttaggaaagtattgttgccacaaagtgcatctctgcctgttagaaggatccagacatagcgtagacggattgtgcaatggagtcagaaataggctgtcctgctcccagtgagtgacttccccaccccttcatcctccttgtaaatcaccggcattcctgatcactttccgtggttccagctaggttaacaacagaagggatcatttccctcataac

SEQ ID NO: 1278 - DNA, 13510 bp, Homo sapiens
gaacagtgtgaactagactgacttttcccactgagatttactgataggcaaacttttgtgcacattgtggacactggttgagggtaggctcactagttttggtactattaatggtcagttgcctgtagaacttgtgaagtaagaaaaggtatatctatagcaagttcaaggttcagataattgttgttctctcttaagaaaaaggttttgagcggttgtcttctttacacttagtgtatgtaatgatagtttggctaaatatgaagaagaaagagaaatagcattactactgtttattaataacttttctttgtgccacacatttagctattcaggcactttgtgtttgtgtgtatacatatacattctcttatatacatttgcgacatgtggtaaaaggccctactttttggagtcagaaattgtgctcatttctgtatctgccaccttgtagctgttggctcttgaacaacaactaagcctctactttgaacatcaattttctcagtaaaatgagggaactagactaaatagttgccaaaattcttagtccacacacacacacacacacacacacccattttgtacttctaaagacactggaaagaagtttacggatggaggaggagccaagatggccgaataggaacagctccggtctacagctcccagcgtgagcgacgcagaagacgggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcagagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaatagataaaaccacaaagatggggaaaaaacagaacagaaaaactggaaactctaaaacgcagagcgcctctcctcctccaaaggaacgcagttcctcaccagcaacagaacaaagctggatggagaatgattttgacaagctgagagaagaaggcttcagacgatcaaattactctgagctacgggataacattcaaaccaaaggcaaagaagttgaaaactttgaaaaaaatttagaagaatgtataactagaataaccaatacagagaagtgcttaaaggagctgatggagctgaaaaccaaggctcgagaactaagtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacaccacaaagatactcctcgagaagagcaactccaagacacataattgtcagattcaccaaagttgaaatgaaggaaaaaatgttaagggcaaccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctcagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatattctttgaaaccaacgagaacaaagacaccacataccagaatctctgggatgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaactcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagacatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacatatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatctctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaagaagtttacggataaaagaatgagaagtagactgacattgtacttttcattaacgtgttgaatgcctaaagaatggaaggaaaataagcttaaaattttgaatctatgataaagaaaactattgattaaccatatgcatatttgacattaaaataattcataattaggactaacagatttctggcttaaaaaatctaacaattactttaagaagcaaaagacatttccagaataaagtagggggatatatagaaaagttggtaccttttttaaacagagtcttcttttgtaaggaagtagaatttattcatcaaaggagatttatgaaaagtatggtggtatagtgagtggcctcactagttttaatgattgatatttgaatatagcttagtcttataacaactccccaaataaaaatttaaaattcatttgtatccctttgattttcagtgctaaaaactagattgtgaatgtcaaggaaatatttaagttatttctgaactaatgtatttgtagagagaagaagggagtgtgcacgtgatcgagaattatgttttgaaaataaatgaatgattggctattaaaaaaatttttaagccttaaaaaaaaaaaaaaaagacactgtataaatgttagttgtttgagcatttttgtatatacgtgtatgtccacacacatatacacaacattttaaaataacatcagttattttccctcttttatgtttttattttcctaataattcataccagtgatgtaagatagtggtacccagaccccataatctaagaggaatttgttgccatttgaacaaggaatgtgttgcctcattcatattttcaaaaggatataaatacattgttgtatatctttaggggaaatatatattcagtattttaaccagagttctcactgctgtgttcccacattgttaatatcaggtagtttgcctagatgttcacagtagaagtacagggatgtagaaacatggtctttcttcccaaagaagtcatttttctttaaaatttgtgaaataaatgaattaattgagtcagcctttaacatagtaatccattttgcattattcagctttgattgaaagagacagagaaaatatgttttgtcggggggtggggagaatgggagatagagatttctcagaattaacagggtgctctatagctcaataagaggccctgtatatacagcaggatagatttgtagttagttaaggaaatcttaagtctaaaggttgtaattcccttagaattcctgtaagttaattgtttttcccccactgtaatgcatacccttgaaaggcaggaaccttctgtttatcattgtatcccaagggcctatcataagcacctggtaaccaataaatgttgaactgatatatgaaattttcctgatcttagagattaagtattatcctcatggtctaggggaataaaacatccacacgtccaaaccatagtaattctgtttccatattctgctatctatgggtttcattattttaagtattctaaacttacagagagcaagactaatactttaaaattttattttggtctatagggaaaaaaaaaggttatttgagtttggtgactgtgtccatcactttggtttaccactgaattcacagcagatactaagaagtatctgcattgttttgtttggtttggttgggtttttaaaacagggtcttgctgtgtcacccaggctggagtgcagtggcatgatcatagcccactgcaacctcaaacccagagtgaatggatcttcctgcctcagcctcccaagaagctgggacttcaggaatgcaccatttgtgcctggctaatttttatttttttattttttgtagacatgggatctcactgtattgcccaggctggtcttgaactcttagcctcaggtgaccctcctgcctctgtctcctgagtagctgcaatcacttaatcctttaatagtcccaccaatctattattatctctgtttgacaacttatgaaactgaggtcagatagggcaaatgcagtcatgcaccatataacaacgtgtcagtcaacaacagaccacatatatagtggagatccaataaattataataacatatttttacagtacttttctgtatttagacacacaaatacttgccattatgttacagtactgtactacataggcaactatgctattcagtacagtaacatgctgtagaggtttgtagcctaggagcaataggctataccatagagcctaggtgtatagcagactgtacaatctaggtttttgtaagtatactctatgaagtttgcacagcaacgagatcacttaacaatacatttctcagaacgtatgcccattgttaagcaaagcgagactgtaattgacctaaggtcacacagttaacaagtagtgaggttttaaactaaggcctttgaccagtgctcttgatcattacagagtggtaccaacatggtagcataagctttaagaggagggaaaacttggttcccgtggctttatcagggaagacttcttagaggaggtagcagttaagctagcccttaaagaataagtcttatcttgaactgaatgtatgctagagtcagaattatagaggattagattcagaataaaaggccatctgtttcaagttcctaatttgcagaggagaaaactgggatctgtgaggttaaataacttgttgtaggacatatggctaattaagtggcattagaactgttctcttccctcctctatcctgtgttattccctgtccccctccgttaatgcacactagctcatgttaagtctgttttttcatcaacactttctaataagagttcctaaaaacattttacagcttgaaagtggaggctttcttgtgtatctatgtatggtgatgaggttaaaccaggaaagggtcagggcaggcatggaaggagatactagagatacgtggagacatggagagacagaccttttctatctgttttttgtttttttttcctagcattttactttattgttacatctgtttccttccataagtatagataattgagtgttgagagaaaggggacaaatgaaattctaatgagaaaaaaatgatttaaaattccacaaaatctatggaatttcagcctcttaagtaacctgggatgtttttaactttcactaatgtttattagccagtgtccttcctgccacccacctacaaggatgtctcaaggatgaaatgaggtcatatatgtgaatacacacttaggatacaactgccatgtattggcagtcttgtctgttccctgggcctacactgttccttgcctcaaaatgtagtactatcaggtagtgttgatgtttcattagccaagtggttatatcagatttatgtactgctaaacaattgatctgggacttgggtaaatactcattggaaaaacatttgttgtattctgagtgctccctgttaatcttctcctcctcagatagcaagctagatctgggacttaaggtggatttttttccttatttttttttcctttgttttacccaatgattgaaaatataaaactaaacctttttcagtaaagtctgaatcagcagatacttacattactttggcataggctttttatagactagctagaagaatacagtaattagcatatgcatttcctcattaaaatgtcattagtgaaggctttgttcttttaaggtccttcaaataaggtttattgcattgcattccatcactaatattttaccaggagtcagatatcttacttaggtgtgttgaagcaagggttactttggactttctatagggtaatgacctaagagcagacctggacacacataaatctctatgcttacattgggtgggccctactttatgtactagtaataattaccagtctcttctcacactgtccattcagaatcctttggatatatagacatttagcaaacctagacttgtttgaaagaataaactgttatctgcactaaactgttttccttggttatcttggtaggatttgatttgaaaaaaatgtatgaagaattagaagaaaagaaatttataatgtactataatcatttgagatacagtattatgcaggagtaagaatacaggctttagaatcagaccattgaggattcaaattcttgcttcatcatttactggttgtgtaactttgtgatacttagcctttataaacctcaattgtctgaatgtaatacggaaatatgagtggtccataccttataggaatgtttgagaattcagttagattatgcatgtaaagtatttagcactgctgcctggaatatatgatctattattacattaccggctgggcatggtggctcacgcctgtattcccagcactttgggaggccgaggagggtggatcacctgagctcaagggtttgagaccagcctgaccaacatggtgaaaccccatctctactaaatataaaaaattagccgggcatggtggtgcatgcctgtaatcccagatacttgggaggctgaggcaggagaatcgcttgaacccaggaggcagaggttgtagggagtcgagattgcgccattgcactccagcctgggcaacaagagtgaaactccatctcaaaaaaaaaaaaaaaaaaaaaaaccaacaaaaaattatctttataatagaaaaaaggagtgtgtgtattttcatatgtattgtatctgctttctacacatctttgacttaagaaatcctaacatgaaatttcaaaacaagtaagaaggtatttaaggagtggtcattaatatcattaattggcttaaggcaaactttctttaaaaagtcacacacatggtgtattcaaaataaactacttcacttaatcattttaacatttctgctatgcagcgtgactagcaacttgaaggagcaagttaggaaatgcctttgatgaccccatgacatcactatgttattaaataactggaaataaactgaaaattatgggatagtctttaaggctttcatgacatttcagcattttagggttgcagtattccaaggacttttagagtaattgcatgtcatcctttgtgtgttgtgggcaaatttgggttagctaaaagttggtcagttaaaaaaaatttatattaagcatctactctgagccaggcattgttcttttttgctgtgaatatagtgctgaacaagaacagaagccttgctgtcaaagacgtaacattccagggtaagaaaatagataactcataaagaaggaaatgattaattcagatacttgtgaggctatggagaagataacctaggctaacgtgatagagatgggtggtgaggatgtgagttaaggggaggccttttgcaggttgttgggaggagatgcaagtgttccaagcagaagaaagaagaagtacaaagtccctgatacactaacaatcttggtgtgttcaagggacaggaaaaaggccggtgtggctggaatttggtgttcaaagcaagagaggagagataaaggaagatgagtcatgcagagccttttgaaggctgtgggtaaaatgtatgttatacggaacttagttctaaatctagttgcagtggattaacctggagagtgatgcaaactgagttttactctggaaaaacactgtgactgttgtgtggagaatatgctcccaagtgtagaaactagatcaccttgcatgggccaagagagatggtggtagtttaagactaggattgtagcagtgaaatgtaaagtggttgcattcggacatattttggatagagatttgacaggaggtaggtggattggacatgggatgtaaagtaaaaagaggaagcaaggatgacttccaggagtttagcttgagcagctggatggctgatatcatgtgtaggcatagggaaaggttgtatgaggaagaatttatagggtgtgagggtgtgaagcagggaataattttgttttgacatgttatgaaagaaatgccaattgacggctaagaaaagatgtcatctgggcaggtaaagaatctaggagattgggaaaatgtccagcgtggaggtataaatgtgaaaaccatcagcatatgggattgaaagctatggggctgtttggattccctaggaagagaatataaataaagaagggggctgagaacagagtctcatttataatatcctgataaggaagaagacccagtgaaggagatgaagaaggagaagccagtgatgtaacacaagcatggatcatggcaaaagagaaaaaggtgtttcataaacaaggatgcttggtatggccacctgtgtcagtactgtgaagttgaatatgatcaggacaaataatattaattggggctttatatttctcctttactacaaccgattaatgaaacaaaaaattaacctagcacccaaggtgtttcttatagttggtctctccagtctgttttagtatcatttgttagttatttccccaaactaatgtttagcttctttctccaaaaagaatatattttttttcctggttctgcttgttggaatccccccctccaccatgatataaaagtaatggggcttattgtaagaaaacagaaaatacaagaaaataagggacaagatttttaaaaatggattcaattctgggaacaacaaatgacattggggtataggaattaaaccgtgtgcattctgtctctcaccccaattttatagtcatttgctggggaccttttctccccagggtacttgcatagcttttgtcaagaataacccttctcacttccccacctccttcttctacatgcagatgcagcacttttctgggtaa

SEQ ID NO: 1279 - DNA, 78395 bp, Homo sapiens
tcacgacaagcatatgaattagcagtttttccaacctaaagagaattatctactgtctctagatgattctcaaaatatgctgatagcaatttgaagcattataaatctatccaggttggttctgaccatgttgtagaagtaatttcaactggcacgtcacatgaaggaacagatttgaaaacagtggtatgcatgcccctgaaggtttcatcttggctaatggtctcaccaccttatggcactactttggattgtgacaacggtaccaaagaaaatgtctatagtctggaaaagatttatcactaagtatgactgtctatcactctggatgtacccccttgttataaatctccagcaagactgatcacttggtatacgtaagcatgtaggtacatgcatgtacaagtcaggagtgtgctgtgtacttgtctagtatcacttggtgtattagtatatatatatatatgtgtgtgtgtgtatttatgtatgtataataactcatagcaaatgtgtggacatagatgagaatataggttattagtttggagaaagacttaccagtttgtggacattgtatatacagaaattctcaagatttctcacatgatgtgtgtgcatgtgggcttgtacatgtgtgtaggtgtgcattccgacagtgtcttccatgagcgatgtagggtattattgacttgaggaagcaatcactgcttacatgaggaggcgtgtcatcttgaccagcatttaatgggaggggaaagcctaactccgtaaaaacgcaactgttaaatcttaactgccttagcctttcattctgagctgagacgttatactaaaatttctaaagcagagacattgttatttttcacgtattatgctaataaaaatagtgactggtgtgacttagtgattggagaaaaggggcttaggactgtaaatattggtagactttcctttcggtacacctttataagttatccatttaatcttaaaggaaattcaaatgccaattcaactgggaaatcaaactctgatgcaggcaactcagggacctgttctctgacccacgcacttgaacagtgttcacagtgagaacagttgagtgcatttagaagctagatccacttcaagaagttagcagtaggaagcatttcttttcctgttggctgggatgtagaggggtgttagaactttttccctctacttttgcaagtatgttttagggaactttataattagcttttgtgcatattttaattatttttgcccatcatcaggtgggattaattttgactgagagcaacagtgtagtggttggtttgtctcatgtaaaaggaaggctgggcctaggctgcagctcagtgatgctactaggaactgaagcacttcctattactgctctacctcttccccatgtagaatgcagtcattacttatgttgcctcacagtcataagttgaacttcagatttcatatcttaaatctggaaagtacaaaaggctctgtcttaggagggtttgtcttttatttatttatttatttatttatttatttatttatttatttatttcaaacagagtctctatcgcccaggctggagtgcagcagtgcaatcacggctcactgcacccttgatcttctgggcttgattgagcctcccacatctgcctccagagtagctgaaactataggcatgcaccaccacacccggctaatttttgtatgctttgtagagacgggtttcgccatgtctctcaggctggtctgaaactcaggctcaagtgatccgccctcctcagcctccaaaagtgccaggattacaagcgtgagccactgcgcctggctgggtttacctttttattcaggtaaggacagtctcttctgggatttgtagcaatcattggccagaactatatcaaatagtcatcccctacatatgaaggaactaaggaaataaattattattattattattgttattattattattattattattatgtttgagatggagtttcactcttgtcacccaggctggagtgcagtggtgcgatcttggctcactgcaacctctgcctcccaggttcaagtgattttcctgcctcagcctcccaagtagctgggattataggcacccaccaccatgcctggctaattttttgtatttttagtagaaatggggtttcaccatgttgggcaggctggtctcgaactcctgacctcaggtgatccgcccgccttggcctcccagagtgctgggattacaggcacgagccaccgcacccagccagaaatcaattatttttaattaaacatatcactgccctgaaaaaaaaatgggattctccttaaaaaggaagaagggagacgtgtacctgtaaaagagcactgctggatgatatattcccctggcctctgaaaatgcacagtggtcaggccaaccggctcatttctattgcatgatatgcacaaatcaccattgaacttcaaaaaaatcctaaaagagcaagtctcaagacaggtaaatccacagccacaattactactaaatgagaacttttagtttggaaacaagcacctagagaatgccaaaaagtcaatgttcctgcagatactagaagggcacagcataggtaaacacactttatcaagtactgtgatactgggatgttgaagcttgcctggtcacatttaaaaaaaaaagtgtcattttaatcagaaaagttttaacataacatacagtcaacttataaaattcattacaccaaaaataatatagatactacatataattagagtcagatattttcacagtgttaatggatgattccaatcctcagtcaacagacagttattgggaacctactatgtgctcacagaccataggggaatatagactatctgaacagataactatgacaacatggcaggtactaaactgggatatgaacgaggtggttttgggaaacaggacaaaacagccaacgctgccaaggattgttgatgaaggagtttaaactctttccttttttttttccttttttcttttttttttttttttgagacagtcttgctctgtgagcgatctcagctcactgcacctccacctcgtgggttcaagcaattcttctgccttagcctcccaagtagctggtatcacaggcacccactaccatgcccagctaatttttgtactttcagtggagttgaggtttcaccatggtggccagactggtcttgaactcctgacctcaagtgatccacctgcctcggcctcccaaagtgctgggattacaggtgtgagccaccatgccccgccaaactctttcctttggtgtttatatcctagaagataaatttggccttcaacaaactatcccttgataaccttaccagaatacctgggagcagaccagggtagaagttcttatatagtcttatgttcttatttttagcttccaggaaattcaagtttgggaaagtaaagaatgcctggattgatactaagagaataagtgaactccaggtctcaaaattttgctaagtaaatccttgtcaaggatcttcgtagagcaaggaatctaagatgatttatgcatctgtagaataacaccataatgaagctgttaacctagccaaaagctttggtggacatgacaccttaaaggtggccattataaagtgagagcctctgacagctttttcatggttttagataagtgggtgtttgaaatcattctggcagctcaccaaatgtttctttgcatcttgactactggatgaatcttgactacaagtacagattttatgtatacttattaaaataatataatttggctgggcgcagtggatcacacttgtaatcccagcactttgggaggctgaggtgggtggatcatggggtcaggagttcaagaccagcctgaacaacatggtgaaaccctatctctactagaaatacaaaaattagctggccatgctggcgtgcgcctgtaatcccagctattcgggaggctgaggcgggagaatcgcttgaacccgggggtcagaggtcgcaggagccgagattgcaccactgcactgcagtctgggcgacagagtgagactccatcccaaaaaattaaaaaataataaataataatataatgtatgtcccagccaccccatgccctgtctggcactactgccagcactggggaactgggaggagagctgaggaacagctccccttgtaggctcctttgtcttcattgattgacatatccaaggagtcctgttcccagcagtggttccaatatgagcaaaagcaaatctttgctcatcttcaaatagccttgtgtatttaagtaaccagaatgttccacatttctgaaatgactatctcacctatctagaatataagttattctaggcaggtggcacctgtgtcttattcctctatcctaaaacagaggagggattcagtaaatgattgctgaaggggtctacattagagccaaaggtggtctgagcaatccagcctgttttagggacctgggtgaaaagtcctggggagtcagaagctctgtgaaaacaagtagagggaaacagaaaagacaacaaaggggtgacaatgtttcctactttccatttgacaaagaacctgggtgtattgtagttaatatccctggggggttatcctgagagatgacatagaagcttgttgtttttggtataaacccgcaatgtcttcttatcttcattcccctttctcattcctccttagagttacctaagcacaatttcttttcttgttttgttttgttttgttttgtttttttgagacagggtctcactttgtcacccaggctggagggcagtggcgtgatctcagtttactgcagcctctacctcctgagctcaagcaatcctcctactcagcctcaagtagctgggactacaggtatataccaccatgcccagctaatttttgtgttttttgtagagacgggatttcaccatgttgcccaggctggtcttgaactcctaggctcaagcaatatgcccgcctcggcctcccaaagcgctgggattacaggcatgagccaccatgcctggcctctctttaaacactttttgcttacacactgcttttggaatgaaaagaacaaggagacttcagtcatatcctcctggatttgaatgctaaggagctgcgtaacatttctgaaatcttcccatgtttattaataagagaataattctacctaccttgtagggttaaaggttgagtacgatagcatggaagaatttgcccagcacctagtaggctgtcagcgcctgttacctttcctttccccaatgctccctaaagctaagttcattggcccatcatgtagagtaatgggtccacaggcggtgaattacttgtgatgctcttccaaggactgaatgaggagagacattttaatcaaagcaccagcaaagcttttgtagcgatgaacatacaattagtgaccttctcctatcagggataatcagcagtgggactggcagaattggaatttttttacatgggtgatctgggcacagatactcagtcagctctgtgtcgcttagaactgggaggcaggaggcatttgcaggttggtcacaaactgggtatcagacatattaagcctgcattcatctgacaggcctccagaacgtgatgtcaggagagacgtttagcagtggggagacaattatgagactctcagaggtgagaaagaggattctgctcactgcctagaaagagagaatatggcattggaaagggggtggtaaaatatgttgcctgacacacaccgaaaaggcctgtcagttactgaggtcccatcgccgtctcaggcttagactgcatgagaggatctatttaggggaaaaaatgtatagcttagccccagtggctgctggggtgaatctccagggctcaaagcacgagttacagtttgtctttagtttacttaataagcttcctggactgtctgatttctttacagcctggaacagagggtaacaagtctcccagtgcagtggatccaaagttggtgggcttcagtttgggagcaaagagctcactgtttgggactgggttgatgtcatcattttatgacagcatattaacacagagtaaatagtttattccccagggtactcacccattccctcagaggtgagtgtcaactccttcgagagaggtctgctcacctaacctgccaattctcaaagagccccacctcaggcattctcatagcctttctctggccttcgtaggtctttgtcccattccccgatgataatgccttcatgacaaagatgaaatgaaggttgggggcagcctaggctgtagtcctggtgctgcaccactagccgtagagccttggccaagtcatgcccctctctgattttttcattatgtcaactggaaaatatagtcagactgcctgccctgcttgcctaacagcacagtctgaagcatgagctgatggaatacatgtgtaagcatattgcatagtttgaggaagtattcatgtatacagtggtgatattagacttaagattttcattttttcatgaaattgaaactagaccatctgaagtcattgaaataggaaaaacacatacagtattttaaattagttctactcatgcagacaaaaaaaaagtgtcctggtacatcgttgtttaagatctggtgatctgtagtgtttgtctaccaagtggctaccgtaagtggcctccacttgataagttgtaacaagatcacagcaaccccaacatctctgccactttctctttctctcttctgttttgggtggagagacatctatattgtggctgtctcagagttacggggagagcaagtcaacggtaacagggaaaaacaagccttgtgtgggttggaccagaccatttgtaaggctcttggggcatttgtgtgcacgcacacacagacgttaaccagtccagaaatgagtgtcattctcctcacacagcgccgacagctgagttcttccctgatatttgcagacctctctgaagcttgactttgaaatcctcttttccttgaaccctacgtgtgagagagaagcccttctttgccactcaagagtggttctgtggtaacagtggctctgtggatcttttgtccctggctggctccttcatatgttattgtaaggttttagtttgtgctggcatgcaggtgtgtttttttctcactcagattttctcttagatgctgtaatacaatctataatttttggtacaggagcaagtttttacaaaggaagatatgtgcaatttgtcattttccagcctgatgacatataattaaaccttcaatagtctatgccttcaatagcataactacaacaacccatcacactttggaaataaatttgtttcatattttatattatctggactctctttgtccagtgtgtaacaggcccccaggaaacaggaagtcccccactagtgagcacccctaatgtgaatgactgcacactcagcctattttggtgagaacaggcagcttgctttcggtgggctcttttgaatgggccttgcccaagctcaatgctctctctctcctcttggcttgtggcacctggccacagtagcaggcattgcctgcttgaaaagaggctgtccttggattttcctgcctcttggaacacagagcttaattcagttccctaactccgggaagaagcaatgatcttcagccctatgaacctgtccggcaacccacagcggcccacaaaatatgttctctcgcctacaacctcatcccagctgctaccacagccctgccgacgcagcgcctgctgcggtcacggtccactcccaagggacactgccttatgtcagcaggccctgtcttgattcccaggtgctgggaagacatgattgcagcctcctgcacccctgctcccctcctctgacacacacactctgagcctgcaaggtacagcagcccactaaagctctagttaaaagtaccaagttgctggaatgcccagggaagtgagaatgagcgggtctcacacagggatgatttgaaacaagccttgtggctttttaataatgtgccaaagcggtctcagtggtgggccagcagggcccccagtctatcttctgtgaaaggagaaagcccagcaggccctgccgaatgcagacagcccctccactctgctggaggagacagactccgagatggcaatcaaggcttgatttgccaacacatttccaatgattaaaatgtaattagcacaactgagtgcctcctccccagctaattttaatacatgctgtgacaggcaggcagccggctgtgcctttagcccagcagcagatggaggcagaggcagcgggagaggaaaaccattttgcaatgtgactattcgcatcacaaaaccatcagggcgctcagctcttagaaggcccttgatggcagcacatcaaattggcgctgtcatagctgaccgtggcaatggcagtcatccttcatactgtcccagaagcacagcgaggcaatttccaggcgtaaccctttaagatctagaaggggagagagagacttggagagcacacttgtcgtcttgcagtgacaggcgagagctttgcaatgtgcgctgtgaaacccacgctcttggcagcttgcaaaccgttacttacatgttccttttccaaggcacagtggagtgtggttcagaagctttggaaatagctgtttctccaaatgggagacaggcgtgagctgccttctgtgtgcattatctgaactgggaaggatgagcttttcagcctgagatggtatggcaggttggaggtttcctcttctattccattcatcccatagaagcctttgagcctggggcctctcatcatgaccatctgcttttctcctatcctgaagggcatgtcagacaagctgcaaagtccagaagaccgtttgcctatgctcctgttctctcacctcctggcagaaacactgggccctcaccactgttgtttggcctgccctctccttccaaggcaccacctgaaaaggaggcaagctccttggaggctaaggatcatttggacctccctgggattggggtgcacaggataatcacagggggcacttgtgatctttgggatctgtcacccaggcttggtggctaactttctgtgtgtgtgtgtgtgtgtgtgtgtgtgtgtgtgtgtctgtgtgtgtagacggggtcttaccatgttgccccagctgatcttgaactccagggcttaagggatcctcccacctcggcctctcaaagtgctgggattacaggcatgagccactatgcatggcctggtggctgactgtcatagaacaccaaagctagacaagcctaaataataacagtgacgatgctaagcatgtattgggcatttaccatggctgagaactatgttaaatctcttaaatgcattaattttctcacttcatacccacacaaacctaggggctccatattattattcccattttacggatgaggaagcaaagtcacagtaaggtgcagccactttcccagcttctgctgttaagtggcagaacccaaatccaaatacgtatctttctaacttgtgagtgggacaaaaaagtcatagctgagacatgctgcaccacagagatgcttcaccagtggaagcctctgagcagagaaatccgatctgaaaacaatgggattattctttgccatctaatggcctctgaagatcagcagccatgggaacctccagaactccatcacacgggtgacgtttacatgccgttgtgcatgtgtatctttttctcctctaaccgaaaaataatatgtaatcgttaaagatcaaaaacgacagtaaatgtaaagatgaaaataaaagtgacccaaactctttatcactcagaaataaacagtgtttggtgcatttttttccagtgttttttttttctttctgtgtgtatgcttagcaattttaaagtaatattgtatatataactctatgtatcttgtttccttcattgtagtagtaataataaaagtagcagtttttaatgtattttctccttactgctaccttgagaggtagttactatcacccccgttttattgattaaaaaaagaaattgaacctgtgggagggtatgtgactcacccaaggtcacttcagttaggttggtgaaaagtaattccagtttttgccattacttttgcaccaacctaatatgattttttttaaacttccctatgactgtgatcacttttccatttcagcaaaattctttatgaactttaatttaatgagtgaacacaaccctggcaccttgacctgttccccaatttggtaacatttaggtttatgaagtctgtgtactaggttagtgcagagagttagaaacaccaggattcaaatgcctggatcttcctcttatagatttatgactcttgacaagttgcttcatgtctttaagactccttctttcactgtaaaattggaaaactaaaacctacacactgggggctggggggtggggggagtttgctgtaaggttaaaaacgtgaatatatgaagagtctatcttagcagatttcgtggcccttgctatgtgctgacagtagccatataaataatgtattattgggtcatttcctaattccataatgaaatttttaaacaaattattatagacatttttgttcctttttgagactagttgagctagacagtatggaaaatatgaaggctcttgatgcatgcttctcttcttctgatgcaaattgcaaaattattttccaaatagaaattgacattcctccagaagtatatgagtgtctgcctcacgacagccttgccaacactgcatatcagcatttacatgtttttttctaatttgattgatgaagagaaatatatctctttttaatctgcatttctttgattactagtgaggtggaacatttttttcgtatgtttattagccatttatatttcctcttccgtgaattgacctctttgcttttgaaaggaaggatgagtctccaagggctagctagagaaaagatgctccagtgataattatctcagagccctggggtgaggagttgcaggggagagaattaaaggtctcctggggctatgaggcggctactaagtgagcggctttctacaccagagcgaggctttctacacagtcagcttgaaatcagtatttgttctctacctttgtatttgttctgttaagaaatattttggattttttagtgggactcttcacattctactcaagccagcgcttataattctttcagggcagacaacgagcatgcctgttcagtttgggttttttgctctgaaagtcccattggtttacagtgaagttgctgtaggtcttgcttgagtcttttatgatccctgccatccagccaggagctgtgactgctctgtaaccttcttagatttaaatctgttgcttgtgttctcctcatagtgttacagagcagcagaggccatccatactgatgtcttaatatcattctctccttagatttatagggtaaaataaaccctctgccatagaagtgcttattgattactgaagtacataataaagcctaagaataaagtaagaccaagtaatcggttctgttcctgggggatgacaataaactctggccgaggcagcctctgaaggttgccttttgccttggagctaggaggctcctttttaattggttgtcaaaatagtaagcagtgactgatagaaatcagacaaaaagagtacatactgtatggttccatttatgtaaaatttttaaaaatacctactaatctgtagtgacagaaggcacatcagtgatacggtaagggacctgagagagggatagaagctttggggagggatggacaggttcactgtcttgatcgtggtgatggcttcacaggtgtgtacacatatatgaaaagctatcaaattgtgcatttcaaatacgtgccttttaccaatgtcagttatatctcaataaagccacaaaaaaatagtgaacagtatcccataaagagacaatccatggctcactctgtgctagaaaaattttctcttttcttagaaagctatattttgacaaacattcagggggaattgtgagactacatttcaccttcacctttagctaaataggggttttagaagactgaaagatgccaccggaaattaaaaaagaaaaaggcataagaaggtaggatagccctctttcttcattcctttttctttcctacatctgaaccttaaaggtgccttttaacataattttttagtaaaacaaaaaaaggtatttagaaaatattaattcttttctctcatcccccccaacccttctgctattacatttcccccacccagaaaagagattctacagtgcagagtaaaaactactccaaaatgttggcagtctaaaagtggacaggcattttcaacacaaagagatgtttgttttccttgcattttaactcttaatttttgacacagtagggaactccagcatggctgccatttaaaatgtaacaatgccatgcagctctgattgcctctgtcacaggggtgttgtgactgaaggccaggagacaaagcaaatgaggccagagacagtgcctgctgctgaagtgctggtccatttctccacccgcatttgaatttgtcttttctctggctaactgcttttctgccctgatgaggagtcactcggggagactgaagctggaatttgtacaacctctttcagtccccttgattttaatcagaaatacacaattattcttttcctccaaatagagaaactcaatccccattttaaattcaattattgtaattgcagcattcagaaaaatagcacattcattttctaataagagattgtggataccaaattactgcatatagtatgtcaaaacaggaaacttgagactggcaaaccagtgggtgtttttatcttggcaatttgtattttcttgcagacaatttatagtaatcctacccttccttgtttatgatatagaagactaggttttaaagccatcctaaaataaagactgtttttgttgggtacagtttaattgaaaatctgttatgagtatgaggaattctacaaagggcaaaagtgaaggcagatacccaataaagggaagaaaaaaaaggaatcactttaggatcctatgtgacggtagcctaagatgtctttggatcttcttgaaccattctcattatctcaagccatatttatattcctttagccaagtttctcactatcttgcatttgtaaaaaaacaaaaaaagaaatctggttggtgagaagttgataatgtggccattatgtcttagcaatatgagagcaccattgtccctcttcctgctcaattccagttgctctagttggcttgaagtgaatcaaatgtgaaaagaaatacagtttttttattttgagtttcctgattttcataaaagagtaaccttaagatgtgatttcttcaagtgcatgctgttattttcttaggatttactgtcacctcaaaattatatccatgtcagccaggcatagtggctcatgcctgtaatcccagcactttgggaggctgaggtgggtggatcacctgaggtcaggcgtttgagaccagcctggccaacctggtgaaaccctgtctgtactaaaaacacaaaacattagccaggcatggtggcgcatacctatagtcccacttatgggaagctgaggcaggtgaatcgcttgaacccaggaggcggaagttgcagtgagccaagatcgcgccactgtgctccagcctgggcaacagagtgagactctgtctcaagaaaaaaaaaattatacccatctttttcatagacacattcagacacctaccacactttcagatcttttagtgttcatgccgccaaccactgtctctctcttgatctcttcactcagacactctccatgctaccttccctcaggtattttgctactgtaatttattaattctttcacatatatgtattgagcaccttctaggtaccagcttcaagtggagcaagatatgagcaaactctgagatactgtcaaggaaactagccaacagtgttggaggtgctagaaaccaacagttaaggtacagccagtgaagtcagagccctggaaagcttccatatggaagaaggaacagtcatttccatgtgtcctgaaagggtggtggtctgttggatccttgagtgcctactaagtgccaggtactttagttatattctctcagcaaatccccatttttgcagttacctctgggaatttttatctctgtcaagattactctcctggttgattttggtaaatcagtccttaaatcaatcttgaatataaataatctgtgagtagggctatcaaaactatctcctaattctgactggtcagaatcgctagacaaagtttaaaatatgtagcttcctacttgtaccagtaatcacctagtgtttttaatatccattctatttatctgtgtatttatttttccaacttaactttgaacattttaataatgtcaaagcccatatgcactatgcatagcataacttacaaatttaaactccaaatcttgtacctatgcattttactttagtccctgtgtgcaggttactgactatttgaagaataagtccaagctacttccatcccaaaaaaaaatgttcatcaagaacctaaagaaacacttcaaaatttcagctctaaggtgtctttcctttttggttttttatcagtgaaataaaactattagttacctggaagattcttcttgttgctcacttcgttgagagggaatgatggtttctggttttgtttgtctgggtggttgtttctgttttcgtgtagcatagtattgagtctttaaacacgtcctgagcagaaatccttgcagaatgtgacttcccctctggcaataaaacggtacaaaaattcaacccaacatttaaataattagtaagttaccctgttgttgtgtgtgatataacatatctttcatggaaataactggaaaaatgaaactattggtatgtctttctggctgctttcacatacctgaactgatttaattctcacaaaaatccggtggggtgtgtatcatcgccattcactggttaagaaaggtagactccaagaattaagttcctttccaaacacagcatgattattaagtggagggggtcagaatttgaacctacgtcagcctcagactgaatgagcacttcctgtgagccagggactgtgctcagtccctcttaagggagagctgtcttctgtggagcagaaatacggctatatggctgcattcactgctgcttgtaggcgctgcaatctcttttcggtttcagcttgcctctgtactttgccaagcaatcaatcaggaaaatattttgaagtagtttctttgtatagcctgagagagagagtgagatggtacgttatactggctaagaacatgaactttgaaggacataactgggttcaagtgccatctctgtcactggaagccttacttaccttctcatctctaaaatggaagggtggtagtataatactttcttctagagctgttgtcaggattcttggtgttttttgtttgtttgtttgtttctttgtttgtttgttttggacagggtctctctctgtcacccaggctagagcacaatgacatgatcagagctaactgcagccttgaccttccgggctcaagcaatcctctcacatcagcctcccaggtagctgggaccacaggcatgcatgaccatacctgctaattttaaaattttttgcagggacaggggtctcgctatgttgcccaggctggtcttgaacttctgggctcaagagatcatcccgcctcagtcttccaaagttctgggattaaaggcatgaggcattgcacctggcctcaggattcttttttgatgaatgccagccaacagctggcatttctagaggaaaacatgctctgccgttgttcctgtggaggaaccctgcaagatgtgaaatgcacttcaacaaccaggcttttccaaaatagagagctcagggctgccctgccatcatggacaccccatctctcctttagcttgagatggacattgaccctttggctgggaattgaatcatgttggtgatacttagcatggaaagccgtagctacattcagtgtctcacaaccttagtggtggaaggaagaatggttgcagcagcttcattacctggggaaaaagaacttggaattccaagcactttaagaaagatgcttttactttgagtgttggagaaaatagagcaattacctattgaagacaaagtggatgaaaaaacacctctgttcatgctaccctgatcatgtaatctattcatattcattctgccttcctgaaggtgattcaagccagactggctgttcctgctggctgtgcctttccttccccaggatacacagggcacatggtgatcacctgagattcccagctaaactcagacattttctactccaagaggagattcctcaaagggctatagcacacaggcagcatcagataatgtggaatgagtggaaggagggagggaggaggaatccataaatcatcaaattgttgttgagcatctttgagggtcctcaagaatacactagaccctgtgatgattccagggacaaccagcctgcactttctgaggagttcactgcctgcctggggagcaagacttgtatatgttaaattagcaaagaatttatgcaagacgtatgtgaaatcagtgaagaattctattctatctagactagagccagggagatttccaacacctggctcatgtatgctttttaaaaaaagatattcagtcttactgaagatgaatagatggatggatggatggtttctaacatctattgattgcttcctatgtatcaggcagtgttctagacatttttatgtttattacatatgtacttatacaaattatatgtttattaactcaattaacgttcttagcaacactatgaggtacatactgtcaatagccccatttaatagatgaggaaactgaagcacagagaggttaagttccttgctagaggtttcacagatggtgtacagtacaggcaggctttgcacccaggcagtctggctccatagttatatatgaaggataacgatgtggtcttttcaagagctgttggcatcttggttcacactgaaagctaccaggctttgttatctgttcctctggctttggcttcctgagtcttaagcacccttctcttttctagaacatagaccagcttgaaccaaccctctgtgattccaccccgcctctcccctggctgcaccaggcctctcatttgtagtttctcttactgagcacatttctaaacgaggacggttgctccactttaaggacatacaaatggcttgccctcacctgtcaagcatgatccttgtattttaccaggcccattatgaacgcaatctttctgttgaaaatttgcatacctcctttcttgaaaagtaatgacagcaatttctttccctccgctcactttctgagtgtctcatttaacggcacctgtgaaaccgacaggcacagagatgagaagtgaaagagagcagttgattaaatcatcatcaagtcgggcctcagaaagtcaattctgcttgccgtctgcaatgatatccttttatcttaaagtaatgagctatggcacttttgcatcgggtaatgcgataagttctattagcatgttccatttgcctcacaagcaagggcaagtcattttagctagctcatatcactgcaatcaaagcaattggcttcccaggcagagaagaaagggaaaaggctcagggtgatttctatggatcacaacacagcggaaaaaatagactcttgtattattttaacccataacatacttttcctttttactcatcagcaaatttgggttttattagcttacacaggactccaaaaagaacccagcatcagttgaagcaaacctgggggtgggggctcagaccccacccaaagcaccaagaaactatatatgggaagggaaaatcgccccattacagaggggtcacaaatagaattctgccaaagcacacaggcaaagatgtcttcctgatagtaacactgtggtctcataataaactcttgcttcacaccatcttcaaagtcatttgtaataggtccccaggcaagtacggattaatgctattgatgacttagaatcagtaaatcaatgacagagaagcaaaggatctgttccttaagcttaaaagagatcatttacaaatcaccgggccccagactgtcagttttacctttggacaagatacttatttttctgagtttggcaaccactgaggtttgtggactctgggttttaagtaaatttcatctttggggtttatgtatatttatacttggcaaaatgtgacttcctttcttagaggaaaacaagctgaactccccaaagatttgtgaaatattcacttccaaccccacttccaataactcaacaatactttaatgatctgtggaaatttacaacatacagattgttttatgaaatacacttggatttcaaagtgacaaaaaggaaaaaaaatattagaatttaatttatgagctttaaaacttcaagtttggacaacctgatttctgtcaatatatttgcacttctaatgggtggtagaatgaacctagcacatagtagttacctgaacattgttggttgaatgagtgtgttattatctgagacactggagggggaataagaagtgttcccttagccccctcagatcacattggttatttgagctctggccagttcaaactgagaacttgcaaaaatgtcagattctgagaactccccattcagaaatgctaggttatcagtaccgaattccagaggcttctgagagttgattctcttgtatctcctgaacaattgaagattggtggacctcatattattttcaaatgggctcattagtgattaccaaaagctttattcttgtaaactgttgtttggaacatgaatattttaattaggctttcattttatctgagctattttatttgatcaggcgtagttactgttaagatagaggggaagagtcgacgacattatttcacagtcagtaagaatatggtctcagtaagaacattttcaggtttaaaaatttaaaaatttctagggccccagtagctttaaatttcacttagtccaaaaccaatatgagagcaatgtaaacagtgtgaaattagggctttgtggattgatgaaaaacagacaacatcagagctgccatatgtggcacaaaatggcggcccatttttacatgagcaaaggattgggcagctgggcaggggatggtgaacgtgtttttagtcaccatgctgctatcttacttctttaaataagaaaataagtgtcatgttttctgcaggtggcttcttctgaaattgcttttaggtgagggatgtctttaaggtcttagataaaccgcctgccccaaaggagaatcgatttgttttgtcactggcaaagttaaattatacttgatgttagatattgtagtttacaagttggggttctccctcattttcctctcatttcctttaggcagaaacaagaataaaataactttgttcagcagtggtattcagccctgacatctttggtggcaatgataaatggatttgagatacgaaataactgttccagcaaggtccattgagcagaatagagagcaatgccctcctcaatgtcattgtatgtgatatattcaatgattgccactctgtgcttaagaatgcattccatcacaaggtacctagaattccatcttgttgctacattctgaatgaaacagagagatgtcacagaccttgactgatttcaatttggaccagagtcttaaaacacagataccgagattcccaaatgaaaatgaaaaatatttgcttttgaataaatataataaagtcataatcacatcttttttctgagccttttaatggaagatattttcttctgggccccaactctaggctctgctaacgattttaacctccctcagtatgttcacacatacatctctttgcgttaagcagtcatattagtgtttcttgtactttctctttggaatcacctgccttttaaatcatactttgcttatgctgcatggaatcaaccacagtttgaacaatactcaagaagaatgagattgacttgtcagtataattgagcatctattgtgtcccaaggcctagagatacaaagataagcaaggcactgtccttacctacatggagctcattctctggttggaaagactgttgtggcaaacaacggcagtacagttttgtaagggatggagatagaagcaattaagtctttctggaaaagtattggaagattcaaaaaaggaactgtgttttgaaggtgaatgtcaggcttttaggtagaaacttggaggaatagaattcccagtagagggaattgttaagtgcagatggctggtggcatgactgagcgtgagtgggcgtggttgaagcaaggtatgttaggatagtgccacacaatgcgaggatgccaaccagggccggaccacaagctgtttgcaaccaacctgctgtgagattagtatggggagtcaagagtaagcattgggaaacttttagagtaactcagtagcataattttgtgtttcataaatctaataattttttaaatgtattatatatatttgtttttctttttcatttttcaagaatttgactttttattatattttacaaaagtaattgtcgtaacatattagaaattaaagaaagcaaaacaaaaacaaatggctcttcaccacagaaagcttaagaagcattgtgttgagagagtggttgggatttgggagttgagggggattagaaacagaatgtgaagggtcttcataggccttgtgaagcatctgcatcaaatagaaatttaggaaatccactcttgtcaataaggacttggattagaaaaggaagagagcatagaccttggaaagcagtcattatcctcttgtaatgacaaaataaaaccctgaactaacgcagtagccatggccacagggatggagagttagaaagcagaatcaataacgtggggtgagagaggaagataagtccgctcaaggatggggtcaaggataaggctcttcacttacgcagttgagtgattgcttggtgatgctattaccaagggcaacgtgggagaggggcagtttcaggtgagcaaagatgttgagtccagatttagatggatacttgagtctgagtgttcgctgcacttcaacagggggcacatacccaacggaagcttaataatacttaacatttatcatctgtacatacttggtaccatgcactaagttgtttacatgtattaactcattctcctcttctagccatattttacagagaaatatactaaggcccagagagtttaaataacttttccaaagttacacagctggcaaatgtgggcatagagatttttgagtttcagcatatacatggtagaaaggaccaagggaatctttaaggtctcccttgaaagtcacatagaaacaatagaactccagatgcaactctggggagacagtgacattaaagaatatgcagaaaaggaagggccttgaaaagacagtcgcagacagcaatattggtgaatgggtgcaaagggaaaaattctaaaggatgtgcaattgaaacaatctaaataaccagcactggggaattttttaattagattatgttacaatccacatagcagattgcagtgtcgcctttttttttttttttttttttttttgagacggagtctcgctctgtcgcccaggctggagtgcagtggcgggatctcggctcactgcaagctccgcctcccgggttcgcgccattctcctgcctcagcctcccaagtagctgggactacaggcgcccgccagcacgcccagctaattttttttgtatttttagtagagacggggtttcaccgttttagccgggatggtctcgatctcctgacctcgtgatccgcccgcctcggcctcccaaagtgctggtattacaggcgtgagccaccgcgcccggccgtgtcgccattttttaaagtgatgttacaggataaattttactgattaaactgaaatatttgacgtgttatgtgaaaatcaaagcaggttccaaaatggtaggaattcatttttatttcttaaaatgtatgtttaaaagacgagtgggattatatccttaagactggaaagacttacaaaaatgtattaacagtgtttacctaaggattgtagatttatgggtaatttttaaaatgtatccagtaaatatgttttttttgtttgtttgtttgtttttgagacgaagtctcgctctgttgcccagggtggagtgatctcagctcactacaacctccgtctccctggctcaagcgattctcctgactcagcctcctgagtatctgggattacaggcgcgtgccaccacgcccggctaatttttgcatttttagtagagatggcgtttcaccatgttggtcaggctggtctcaaactcctgacctcatgatccacccgccttcagcctcccaaagtgctgggattacaggcgtgagccccgtcacccggccgtaaatttgtattttcaaaaggagaaagattgggtgggttggtttgttgtttaaggggtaagacttgtctgggaaaggaagactgtgcctccagcagttcacttttaattcatgaaaccaggggaagagacggtgaagatggaagttgagtggtttcagtattgagatggctggaaggactcaggtttaggaactagtccctttctaactgtgcatttgaggcctttggccaggcgtgcacacgtcctctttctctccttttgtgtgtgatggtttgggtcatgtctttgtctgaaggccgggtgaccatgaattcttatctgtgattgctgtaaggcctagttgtttctttttgtctcttttcatttcttgcttttaaaatggaggatatatttttagcttttcacagcgggctctgaaatcttgtcatggagagtacttcgtcacctcaagctggtagttagtgtgcaacctgtttgctaataaaccaaagcaggaccccgatgtcaaaatgcttaaaatggtcaaatccgctgggacgccgtctctgcatctgacatgccttttccatttcccagcctcatgcagaacataaacctgcatcaggaggtggctcaatgtgaactcttataaattggagtgggtatctagggattgaggagcagacacttcttcttttaacctttgaagaccaagaatcacttggccaaaaaaatccacagtgtattgaacttagggtgtgaaagctatacagtgtattaaatgtgaatttgagaccatgaattctacccacactgactctataaaacagcctccctttttcataaagcaggcccataaaccgctgccagtgaagcagaaagactccttaggactgtggctcgctttccgtctggggttgtcaacaaaccccctttatgagtggaatagacctcttgtatgtgtcgagcttctggctttttacagagtgtgttaggagccaggcaaggcaaacgttaggcgctgtttgctgagtgcatttattggctttgcataatttatgagctggaggggttgaccatcattcgtctctgccaggggctggcactcgaggctccagagagtggagctgtaaattggatggtgcgctcctgctgagctcacggcaaagtcctcaggtcagtatgggaatttaataccagaaatggaactgttttctcagcacaccatgtggaccccagtgcagcagagactgttttggcagactccacgactggccttgtcgaggagctgtcactcacccggcatgttgtgtggggagcctgagcatttttaatcggcttggcatccgtgctgcttccataatggataccagtaggtctcagttcttcaccatatgcttaactctggagacaaggtgcttctgggtatatcagtaattacttgatgcagaattaagtggaccttgaaattagaactggactgttggaaagcaggaagcttaacactttgatagaaataaccattcccagggacatactgccgttaggatagggggcacagtggtggttctttcccagctaccccactcctcgtcctccctgcacaccagatccttggggaggtgggcaaatgcgatgccacagccttcagctgtcattgattacctcacaaggagcgctgtgaacatctgggaacatgagcctgcctggcaaaatagtcttctgccttccacacccctcttgaattgagcgttgtcactcttgaaaatgtgcccagatcttaggaacctcacagagggcttaattaaaggcaatggagagatcacacaatcaggacagtattgttcctcatccacctgcggttctaggccttcaaagtcttcatctcatccaatttctttctcaactcatttgacttattacaataaagaaaccactcatcaggtcaaagaatgtaaatgtagacaatctgaggttggaagctgggttggaaatgatgcaccgtacttggttaaatcgctgtcactgaatatctgactaccctgtggcactgaggagccaatgggagaagtagaaaatgttctaatcctccagtctataagactgtgatataagttcctaaatgcttttactacggagtgcttagtctgaaaagaataagtagtccccaggttgtctcataatagcaagaagtccatttagatgggtgttctgttacttcccattaaaagctctctaataggagcttaaacaataaggtaacttagtgttttctgaataaaagtcctgaggcaggctgccctgagatgggttcagtggtccaattctgtcaggcattttttcccttggtcccactctgttgtttttgtactgagtctttttgcctcatttttgcaagatggctgctacgtatctggacatcacgttcttatacactcatgttcaaaggccaaaggcaggtggttccttcttttctttgtttactggggagacaaaattgtttctagagccctcagcagatttcagaatctcattggccaaagatgggccttcaaataagcgattacaatgcccagaggtttacctcttttcccatctttagcctcaagaaaaattgagaaagaaaatacctggcatttttaacctcaaagtgtcaggagaaggtacagactagggagaagggagttgtgaatggctgtggggatctagccagcagtggctgccctacaagcaaatttatttcctgtttctgttcaaagctataccaactcccatgtccaggtggccacactaaaaaaccttggcatcatcctagacacatccctgttacttgcttcccatatccatgtgttatcaaatcctgttggttctaccttcagaattgctgtgccatctgcttctgccttcctaaaccatggcaccaccttgggttagacagtggaatggctgccaaaccactctccctgtgacctgatttttccccactgtgcactctctccacgttcccacagaaagtcatcctcatggaagcagctctgatcatgccacacccctgctagtgtttgtatcccagcttcatgtcttactgctaaacggaaggctcctttagagccaggcctgtatctcaggtgaatttcagtctagtttagcagttccttatcaagggctgttgactgaatgaatagatatatttacctgctgagctttactctaacaaaacacatcccccagtttttcattgaatattgaattaacaaaacacttcattttttttaagttgtgttcttttttcccttgcttatcatgaggatcccaaagactggggttaattattaattatcactctctgcttatcccaaaccaaactcagtggttggaatttgggatctgtttgatatggtctgagtctatggccctaaagcatacttttttgcccatattttttatttactaccctgacctcttgtctttggcatactttttatagggaatgttccttctattctctgggcctctaaaccggaaaaggcagccatcacaagtggtgagccttggccattatgttctgtttccttcaaagttcaaatgagtgactacaacgcccagaggtttacctcttttcctgtagaaaagcaccggtagagatacagccattcacattagctgaagatagaatgtcttcgttaagaaattgattttgctctgaatttcattgaacaatcttgattcaccttaatcctgtggctgactcctagaggggcatcgcctctaccctgccatggtgggagggaagcgctcacttgtgtgattgagcaccttgctggactgacctgaggaagagccacagagtacaggcatcagatgaaatcaacaaaataacttttttgcatctggatagcattttgtttcagatgctgtttactagcacttgaactggagaaactctttctttccaggaagacagcattttttatttcctttacttatcttgcactttttttgtatgggggttgggggaggaggcatcaaaagcaaaaacatactcagttcttgcactaacccttattctcttgtcttcattttcagtgtgacagtgacagtgaccaggaagagaaggtaagaccccccctcccccattgtgggcacagcacataacacactgaacaccagagtcctcccacacacagctgcagggtaggatgccagcttcatgttgacaggaccttttctctttaggaaagatgggcattattcacacagtgacatttcctatgctatgacacgtttaatttgtcagatctacctttttttcatttaaacaagacctttaatattgcatatatgtgacactgagtttttactttatggaagatgactcatagactcaaaaacattttaaaagacaaaattatttattttaataaccatctgatttttaaaaatccatgatgagaacgttaaacttgctagtttgtgtttataatgtcatttctgcatttattttactgacccatatgcttttctgtacctattggccttcttgatagaaatgttaatggtctgtgtctaggaatctcatcatggggtacgggtgggcaagggaggtcagatgggaactgccctcttcccatccgggcggaccgccaggtaggaggacagttcttccagcaggtacatgctctgtttcgaggctcatgggcaccagcctctgtgtatccagatcaacatggatcaagaaaaggaactcagtttctgaggttccagaagattggatcacaactcggtaaagtgagctttctgctgcctgaagcaaagggattatttgtctgtttggtctttctttctagccgttccaatccccaaccaaagttccttccatttttactgctgctttatgttattttgaaaagagttacctgaatatcacggtttctgtattgcttggtatcaaaaggatggactcggcctcccttcccccgtttctggatctgtcctgtgccctgtgctttgactttcacctcctacatgcttgcggattttattcagaatgctgcagttagtatttagtgggatctttccaacaaacccagaatttttctctccttctctgctgccagcctccaagagagatctaaaggctcttgttctgtactgtcgttaatttgaattcagcatatgtagcctgttataaaatgcgagacatcatcatttgagcaggtcaagcatattcagatgaagacaaatggtgcttatttgatttccttaaaatcaggaaatgaaaaaaatgctctctggagaaatcatgttctgcctgacttggatgatagaccaatgcatgtcccccagataagaacaggctctcgccttgaggtttttatctctgaaggacggccaggactgtcagcttgctgacatgtgcattatccatgtcattttaaacaaagtgacctatggaagggtacgctgtgctgtgacatggtaatgggctgttggatgacagtgaaagtacacactggaaagggggctgtggattattcttttgtttaactgacaagtaggagctgcctttctccagcccccaggagccttagctccttggaagtaggactcctggtgtctcaggcagccagtgtgtagtgggtgccagggacatgtgcacagcagtaatggttagtgttcaagacacggtcattggcccccaaacccccgaggccacattcccacatggtgggcatcactggtacccagggagggactggtaccttctggccattccagatctatcagcaatggttgatctcactttctaagtctgtgccacttttccaaaaggataaatcttattcagggtcgtacaaccaagctgacattctttccttaaaaggaaatgtggggccaggcgcagtggctcacgcttgtgatcccagcactttgggaggccgaggtgggtggatcacgaggtcaggagattgagaccatcctggctaacactgtgaaaccccgtctcaactaaaaatacaaaaaattagctgggcattgtggcgggcgcctgtagttccagctactcgggaggctgaggcaggagaatagcttgaacctgggaggcggaggttgcagtgagcagagatcgcaccactgtactccagcctgggtgacagagtgagattccatcaaaaaaaaaaaaaaaaaaaaggaaatgtgaattccaaaaccatcaccagtcttcagcagtggtagaaggtggtaaggatgcccggttttgtgttccttgtaaatgtcttcaccagtggcctcaaccttgacacccaaatcacctagggagctgctacaagttccagtgcctgggcctcatcccaggtcaatgaccttggagcctttggggctgtcttgaaccatgggtcttgatgatcacctaactctggtaatttctaggagtaatctgcctctggttgtcagagggatctgggggccaatactgagagcaccccaccaggtcctttcccatcacctgaattcctgagtagttattgcctgggtttccatctctaagtgcaagaagtaaagtgtcggaataatgggtattgggaaggtagctcccacctaccactctgagcttgagtagatttcagggtaataaagcggatacatagttgtttataggcgagtccaagagtggcaatggcaagaagggaaggggtattaggagtgttcctcagattcatggcgcacctcctgccctgcacccccagccattcttcctttctactgtggtgatcctgcaggtcttaagtgggagccacaccataaccagtgttgacatcatctgcctctgttctgccccatgccatttctccagggggctcccaacaggagccattgagactctaattgccctcgcacctgcttggccctgttgcagttaagactgttaggcttccccttttggactgagattgtctggtgtttatcgccaactttaacaccatcctccaagacttctgctctgtcggagcctgggtccctgtcagcctcctctgtgaagaaacctcttgcctgtgcccccctcgaagccccagagctaaccagggctgctttcatgtgttgcttggaggattcgcattcgaatctgaattgctaatggtggaaaagatgccactcagtgtcctgggataccttcagcaagccccaccagggatgctgttggaggcaaaagtgaaacttgtcagggacccactgggatttctctctggaagacctgccattctcttactccatagggatctgcagaaccggcaggctaaaattagggtactgtgtttcacacagctgactgaattaagataaactctgctttcctctgatatgaagctgtaatttataaaatgatacccttactaattaacgtggaagtgactccgaaaggggctaaaaaagcagagctttccctaaatgcaggagacacacttgtgcacaaaaaggctttgatgagacactgagcaaagtatctcccttatcctcccctcccagccacgtgaatacattgcacattaatgtcagataaccacaaggacgttcatgaagagtagaaattgggctgggtgcggtggctgatgcctgtaatcccaacactttgggaggccaaggcggggagatgacaagatcaggagttggagaccagcctgaccaacatagtgaaaccccgtctctactaaaaatacaaaaaattagccgggcgtggtagcacgtgcctgtagtcgcagctactcgggaggctgaggcaggggaattgcttgaacccgggaggcggaagttgcagtgagccgagatcgcaccattgcactccagcctgggcgacagggcgagactccatctcaaaaaaaaaaaaaaaaaaaaaaagatagaaattgggtggggaattacagaaggctgtgaacactgcatcttagatgtgggattgttcttcactgtagtgagagctaagaaaagaggcagcacttggcacccttaatcacccaaattaagcaattattctgatcccccattcgaaatgaattggtatcatgagaacaaagaggcaacatgcaattgccaaatatttggcctatattttattgtttcctttctttctccagtactggcagcagcccatgatgctaagaaatatcccgtttggttatgaagttaatgtggagattaaaagtcattccctgttctacccacaccctttttcttgtgtatagcatgtgactgagctgattggaaggcatatagcccagtggccaagcacttgggcctcagtgtgatggctgacacatgtttctgactctgtccatttctattttgttgtggacaagccttggctttctcagctgtcaaatgggggtgacaacagctctacatatagtcctgtagcaattaaatgaaagcatttagggccaggcatggtggcttatggcggtaatcccagcacttagggaggccaaggcaggacaaagtgggctcttgtctttgagccctagagtttgagaccagcctgggcaacatagtgaggccctgtctctaaaaaaaaaaaaaaaaaaaaaaatcttaaaacttaaccaggcatggtggcatgtgcctatagtcccagctagtcaggaggctgaggcaggatgattgcttgagcctaggagtttcaagactgcagtgagctaagatcatgccactacactgcactccagcctgagtgacagagtgagaccctgtctctaaaaaaataaaaatatatgaaggcatctggctcagtgcctggtccatagtaactgctcaataaatgttagcttttgttcattttacttgagataaaatgagagaggacgcttgaaaaaagaggaagactagcatcctctttggaaagctggggttcttctagagaacctgctagagggtttccccagaatctgaggctcagcctttatcccaagggcccttctcctggacacaggctgaatggaagtgttaaattttgaagggttctgaaacagtgtctttttaaaccccttatccaaacatcaggccttcctctgagcagaacctggagccaagagcacgtgtactgtcctggagggatcaaatggtgattaagtgaattgtatagctcttgtcccttcagcaactgttcccaaatgccaaacactgtcggttcccagaaacccatcacaggagagatgttctggggtagggccagagcatctgtattttttaaaaagcttcctaggtaattttggtacacaactggttttgagaactactgccttatagtaaatgtcaaagggaaacatgatttttccccgtgtttaatgctcttgaaattttgactgcttaggagaaaaacttgaaagttgtggagatgttgcctgtgtgtgcagacatgtgccacccatgcttatgtctgtagataccgggcataagtatacatgcagtacacacatacacaatctcacagaaatgaatccttctccttttcctatcaatcttttaacatgactcctgattgcagttttttctctctgtgctgttagcagtaggaacaaccacctggagaaggtgtttgtgctcctgggctttgctttggtactgtgtcctgtacccaggacagcctactggcacaatggctaactgcaaatgcagtactaccgatttttcacacctgctttccctctttccacacactttttggtgcattcccttttttgtttagagacagggtctcgctctgttgcccaggctggagtacaatggcataatcttagctcactacagcctcgaactcctggactcaagcagtcctcccacctcagcctcccaagtagctgggactacaggtgtgtaccaccatactcagataacttaaattttattctgtagagatggagtctcactatgttgcccacactggtctcaaactcttggcctcaagtgatcctcctgccttggcctcccaaagcactgatattacaggcatgagcaaccatgcctggtgttcatttttaaattcatgctaaaagttgttgtgtttgatcattttatgttcacttgtgtgggaaggggcttctaagaaaaggagcaaagaaaaccagcaaagtcttatgttcctaactcaacacaaaccacatgcctaacttggctcgtgcaggagtcagaaactgctgagatgtcaaactgaagactgggcatgtggtttgtgcttacagtggaagagtcccatcccttggttggccatgtttcacactcggtaaggtttgtgcaccctcagcaacattccagaagctcagaaggccctcattgttgcttgtggaacccccagccttagttttcaaataggatatattttggtcaggagacagtttggaggtactgtcctattttgtagctagaaaggaatatctccacctttccagatttcatagcagcaaagcagacagccatcacccagggaaagagaatggatccatgttcttgtctttatatccctaatactttgcacagtgcttgatatgaattaggtgctcagtgttttgcaaaatttgcattttctttcctggatactcatctccaaacggaggggataagtgaaccaagttcagaagactcatactcaaacctgattgcacctcatacagtcgcaatgtctacttcctggacccccaaaatgtgtgatctcttcctcaggcttctatatttcatctacagttttctcatacaatatatctaagccatttataagtttcctaacttataaatagacaatttcttatggttcttggctgagtctcaggagatttttaatttatttttgttttttgaaatggagtctcgctctgtcacccaggcagaagtgcagtggcgcagtctcggttcactgaaccctcccactccttgattcaagtgattctcctgcctcagcctcccgagtagctgggattacaggcacccaccatgcctggctaatttttgtatttttagtagagacagggtttcaccatgttggccaggctgatcttgaactcctgacctcaggtgaccggcccatattggcctcccaaagtgttgggatgacagtcatgagccaccgcacctggcctaagagctttttattttggatgcgtgatttccgtgatgcccatctactcaacctcttcttaccccttcaggattttgtctgggttaaaatgacattttattgttcttccaaaatcatcatatttccaattggcttaattacattgcatacatcccaaatacacattgatactatccttggattaaatttctatggtaaattattttaaattcagaatctcattatctttttcatatgataacattttcaggcaaaaccaaaaattacttcacttatactgaacatgtatgtacaataatctgttcattactaccatgtcatgcacctgaaaaagaagttataaatgtacagattttcaattaaatataggtaagtcaacagaataaatacttgttattggaaatatgtcaggcattttcagctaaggttttgtttcttgaaataaacagtgagaagaaagaacaggttctagatgttctattgctcgcaataggtgggtggtggagaagggcactcagaagacccaattcctgatttctcactcaccagctgtatggccttgggcaagttacctaatggtgcctagcattagttttgtcatctggaaaatgaggcagtattcaatgatccaacattgactatccagattttccaaatagctatttacctaggccccaacagcatggcagaacccagagggaaattaatatgtgattgtatcttccctttgccaatgtggaaagaggattatataagaattgtctccattctttcgtctctctcagtcttccaagagagaataaacatataggggacatactcgggtatatgtgtgtgtactctcaagcaactgaaggaaacttacatacagacctgatgtctaaacagggtccttatctgtttgttggttcagtctttcagtcatacatatccactcattttttcacaagtgtctactgatgaactgacatgagaattatagttgcttaactctgatggaactgtcaccatgtacctgtgagtaagtagcagagcagttcatttaatctgtgttcctcaactactgtaagtatttaggaaagcatggggactaggtggagagctagcttacggaatgtgtttcaagaactcacttgtttggtaatgaccattacttgatctataaaaggaattgttccagaaacatcaaggttgagtgcatgattctgtgttcccacagaaaagttcctgctgcttccccttgggtgaatgagccatcgccttgggtgtcatggcttacctgaagggaaagttgtaaagccaaggaggaggctgggggaggtgatggctatcagccccatgaaattgaccatgagccctgagccacctgaataccaggagggtcatgagcagaggcatttgtacaggtgatgtcttgaacaacatgcttcatgttagtggcctctgatagagtgtaacctgggaggctctttggttgtcagagaatttgtcttatactgtattagggttgcagagtgttctgtcttcaatgaagatagaactttttggtcatgtacgtgtgtgtgtgtgtgtgtgtgtgtgtgtgtgagagagagagagagagagaaagagttaatcccccttgacaactcctggatggcaagatagttacagataaatgctcctcagaactgtgccattctagtgtgacaaatataatcaaatatctatattaggatgtgttaataattatctaaactttatactttaagaagtccccagattcaacaaatgaatggacttctgttttcttttttaattaaagttacagctgggaaggtcaaattggttctcttttatacaggttagagattttccctatcagtttccatgaggagcatgttgagaagttctagctgtagacctgcatgacctcttcaggtacccgaagaataacccaaagaaagctggaagcagctttctcccttgttgttctaaaccaggcttgactcatatacttacggagacagccgaatggggtctttgaaataaggaaagaccagtaagccctgtggtgggtggttgtagtactcaaggagcccagtttgggcttcatcttttctttctagtgctcttagtggtttttgaagttcctaatttcctggtctaaaaatatagatgctactaatgtcttcggtcagtgaaaaactaagattagggtcaataatagcaactaaatagtaataataagcaccacttcacatgaaagagaacattgcattattcaaaacacttttaaaaacatcattttataagatctgtttaagtatttattgtagggatctatatattctcacatacaccatcgttgaccatgtgccaaactctctgttagggcttttcaaggctttatcttctcaagcaggtgtcattgttttacaaataagaaaaatgaggcataagtgatggagctgagatataagttgtgtcttaggattccagaatctgggccctcttcccatgccgtgctgcttccccgtacgtcagtgtgagttgggataagcctagcagtgccattcaggagctcatgctgtcatcccctctgtgtctcacctacttgtgctgcaagagacctggatcctgtttatctatccaccctcacccccacccaaacaattgcactaactcctaaaaattcaaacatggcggtttctcaagaaacatggaacgaataaaatttgggtctactaacaacttagattgtacaggctcttctgaagtgggacttttttcttattttagcctggaatgcagttatccaaggtgagaagggaagggctatatacaaggtatatattttaactcttacagatgggtagcaaagtcagcccatgattaattagggatgtaggctacaccagtcggtggacttagcatgaaccatatttggacacagaactcagtcttcctttaagtgtctgtatatgtgtaaacatttaatattttattaaatcatagactccctgaaagcatcccatgcctagcatgtacttgacacatacggccctgtaaatattagtgttatacccagaagttgctttattggttatccaagtctcataaaggagaagggccttgcctctgtcactcagaaagcacaggaagagcagggctggagcagaggaatttcttctgagcttccagtccagagcctcatgaaccccatatggtccctgcagaccattttcttcctacgaccccacacaggagaaggggccatggttccatggtggctcctgcactgcaccctctaaggtagttttgttctgagttataattcgccccctcaagaaccctcttgtccatccccagacactgattctcaccctgacagaggtctgggtccatcagggccacagggccttttcttttttaacagcaaatgctgcgtgggctgttcctgcagcccaaatgatagtaaatacctgaagcagccatgtccatgttaaagattatgtatttgccactaaggggagaatatagtgtttatcggccggagtgcgtgccggctgagctgattacggcacaacactctgtcagccaatgatttgtcctgtcctttatcatctgtgtcactcagcagtgtgctggcgaagggaacggatcacccccttccctttttttgtacccattttgtgtagaaaatttgtatttactttgggagtgtaatttgttcctcatggataatgtgaccctgagcggagctggatcatgggttagttgaagtgatattttccgctaatggtagtcgtacatcattgctgtcagctcgggttaggaggcaagcacattacagctccattttacctctgcaggcatctgggattatttgccataaccgagtatgacatgaccgcactacagagtgcattaaaattttactggcttctcaggcaagttccccagctccagtgtgtgcttcaggcaggcggtctgatggggagtccaagggccctgacttcctgctcagaggtgctgcgggcagtggcctaagcaggggctactctctccttgccctgagaaagaagcagggaaagactctgtggggagccacccaggggatgtttatgtctctatacgtcccggactggcaagtgactagctgccttgtgtacataaccaggtgccgcccacagtggctgctgccatctgctctctctccttgatgacttcagcccccagggtggattaggcaaaaactccttctctaaggagagcccagggtaagtgcaagtctctgccaagccttgggctgatttgtattgttcttgtctgcctacgttcagactgaagaaaggaggcgtaagtcctcattatggcagaacccacgtccagccatgtagctggactgagcctgatagagtctcatcaacccagttagaaatgtttgccaaggtgttttacacattatcttatacagtcctcacaccaacccaatggagtgtaggcgtgattacctccattctacttataaggaaactgaggttcaaaggttctgtaacttacattatacagctaatggtagcagaaatagccttctgacttcaaattctatatggtttctagtgttcagtgctacagagagataaagaagtaactattgtttaaatagtgcttagatgtgctatacatatgttgacttgtttagtcttcagtacaatcctaataggtaggtgctaatattatcccccatttacagaggtgggaactgaatcacagaggtattaccgaacatgcccagtcttgctcctggttaatggcagaggcaggtttcaaacccaggtcagtgtggcagtgctcttagccgctaagctggactctcccacatgccacattccaataagcctgagagctgataggaaaagaccagtgaaaactgtaatacgttggaatacaaggaaatgttcaaagagtattttatcactttctgttgtaactctaacatccaacaaaatatcactcaaagaagatgttttgtgatgagctttaattaattaataagtcccatttgcagttagcacattacttgcatgcaaatgatgcttctaaggtgcttgaaaggtatttattttgataggttaagactaagcagtcactctggcaaatgctttattcttttatattcttattggaaaggctgtaataaacttatgttgaatcatgttctttaaaaggacaatttaaggttgtctcccagtaattagtgggatatggatgagggcccataggctgccatatagaataaaatgactgcagattccatattggtggattccgaatgctggacacttgaatgtactctcgtgcctacagtgtggacatgactttttgttctgacacggaaatacccctttttacctctctagccgcctcatcgctttctattccaagcttgaaatgttacccctcctggacagaatggacaagccattcttaccatcacctgtgtacatgatagggttgtaattcatgaatttattcaataagccagacataaagtgagttgtaccttcagggcagttttttaaatgctgcaacagaagagccatagataagcatggcttttctcactgagaaatttaaaattaagttagcacactaagaattgtcctccctgcccccgctcccctccttgggctcacaagcacacacattgatcttccctgctagattaccataggtccaggggattgaccttagtttctcctctagccttagatccaatcactcaagtagtaaagaataagaacaaaagtattgatccagtcatggaacagtaattatttctctcagatggtcgtttagaatgcagcaataattttaaataatgtattcctcagagacagcatgacaacatatgtggattatttagttggtgcgtttaagtaagttacacttgcaccctcacccctttactggacgtccaatgctgtgcaaggaggcctactttaagaagagtagacattgagaaaaatcagagtttacccaacaaatcaattaccaagcaattgttcattataaaggggcttatccattttctgtagctggacaaaataatggacctccacatgctcacatgcttacagtgcaactccacccttccgtatgaagagacttcatgaagtcattggatccttttgaaactcttaagttgtaacagctttgactgtgtttatgttaatagagttaccttttaaagactctttttgtttcaaataacatacattaaactaacaaataatgaaatgtttaggcttttggaatttaaatgtgttaaaataaccaaaccatcagaagggcagagccaggcaactggatatcagaaacagtgagcagagggctaaatgccctccttgctttgtctctacttatttttgcccgtccacttgaatcttgataatttcggagacttcgtttctccttttggtagaaatcatgacccatccacttttcagttttagctacaggcagagagactgtctctccttttccactgccattgctaagatccaagggagagattctgactggctgagattagctcaggaaaggattgtgggttggtgtaacttaagccaggtgcttacacctggattggtcagttatgggtagagagacgggaccatgttgtccaaatgtgcttctctagaggtgcctctgtacatggtgctggagtcagtagagaacccagaaagttaggagttgggcctgcagcagtgggttctaggaagcaaaacctaatcttcctgccatttggatgaggcactacttacaggcataaattcttgacagccatagaagctgcctgggtcatccaaagttgacactttatagtgatcacaaaatctcaaatatggatacgtatttacaattatgtataataattgcctaaatattcatagagtcattttaagtgctattcacagattagttctatcttgcttaagctattaaaagccatagaaatacacaggattttgtagagtgagagttcatgtgtacatgcacttagaaaagtccagaatttattaatattttaagtacacctatagtagctaatgaattactcccctgccccacccaagtataagacagccaccttgagagacacaaagatctcaaggaatgtcaattagtaaattacatatctagggtacaaaatgaaacttctttgtccaaagggattgtggtcaacctggagaatccaatttgcatgccatgcagtactacttaaacttcagcaggcagccttcctgaagtgatgttcctaagactagaaaatagtaactcactcatagcttctttcactcatgtttcattcaacaaatttaatcctcacttgtatgctaagccaagcactgtcatgggaactagggatgggaagaagacaaagacatagaaaaccttcagggaaatatggcctaattgaagggaaagctgaggtacctagatgaattacaagaccccgtagcgtatgctgtttctgaggaatggcatgatgtctgaatgcaaaaaactgagccatactctgtaagggaggaagcaattgagttagatcttgctgcagcacatggaatagatgttactaggtagcaagaatggggtagatcacaggcaaaggggatatcatttgcaaataacagagttaggaaaggcttagcatgtggagagaagcatgaaaacttctgtttgtttggtcagggtccatggcagtgttggggggaagatgagactgtaaacatatgttggtatacacagttccataaaaacaggccttgcacggcaagatgagagtttggacttgatccagatggaagccactgggtaccttatgtaggtgaatgacacatcagaattgacattttggaggaggattcaggcagtggcatgaaggatggagtgaaagggggtgaaagttgtcataatgggggatttgagaggtgatagagatctcaaccaaactaatgtggaaagaaggagtctgattttagaggcatttctgaagtgatgattttgtgaccactgggaaggggggtcaagggaggaatcgtggatgactcaggtttcaagtcaggctgactgggtcagtattgatgatgccatcaatcacacagcgaaagtggggggatggagaaaataggagctcagggaggggctttcaggaccttcagctggatgaggtcagaagagagtacatattgatgatgcaggagtgatcccaattttagttcagtgtctgggagacaaaactaccttagtagcagagatggagctataggggaatgagtgggaggccagccagaacactgggattttgtctgtgtctacaggaataaatatacgtggtgatgataaccattaaaaacaaaataaatactggggactagtagagagggaaggtagggaggaaggcaagagttgaataactattgggtaccatgctcactacctgggtaatgggatcattagaagcccaaacctcagtatcactcaatatacccatgtaacaaacatacacatgtacccccgaatctaaaataaaaattgaaattattttttaaactacaaaataactgtatattaatcgtagcacttgatatttgtatagcttttttttttactgtacatatctttattttttcatttgtggcaaaatacacataacataaaatttaccatcctaaccatttttaaatgtacatttcagtagtaatggtaagcacactcacatggttgtgcaacctatgtagtttttttatgccacatgtgttaaagtaccatatatagttcatttaaacctcataagaaacaccctggatgaaaggatgttaaatatttattttagaaatgaggaactttgaaacgggatgaactgaaacaaagtcgtaatgctttggtgataatatccccatgccttctagggtcagtattggggttataccacagtatccttagtgatgatattttaacatctaacttccagtggaccaaacagtaactcacttatagcctgagatcctattgctttccttaaggaaactggaatggaatcagccccacagcatgaactgggccacccagcagcagccaggtcgccgctctgagaggtctggttctgaggggctctgtgggagtaagacagcatgaggccatatagctttggatataggaaacgcctagaaaggtagagagatatgataccacacttccagctctagcaacatagtgctgtgtgactgcggccttgggcagtttactaatgcttctaagcttctgcttttgtgtttttttgtttttgttgttgttgttgtttttccttttaaaaatctagatataaaatacctagaattatatggcccataatagtaactactcaggtcaggcactgtgactcacacctgtaatcccagcactttgggaggccaaggtgtagaccaacctgagtaacatggtgaaaccccatctctacaaaaaaaataaaaattagtcagatgtggtggcaagtgcctgtagtcccagctaattgggaggctgagggaggaggattgcgtgagcccgggaggcggaggttgcagtgagctgagattgcaccactgcactccagtctgggcgacagagcaagatcctgtctcaataatactactattaataataataaggattcagtaaattttacatttcagtcccttccaccctgtttcctcctgctggtcccccaccattgaccgacttaccctgcaaaaaaccataacacacattagcaagattcatttattacagccaaatcagcaccccaggatcaggccttttaggaaatgggatccaaaacataagtgtcttaaagaggtagaagatcagagggctttgaaacatggccatgtcatcagtctgaaatttagaaagaagttccctgtggcaagagaatccgcaggaaatcactaagctttggaggcccaggatatacccagtaaagcacaggcggtgggcccccaagggaagatggacagcaaagacagcctttataatctgagtagatttcacccatgtccccctccacctaagctctggttttcctttagaggaggcttttaacttaattcctgttgaatttactaatgttgtgtggtgtgagattttaagtatcttctccagcctcctgggcccctctctcctcccctgtcccttccccacctccctatcctgtcttgaacttccaaccccaagagctcttctttacactgtttgctaaaatggagcctcttgtgtgatgcatacccaggaggtgaagctttcaggggtcctaatgtgtgcttcaggataagggcaccatgggtcccctgcctgccagtgtgcccctcaaagaatgtgggctttggcaacatggcattaattcactgccaatgaaacaatgatgggaattttaatgatagcgttgctgtctaaaagatgacgggggagacttctcagcgtctgtgatccagaaaacacactttctagtaagtatctcttatggtcagaagtgagagtgaaatctctgtcagtccttcctaagcattaccttggcaagcgctacagagcaatgtaacataggatgtgttcagtttaagtaacagaatgcctgatagtggctttgtccgtgtattagtttcctgtggctgttctaatgaattatcacaaacttggcggcttaaaacagtagaaatgtatcttcttggcatgctggatgctagaagttaagcatcagtttcactgggccaaaatcaaggcatcagcagggccacattcctcccagacgctctaaaggagaattgttccttgccttgtccagcttctggttgccaccagcattccttggctctggcagcatcattctcatctctgcctctgtcttcatgtggccttttcctctttcgtgtgtctcatctccgcctgcctctctcctataaggacactcgtggtggcatttagggcctatccagataatccaagaaaatctcacttcgggattcttaattagtcctatctgcaaagatactttttccttgtaaggtaacatttgcgggccttacaaaacacattcaaggcagacaaggagacaggcggtcatgtgtcctgtatgtccccttggctagaagagtccattcctaagtgtgagagagaaaggaaaagcaaagatctggcaaagaggggcaaggatttccatgacccatcatgattgtcccctgtgggttggcgttgtgctgtcttctgttagcaagaaagaggcggaggacatagtttgtgggtggtcgaagaactatgactgccaccaaggatgcgggcttccacacccccagtgtgtcagacaaaaagatctgaatgggggtctctctttttttggggaaggtaacgctgttttttaacgctattaaaaatctagatataaaggccaggtgtggtgtctcacgcctgtaatcccaacactttgggaggccgaggcgggtggatcacctgaggtcaggagttcgagaccagcctggccaacatggtgaaaccccgtctctactaaaaatacaaaaaaattagctggacgtggtggcaggcacctgtaatcccagctactctggaggctcaggcaggagaatcgcttgaacccaggaggcagaggttgcagtaagccgagatcacgccattgcactccaccctgggtaacaagagtgaaacaaaaaactccatctcaaaaacaaaaaataaaaatttatatataaaatacctagaatgatgtggcccgtaatagtaactactcgggccgggcacggtgactcacacctgtaatcccagcactttgcgactgagcgtttccctgctcagtcacactgataaaccaccatcgcctttgagtttctaactctgcctatctctggaatccactgaggaggaaagtgggcttaaggtttggtcttggattctgaaggtgcagacctcatcaccacctgctgctgtgcaaagcacactactggacctctctagaacctcagcaagaattcatacctcccaaggctgtggcaaagatgaaatgcaggcctcgggagtgctttgagctctagaccattccacgagctgctgttcctgttgtcactggacagtagggcccactgctgcttcatagcctaaagccaggtggagggagtccagtacccttgttgattctttgcttccctttcccttgtcagccacacccaccacacagacttccacatacccatgtgttgttgttgtttgtttgtttatgttcgtttgccagttctgacttaggagcaagcctttggtgctgaagttggtactgttctcactcctgaatgtaatgcccataatggatggagaatgtcaggggaattgtgggtaatagtaagattactgtcatattcccaaaccctggggtgggtgggaagaagcccctaaccatgcagctttatttccactgtgcttgtggtggggcctggaccaccttattcctggtggccttcatcttgggtgctacaggtggcaatggcaaggactgaagtggggagagtgaagatgcccgcagcatctgtgcctggccctggctcattcgtctgattggattgttagcaagccaaatatgacctggcctgcagggtacaagaagacatggaatacctggtaggcagctagataggaacgcgggacttcccagcagctgagcgtggagaggtggttccctacctggctacacatcacagtcactcagagtgctgtgctcagagaggcactttggcaataccctggacattccgattcagaagtttcttaggcaggtgtggtggctcatgcctgtagtttcagctacttcaagaggccaaggtgggaggatcacttgaggccaggagttcaaggctgcagtgagctgtgatcatgccactgcacttcagcctgggtgacagagtgagactctgtcgctacaattaaaaaaaagaagtttccaggtgaggtacaggaatctatatttctaaaagcaaccctgggactactgatgcatagcctgcctggcaaatacacagtttttaggagaaaaccatgagctttggggtcagggaaacctgtttttggtaacagctgtgctacttactagccatgtgagctttgtcagtcacctaccggcctctaaacttcagtatcctcagctttaaagctagtgtggtactaatacctgcctcacaggattgctgtgaggatgtaataagatgtttatgcacaggttatatgtatgcacatcatggtgctttaaaaaccctcaacttccccctaacccagcacggaagttcaagggcagactggcccactggctttggctctggtgcccccagccacttcccaccaactccatccatgtaagatttacatagccatggccaaattgttactgcaattaacaatcacacctaaaagcttttacttttacttttactttacttaaagggaactcttaaagagtgtttacttcatatcattagcaaatcattgttaattcttgtgatactcaccgtaataacatctatccaaatgaacatgtttgctcttaatgcgagtgtcatgtgcaatttgggagaaattctgttgtcatttagcattaattaatgcccacttactgtaaagtgttcagagacaccaatatcagcgagatttccagaccacatagacaggacagaagagctgggaaggggccagaagccactagcagggctgcactgtgactgaaggcagtggccctgggcacacttctctgctgagggcaggcaggccagccttctggctggaggatctaggtgtccacccataggtgttcagagcacacaactgggccatcccagcctggctccactcactgtggctggaaggggttctgcctctccatccccagcccttcaatcccacacaaccacctctgatgacctctcctcccagctgcagccaccttggatgttgatttttaacctgatttcacctggctgcacatgtcagctggtgggccctggagtgtgaagtgtgacttgcttgggcccctgcagccttgcctccctgcagcgacttcctgcagtttgactttggggcagcggctgccggagaagcctgaaagttgagctcaggaagtcatcttcatctccacccccaagcaggtgcttgatcaggactgtttattaatgtgttctattttctcaaatgcgtcctccaaaacagagtgtgtgtgagatactactcctgtgcctgggacagtcagtgtgacagtgaacagtgctgctctaggtgtggggacacagccttacgttccctttcttccaggcagctcagtgtagtggaaactacaataactgaccggggctgtgcccaccagctgtgtgagggggcctcagttttcccacctgtaaacggggctcactttacccaccccgtggaatggtttaattaggtgtgatgaagtcctgcatgccacaggtggtgcttagtagccatcgccttattaaaaatgccagtgatcaccgaggatcatgatttccctccccttgtgtccacacctcagacacgtcctctctccttctggaggggtaggaacagaggaacagtgcctctcacctgaggagggaacttctctgaatccaccaggaaacccagtcacaaatcacacagaagcagtgttcattttttctgtccacaaccaatatgactaaagtacggtggaaagacaagtattttttgtcctggtgaggaaaggtgccttgatatgtactttttttctgccttgtggatggactgcattggacagaggtgggggtggtggagggagtggaatttaccatggtggtacaaatgagtcagtctgctcaatagggatgtgtcccatacagagccgcagatgcctggtttaaaagactcaggctgcagttaactatgctaaactcaaattttactgagtggaatttagtctttctctgatgattaaaaggcccttcagaatcttctgagccgttttgttgaacagtgcttttttgttacttcctgggtgtaggaaatggtggggaacagagggttttgctggaacacccactggacttgtgtgtcctcctctcggtttctaagggcccctcaggccacacgcctcccatttccaagagagtgagaggggcctagaaaaggctgaacacaaagccccacaaccgccaaattccctttcaagggtgttacttagtaaacatgagcccttgagcccacattcttccagactgtgtctgcctcaggccacccctccttctagaaggagcagtgggggccctggcaggaggctgccggctcagcctggagtggcccacagcaatgctccaattcacagtgaaatgatttcctctgcctcgtataatttaacctgcccacattgctaaacttctatattacacatttctgtcaggatgtcagaagaaatgataagcctccttgaaacagcaacctctattacatgctaagagcattgcgcctggctccccccagctctggtccttctggtatgtttctgagatttttagcatggtctctcaagtataaagaataccctacttcatgaccccagcctcttgttagctgatagatgaaatcttttctaaagctgactctcttgtctattatgttttcaaaattcaaggttttagattcttggatggctgccaagtggccgggctttcttagtaggtgaattgctcctctctttttttgatccttaaacaggaagtagttgttttttagggtggagggaagcgggaggcatgttccacctcccttctccctttgttgatgtttccaggcaattggtggggaattttttcaggaatttctcctcggggaccatactttaggaataaacccaaacacggaaaagccatttccttgtctggtgggagcttgtgttttctcgctagattgtgtcacccagaatttgttgtggagcttcttgacaattgtgctgtgcacgtgactgcagcatggaccactgagggggaatagcaccaagctgctccatccacacgggagacacttgcgagatctcagggccatggacagtgcagctgcctgtcgctccctgcaacttactcccgacccgggcctcctcagagacagccacaatgcagacagtccacacataggatggctcaggactctcttcattattagctgtggttgtgtggtttccccgggagagagaactaagactgagtttcatttaaacctaaaagtgaggaagaacagatgccatattcctacccttagttgttaatttggattacaaacacccatgcttttcttcaggtcattagtcatgtggcttttttcttctttgtctcactagattctgtgggaacagatttctttctgcatagcatttagtggtgggaaaatgatgtttgctgaccatccttgaaattgaggcacaatgtagttcttgattaggaagactctggaataagcgcccaggagaaatggaaggtgtttggtttccaaaagtggtaccttcaactctttttgtaagctgagtgtgtttctctccaaagttcctagcccattagtgaactgtcatacacttcaaggccagctcaccactccgatagctaagctgtcatacatagtccagggtccgtgtgagccccagctcttttaaaactcctggctggctgtgtccagagaagacattcttatcagttttctcagttacttttgggaaaccatctcagagtgtaacctaagtctaaactcagacaaggcactgtgtgttttacaaaatacacatcccactcacctgggcttaattacctgtaaaactgaagtaatgaaagcagtgcctcaggcttctttgcagctcaaaggggatgggccagggattggaatgtagacctgggagcttcctttgggtgcctcctggatgaactgcactgtaggttcagtgagactccttccgggataagccaaggacaacagagccagactgtggggcagagggtctcatggtcctcatggcaaagccagccccagccctcagtgtgccctcatgactatgagtccagtctttacaacaggaacataacaattctacagaagggtggaggatctaacactgaacaagcaaggccccatggaccaggcccccaatagacgttacttcattcagtcatccccacagccccgggaggtggaggcatcactttccataccgtatagaggagggaactccccaccaactagtgaagtttaaaaccagcattccaagcagggctgcccagctaccctgcctactttgtcctgttgctgcatcttctctctgattcccctgaagtctgtgcgaagtgccacaggaggtcgaaggagggaccagaaaggtgagggtttcccggaagtagtggaagcggaccgtgtcctgagaggtccccagcccgagaaggaggcagccaacctcagcaaggacagcctggtctttttttttttttttttttttttttttttgagatggagtttcgcttgtgtcacccaggctggagtgcaatggcacgatcttggctcactgcaagctccacttcccaggttcaagtgattctccggcctcagcctcctgagtagctgggattacaggcatgtgccaccatgcctggctaatttttatacttttagtagagatggggtttcaccatgttggccaggctggtctcgaactcctgacctcaggtgatccacccgcttcaacctcccaaagtgctgggattacaagcctgagccaccccacccgctgagcctggtcttagagtggggtcagcttcggcttcctattgtgagaatcaggcctctggcacttatcagccctgaggcctggcttaatttacttcgaatgtctctgtctccatttcctggtctgtaaggtatcactggaagtgttctcaaccctttagtatgctttagtgtgagaaagcttgtaaaaatgcctgcatggtgccttgctggtgcccagtcagtcctgcatttctcggctctgcaaaatcacagacacatggaatgggatggtatgccccagaagaactgggggattgggagacctggcaggtgtgagccctgggtttgggaagggcagaaggtaagtggtgacagataagtctaggaaggcatttgggtgtcaggtcataaaggaccttgaaaaaccaacccctgggttagttgaagctttggtttagtttggtttcacggaggaacaggatgatgagatttttctttaggggaagatgacggcagcaataagagtgttggaaaagtcaccctgaacaacttttgtaggtaacttaagggcagaaaaaaggaactctttatttttcaagtggcatcatggctatcacagctcatcagtgcctggaacaacacctttaataatgtcaataggaacgcttcgaactgctgcagaaattctgcttcctgaatgtttgaacttaccctcccatttaatctttaaaccatcccttcaagagagggaggacacaagggtttttctcaattatgtaccactgtgagcttggcttagttaccaaaggctgatgatgggctcagcagtgggatccgagtccctgcgttcccacccaggcttcccaccattttcctcttaggtgcgcatccgctttgaagctgcattctctctgagacatgtggtggtaatgataatgttaatactagtaatgatcatagtaatcgctaacattgagaaagcatttacttattatatgccaggaatacgttgctagttttgaattgttttgtgtaattatcatctcctctttccaactaagaaaactgaacggtaatgagataaattaccctaggacacataacaagggtgtggtaggatagaaccacacccttcccaggtgaggagttgcctgtcatttctcagggtcctccgtggcacctggggacaggtggaggtgggcgtgggttgtcaggacatcaggggcctaactctgactctgcgtcaatcagagaagcttgatttttatctgtttcattggcctttctcaaaagagttgatttgagaaagtgttttttaaatagctttttaaagcggaaaggggccgtgtgcgctggctaatgcctgtaatcccagcatattgggaggctgaggtaggcagatcacctgaggtcaggagtttgagaccagcctggccaacatggtgaaaccccatctctatgagaaatacaaaaattatccaggtgtggtggcatgcgtctgtagtcccagctactcaggaggctgaggcgggagaatcacttgaacctggatggcggaggttgcagtgagccgagattgagtcactgcactccagcctgggtgatagagcaagactccgtgtcgaaaaaacaaaaacaaaataaaaataataaaataaagtggataggggttgattggggtttttcttttttggaaaaaagcaattaaaaagaagatggattgatagatacataatgagctgggtagatggggagacacatgataaagcaagtgtagtacagtgttaataaagtcagtggtgggtatataggtattcactctaaaataccacttttctctatgtttgaaaattttcataataaaatgttggaggagaaactagccaagtaaataatttctaagggcccttccaattttttaaaaaattttatttcctgcacttctctctacatcctatagttgtgatcatgtacaaccatgacgtgatcattaatctagatagatctcctagtcaccactggatgttgccactaaaaaaaaatctaggctgggtgcagtggctcacacctgtaatcccagcactgtgagaggccaaggtgagtggatcatctgaggtcaggagttcgagactaggcagaacaatatggtgaaaccccctctctgctaaaaatataaaaattagccaggtgtggtggcaggtgcctgtagtcacagctactcgggaggctgaggcagggagaattgcttgaacccgggaagcggagattgcagtgacccgagattgcgccactgcactccagcctgggtgacagagcgagactccgtctcaaaaaaaaaaaaaatctgctggggagaacaaagtcaatcatcactcatttggttctccaactacctgagcctaaattttgattggcaagtttggttgggttcagatactttcactagaaagccgtaggcctgtgagtctccagatgaaaggtgggtttagatctacacatctcctgtttcagggcagtgagctgttttggacccatctctagtagaagtttcttggagctctccagccacaataaaggtacagtgttcctgttcactcactttggcagagccttgaaaaggagcacagagacggtcaaatagtaaaatctaaaaacccgtagaaaaccctagcagaaagtattcttaaagacccagctgtatttttctgttcataagacccagataagcatagtcttcccatttgacattctgactttaacatgagagggagtttcatgcccccttggtaggacattggagtacttgttgcagcgtgcaagaagtggactttgtccagcttatatttagaataaccttgccagcacattccagggagttgatcaaggagttttgccaaactgtgataaatcagcacattgagcagcctctgatggctgataagcttgggagtgccagttaattgacaagaaccgcacttgtcaatcttttgaggtcatggaaatggatctcttgtctttctgcccttccccaagtcttcacccgcttgctctttggtagattgagcatggccttgcactgcatggagcacacctcccacctttgttcttgtgtgtttgctgagtaattaatctcattgtgctagtatggaaatagtctattaaaacattccggaggacaccatggagagggaggaaggaggatgaagactggcggagggagtagtttgctctgtttaattggttctttcacctaatggtagtttgtcaattaaggggatacttagagaaagtgaaattaatccatgtgggtcaaatgcagctattaatttttaatcaaaacacaatgttcaacaaatctgtagctgtgcttagtacaaatgtaagcatgccaccagcctcttcccaaaggatgtgggagcaggcacaggaaaggggggcctgttaatctagcaaatgtttgcctcctcccacactccctgtgaccctgaggtaagctccgcagagcttcgttcttgtctcttcaccatctattgcattgcctaacacatggtagatgctcagtgatattgctcttctggaactctttccatccctattatgtgcacagctttggagtacctcaaataggttttaggcataacagctattctctaagagctcctagcctgcttgagaaagcagaggaggcagttatgaatgcatccccaagtcactcagagcaacgtacaatcaagtacaagaatgtgtgataaaccgtggcatttgttgagcacttgctatatgccagatacttttaagcacttcacataaaccaagttttttaatctttgcaacaacacaataaaataagtaccatttttatcatcctattcataaataaggtcactgaggcccagaacatttaggtaacttgcctagggtctcacggctagtacaattagtctgctagagggttgcattcattacctaatattataagacccagagttgtcccaagagagctggcattgatcaggggttaaggtatgagtttattttggaaagtgccagaataagatgctccaggtagttggaatggtaatcagcacggttttgtggaaaaggagtgcatttctggttaactggaatatgaggttggtgaggttgaggtaggtctaggttaatacactttcagggtcttggataccaggatgagaaattttcatgtcggttattctgggatttctttattgtttatgggttgtttcactttggaggagcaagtcccgttcctctatttctgcacttgggcattgtgccctcatcattatctctcttacctcctctgcctccctccatctggcatctttcttctcatttatggcatccttagctcctcctgcttcccatttttagagagagggagagagaagagaaaatcaagaaagtacaccagccggcctacttctactgactttcagaggttgaatgaagcttttctcagccctctgccctcacctcagtttggtcctggaactttgagaggaaaaacaccagaaggacttggcctcaggaagttttcttctgcctccccttactgagcagaaagcaggttggaggaaccacttggctctgtgacatttatagtgacatggtttggagaggtcaggaaggactgtcccagtggtgtctcttcaggctgctcacaactgcctgaaacctctcagtaggagaggtttctcatgatccagtgaaaaatcaggcttcaggtgtacatagtttaggataggctacagggtatgttaaattccttcacattggccagaagctggagaaatgtgaggacaggtaaaatccttggatattttcttctttacttccaaggtagcttacaacctggcctcttgaagtcattgggctgatgataactggtggaaatttgcaggtaattgccaatgacaatgagggagagaattggggaatagaggggccctatgaagaggatcctctgcctcgtattccatgcagtcctatgggctgctgcagtaaacctgggaggtcatcaggattaccacaaagactcgtgattgggtgggtgtccctctgggcagcctagtttccctagacatacaacacgtgttcttctccagcagtgcaaagctgagaaggggcctgagtaatcgttctggtcttgctccaggaggcaaagccacagctgtctgtgtacccccatgcaagtgggcaggaggggttccagcaaggctgcttgctgggggagacagggtggagggaggaacagcgactctggatcatagagcagaggtcagggaagcacagttaggatggaaagtctcgggcagaaggtgggtagaggtggataggcagtgtacatggtgtttcaccatgtcatcttgaccaggaacacggtggagagaacagatatagctgactctgtgtgatcagtgattttaaaatgacactagtgtcagactcttaaccagcaagggaacacatcttgtaaatctgggaaaactaggtagcccaaagggacacccacccaaacaagagtccttcatgttgaagaagaagaagcacttcttgataaacaatgaaacaagctgatatggaagaaattgttatgtcatgggaaggaggacatttttggtacctaatgattaatatgaaataataattatgtagtgattatatccttgcctctcaatctaagaatactcagaacattgtcatagtgaatttcagtatcttctatgtgaaaagcagcttagctagtgatatctgttattcatgcattcattttttctttcctttgccatatatttaccaaaacctaatctctgctaggtagtgaataaggcttttgggatgcggcaacaaacaaaatgggcatgttcactgcccttaaaatgtaaggtgaaatacaacctttatagtgtccactttcctgcgatggttaaggttttcttcgtggacaaatacatgatcaattctatagctattccatgcacatataaagaaaagtgaataatacctgttcacaatctcaaaatacctgttaaataaaatgtatcaattttaaacattagtgtgagacaaaaacattaagtaacagattgtgtgcgtgtgtgcaggcatgtacagttagtcttgaaaagatcaattgggagtcagtggagcatttaaagcagggatagacatgatcagatttgtcatttaaacggtaactttggcagctgtgtggaggacggattgagggaggccagagtgaagatcagcagtgaggagagactgttacccaggtgagagaggatggtgactcagagtaggcaatgtgggggctgagagaagaaaaggagctaaattcttcttggagatcaaataagcaagatttggcaactgatggaagagaatgtaaaacaattatctacttcctaggttggttgtgggaactaaatgagacattattcgcttcattttacaaacaaggaaatagagactccaaagtgattgagataaacgtctgacttccacacagcctttgatctctctactgcacaaggcataaaaagggtgtaaacagaggtagattcacccaggctaatggctgaaagcctcaaggcccttcacttgctgggatctcatccaaggcctcatacctaattttatattcataactttgtattcattttcttaaaaagcaccctccacaagggtttaagcttcagactccaggaaacctctatctacctctggccaagtaagtaacctcattgggtaggactgaaacttgatgggatgagacctaggatcaaaatctgacccagcaggcagagaaagtagtgtgtttaggttgggatcaactgggagagaaacagatgccatattggaggcataacaaaaatataactgttagtgtttattgaatacttcttgtgtcaaacagtgtatttattgactttgattttttgggggaagtttcttgtattatatcacttaattcttatacaacccaacagggtggttgctttcattatccccattttatatgtgaggaaagtaagccctggtaagagtaagtaaattaacaaagtatcacaatactaagcaggtgagcagcactggcatcttacaggcctgactttgatgtttgaggctgtccttaacctccactgctagagggactgtggtccgaagccagcacctctgatagattcttgacatgtgctgggcatttcctctcctagaggttggaggaagcaaggtctaattctgtcctgctcctttccaaaaaggaattgcttggtgaaatgtcagtgggagaaagtaatcaccccaccttcagatacagagttgaggacttatctgacatgtgccggagaagacaagaagattctgaggcttgaggccgaaggagggcatcaagagactccagcagccttattttgttattatgcggttgttattttgactcaacagttggctctggtgaaggggagagatggggcttatatgcaacaacaagtgagggcgatttgagggaaaacatgtgacccagactaggagcattgtgtccacattaactgaagctcacagaaatcctaaggataagtagggttttcagcgtaattttgttttttatgttctgatcaagattaagaaaaggaggctttgtcctttgatggaaggtgtggtgttgatggatgacccagagaaagcagagaggttcacctcctgctctaccttcctgtccagaacatgatctttagaaggaaaggtatagaattttcttggcttaaagggactttagatccaagatcagtaaagagattgccttgaagatttaaatgagctcacgttttcctgacctggacaagttacctccccacatgctgagagatcttgtaaatgaaatcactgacccctccctgccagagatgttggagaaaggtgggacatcaggagagaggctgggagactagaggggggcaaatacattgcgaaatttttaaagagaaaggagtgttctgtagccacaggtcagtgagcatcaggtgctctacaggatcctagacccggtcagcatggagcaggctggtgaagaggaagcaggaatcaaagagtcgggtcactaagactggtcactggagcttagcacctttttttttttaacaagcttactaggcagttaccaaaagtggaaagggcagtcttactccctcttctcaaggtcttcgacaaggtcttttatgaagcctttgtggattcggtgggaaactgtggagtggctgcagcaaattggtgaatttgttgaactgaccaagttgatggtcgctctacagtttcgtcacgggactctgccctatataaaataatcgtcagtagttgggtaataattattctgcaccaaagttgcagaagacagaaagttgtgaggaaaacagatagcttcagatggccaagtcagaatttgaaaaagaaaactcattcatacagtcaacaagtatttgagtgtctgttacatgccagtcatatatccatcacggagcagctacttctgggttgattctcctagtatggatggtaagcaatgaagaaatgtgtgtggtgtctgcatgcaatgtcagatgatggtaaagaatatggaggaaaaatttaaagtcttaggagataagagcaaggtgtgaggggggtgctattatgatacagtgatcaggggcagcttctctaaggaagggcccaaataaagagaagctggtagatacccacaaatctgggggaaaactatacctggtataggcaacagcaagagcaaaggccctgaggctggaacatgtttggcatctctagaaagcctgagtagctggatatcagtgagagcaagcatgagaggtcagagcacagcttgtccttgcaggctatgggggatatcagatgtcctgagggagagggaagccactggaagcttttttgatatataattgataagatccgactcgtggtttgtttttgttttgttttgttttctttttaattgagtcagagtcttgctctgttgccccgcctgcagtgcagaaatgtggtctaggctcactgcaacctccacctcctgggttcaagcgattctcctgcctcagcctcttgagtagctaggaatacaggcacccgccaccacgcccggctaattttttatttttagtagagatggggttttgccaggttggccaggctggtctggaactcctgacctcaggtgatccgcctgccttggcctcccaaagtactgggattacaggcatgagccaccgcgcccagccaggttcatggttttagagactcagtctggagataagcttagcacagtgtgatgggctggctcttcaaggatagcatgacacacatggcttagcaatggtagatgcgagaaaggcctagaaattttagtaaaaattcaccctaatattagcaacagtgttatttgcctgaggaaaaaactaacagtattaaatggtatttggtatttacagtgactggtagggattggtttttaccctccctcccctgcccaatctctgaagtcttttaggataagaaccgattggttaacaaagcttcctggatgaactcagcaccttattcagctggccactgccagccccaaccaacagagaaaggagcatcagtgaaccagttctggtgaaccagttcaccccactgtgaaaactcaaaacccaggagatgtggtagatggaaataaggatgtttaaggtaaagagagcctcatggtcaaggtgaatcactggattcagatgtttggaagtctgctcaatagagagaggagattaaatttggccacagcagttagtactgtgacagatttcttttccatatataaaatatgcttcctagagtcaacgctatctaaacatggactgggcccacgcagcatctggctcatccctggacgtgtatgtaaactgaggctggataagctttgggtgcagttatgtagagacttaagtcagtaaatggacacaatgcagtctgataaaggaaagagggtggaggcggggagacaatcaggaggagaaaagaggcagagaagtagaagcctgtggttgtggagatggtctgtaaccccaccgggagcagcagcatctgaactggttctccccttgctcccctttcttttgccctccagccaaaccagtaacaaagggcattgtctagtagtctgtgtcagcaataaaagccatggggatctgacccgcggcagtgtgtttcagcctgcgaacttcctggatatctttacggggaatcattcccggggaaggaagggcaggctggaaataatataaggagatcaagaaggaagtcgagcaagtgacacctttaaacaggccaagcgagccgggctcttccccctgggacagttagagttatgcagagctgtaattaacccagcagcccactggatatgtctatttcaccgcacaaaggctgttgaaagaaggattcttgaagaaagaggttccaattcaaatggtatttgagtaagtcccttgtcggatatactgtttctagagtttatggctataatcaacaaaacatggccattctttcatgcaggtttctcatgactttctgaataccaatctttagaaagaaaaggggaaaaaaaaggcatccagaattgtctaggggtagaatgggggaaagggaaggagggggaaatatggctcgaatcaaattaaggacttggttttcttttcagaggatgttgaaaacatttaaaaagcaggtgtgtccttctttcataaatgaagactctgagatatgtaagaaaattttcagttgtgtattcaagtccctcaaaatcattttatcaacctccctaatttcaattaattttttaacaaatattttttgtatgcctaccctatattaggcactattataggcgctggggatattaatatctctctcctgccttcctggagctaatagtggggagagatagacaaaaacgtttaagtatgtagactaattggtgtgtgagatgatgtgctatagagagaaaaatagcagggagggaaatacagtggggagggatgcaaggaaggccttgctgagaaggtggcatttaagcgaagatctgaaggaggtgagatgtggatccggtgggtgtatgcgtggtggggtcagcgggtggggagagacagcagtgcaggcagtgtgcacagggattcgtaaggtagcagtgtccatggtagtgtgtgtgaggaatagcaagcaggctgaccgggccagagtggagagggggagagccagagcactgggagatgagggcagagaggtcagttatggctggagtctgcctttgccctcaataaggcacccattcagttactcaagtgggccagcacacagtggtgtgtcctcccacatgctctgagtactggccattcagaatggttcccatcacacttaaaaccgtagagaataaaattacattgtcactgtgctactcttcacccttggatagtcctagagtcctttggcgtagcttttacatagtgtgccacatcccactgtactccctttcctgagaacagactgatggaccgagttacgatttatatgagagaaccccaaatcagaattcctagccatgtctaatttatatatcagcaggcaagttgttttgtttcttgtttgggttttggggcttctgttttggggtggggtttttttttttttcccagtaccgtaacttataatctcagatcatggaagagcattctctaatgagctttctaaagccaagagctctacccagttgctgggtaaaggggggaacatggagaattagaatgtttacattgtaactgatttatgtacactatatttgcatgtaagtgtactaaaatattttttaaaattaccagccattaaaaatgtgtttgctaatggggataagaatgctggatacaatgaggtaagctttgtttaaaaggatttaggagactcacaattcataatcaatatttcaacacactcgtctgcatttttagggcaatagatctgtaagtagaaacaggcgtatttgaagaaaaacattagtttctgagatctggccagctcctgttcttaccactctgtcatctctgattggattagacgtcacagaaagggcctcagatccttgtttcacgttaagtttaaccactccagttgaataccatccttgtggagctcagtggagagaaattaaatttctatcaccagaagtatggcactgaatcaggtatcaagggggctacatcagtaaacttcgttggctacaagatgtatgtccttcctgaggctctgtagctgttaagttggctctttccaatcacagtctgatctttcattttcccgtaatgcagttagacaacctagttattcaggcatagacttctctgtttttcattatccctgaataacatttgatgctgaaatagggaagacgggaaggacgggggaggggagccaagcatttttcacagcttgtgtgaaatgcttaatatttgaacgtctttaaaatatactgtacacatacattccaattttataagactaacataacatgttcaaaagttttatgaatttcagcatgtaaccagagtaaacgttagcctgttttaaataagccataatggcctggcaacaaacctgcatagttagcaaatccctcctctgtttatgggcagccattcctcaccaggtcactacaaaatacaagttttatcagtttctgtggactccgtaagttggtctgtgtactgagttcagcatgaatctggttttaagagcacaaaaccaagggcatcatgatgaggtgatatttcgttttgattttaatgaaatggcatgaatctgacttgcttaagaatatgtccaggcctctcgtatcctgtgggggcaacttggttcctaaatgccttccgtaagcacagggccacacagacgtagcaggcttaccccttcctcactggagtcaagagagtgctttgtgcctagaaaatgtttgtttttttggtggggcttttttttttttttttacttaggttggaagcgccccccagatgatgctttttaaggtaggatctcctcttaacaagtgagagcatcaaacatgctgggtcatgcccagttccatcccatcgtgtgtcctgggtctaaggtattagacacagtcatgcctctcaatggtgaaggttctatgttaccagatcatatatttcatggaaatctgctagctcaccagataaaatcctcccagcttcttcaagcgtggcagaggagagagacttcccatgtgttaaaaatctgctaaactttgcagccccaactcttttgcccgtagactcaccctggcctcagccatccctcaggaatcatctaccgtagaccaaactggcttcaggggatattccaacccctgatgtactctggcatcaaaagctcctttaattacaaataggacaccagagaacaggttggagcatttaaataagactgatctaaaggctgtgggccaaagatttctcacagagggcaacacgtaattaggtaatctgactcacaagatgaagtttactcgctttcattgtggtgccccccagggcagccttccccacctgccctctaggcctgtgtccttgtagcacttaccacttgtaagcccagccttctgggagaccctcagtcaggtccagatgcttccagaggccgactccagactcatccagtttcttctctctttgtcttataacagtcatggtcctcattgctccctaaaacatcctacttagtatttagagctcactatacatctgttcaaagcttggcttttggaagtctttattgtaccagtcttcttacctcctgaaataaggaaaatataagtataactgcccacagaggcatataaaactcctttccatttacctcatttattcgtcttatttaggggaagcgcagttcagggtgggcagtctagtttaagccattgagtctagtttaagccgttgttcaccatcatgattttatagcctttagttttattccctgtcagccatagacatccccagagatgcaagaactcatgcaggaaaacccatttaattaggacccactgtgaaggaccaggaaacagaccctaaagcactttatgacggaagctgttgatcaggaaacaggatgttttcctttccctgggtttaggtctggctcatactcctttggggagatctgggggcctgtctccatctccacggaaacagaacctgtaaccttcccagaatcaggttaccctagagggcagtgacatttatatctgcttttttgtttgttcgttgttctctttcctaagacatgtaagtggcaggttttgaactcctggatctctgcccaggggcctggcatgttgtatatctgccattctgatgtgtggagggcctcctgtctacactctctctgccccatggctagagacagctcattctgagagattctttttttataggaaggcaaagctcacctatccctaacatgcaaaaattttcacttgaggaggcggggaactggtttagtaaagatctttgcgtgaaattgaatccagtccttgccatccttcatgttcaactcaagtcctccttctataatgaagtcttccccagccagaagtgatctttctctttccattacatcagggccttttccacattcccacctttcccccctcatactgttgactagttttatttcccattagtgctttgcaccctagtgctcctaggtccatttaaagacctaaatggctgggatcacatcttctacttggttatttcccccacagcattcgatcacttataaactgtgttaattttccccacagtgcctcacatagagtggtgctcaattacaacttactaagtccatttgaaaagaaatacactgttggtcaagaaatctgtgtgctgagtgcttcaagggacacaggcagtataaatgagacatcctgccctcagggaatgtatagtctgagtggggataagacgaggccacatgaaaagtctactaatagcggccagggaccatggcttcctacaatacaagcactttgggaggccaaggtgagaggatcacttgaggccaggaatttgagaccagcctgggcaacatagtgagaccctgtctctacaaaaaactttcccaggtatggtggtgggtgcctgtagtcccagctactccagaggctcaggtgggaagactgttagagcccaggaggtgaaggctgcagtgagccaagatcacaccactgcaatccagcctgggtgacagagtgagactgtgtctctttgaaagaaaaaaagataaaaaaagcaaccagtaatacaattccatataggatctgggccagaaaaaaataagtactgattgtcatgatcatggtgatacgttagttatcttgggtatatacactgtttttacccatccccataacaactctacaaagtagatggtgctagacattcttagtctcagctctcttgtctttagagtgaggacaaatgattcgtccagtgagtacagagtgctgggattcagacagctctgtgagccctcacgtgaggctcaccctgggttccaatggctcagagcttctcctcttgcttctctctcattacccttgtgccctgcccactcccaacctttcaaatatattaaggaggattaaccatattgttcactgctattaaacaagaccagagacagagtctttccagcagaggtgacaccttggtgtctgaatgagaaaggagttgtccaaagacatctgccccacacagaagaaaattagacatatcacatgcctgctttgttataatggcataaaagtatgtgtatgttttaataagtcatgtactgagtgtactcagactatagcatatccatgtgtattacggtggttaagagctcatctctttagtaacaaacaggggttcaaattctgactttaccacttacaagctctatagccttcagcaagctagttaacttctcaggacctgttttttcattgataaaatgagtggggtaatacctagctcaaaaatttgttgtaatatttaaatatgaatgtaaagcacagtgcctgaggtcactcagtgaactgtgattgtggtgagcatactgttatatcccttcctgagccacagaacttgaatttgtgttcagagctggagactccagaacatctcccaaagggaagcaatttaaagttgaagtagcctctcccttctgtcagtgaggatgccaggtcttttctgagtttcctgtaagtcctctaggatatgttactttggataaagtctcactactttgacctgtggaaagaaattactgtccaagtacacaatttattttgacctcccaacacctttggacaattccaggctggctccaggcttcatcagaacaattatgtcctctctgtggaaaacattcctttcaaatgaatcagtagttactcaccttttcttttcccagccatatttttcagttgccaacagtgggatcagtgaggggtagtggtgtagctaacattagcccaatatagataagctccagattatccgtcatcttgtttgaaaaaaggcaggcctgccaaatttgcctacagttcccagtgagggaaagaaacaacaggttctatgaagaggaaggcacagaactagtcgtggaagtcacttttccagactccctccgttactcaggaggaaacaaacccagagtgtcttcttcaaggttaaactccctagaagctgatggaacctggccagaggctgtgaactttgcacagagggcatcatcagaatcaccctctgctcagtggatcgctgccctcccattactctgctggcacgtacctgatttggttgacatttccataattaatttataacagcaataaccctgagatgagcctatttataggtttgtgcaagctaggtaagaatatagattaaatctcagatcattaacatacttaaaggacttgggagagttttgtgattgtcaaatgatgtgattaaaaggcctccaagcttgatgtgtactgggaatccacaagtttactttccttgccaagctcagaaacaacaaaatagcaaaagataagcttacattccacccattcaccaaagatgttgggtcatccggggaactggaccagggtcatcactgatggtctacagctgctgccccacagatgaggatctgtgagcgtggttctgacccttgatatgccagcaagtgtggcaccaagagtcccatgggaagaattgctgtgactgtccacagcaatagagatgagtgtgagaagcacacctattagttgaaaggatgctattatgacctggactgctgtgcagacccaatcttactttctttcctcctttttatgttctgttgttctggttgttaaccttctgaaaagtaacatggattgcttttctattataaaagtaagacgtgttcaatatcaaaaataaaggtaagtacagagaagaaaataaagatcactcataattccaccacccagaaatacccactgctgaatttcagtgtgcatccttctaatagagtcttcattctgacatcatgctagtagaactgttctctggacacagaggcctcccattcaggtgcttgctttgacagatgtgtttcctactgaggaaagcatcttatactcagggggtgagaatccatccatcaagaagaaggaatgactaagggactccctgccttgcctgcaggaggctcttcaaaaaactaccacccagaagtagttccctctctctcttctttttacatttacccagaccactcaaccctatttatccttttcttacctgtatatgcaaatatgatggcaccaccaacgtcatccacctctttcgttcaagaccataacttcttttaaggctctcatgagtccttcacaccaccctccagcatagagaagggctcttcacccattattcccattactagtgttcaagacttgtttttttttttttgctccagttttttattagcaaactagctacaaaatgctgaaaatcaagttaaagttaatacatataagatcatcataaatgattgcacatgtacacagataattattactttcatttgttttattattttaatctacaaactttgagctctttaaaagtggagattagatgttatgtcgccagacccttaacttcgcacttggcataatataaatacttgattaatatttattgaattaagatgaaaatgaagagaaaatttaattacccagtctactttttttttttctatctcagtagttaagtgcagagaaaaaggaggtcatataaaaatgatgaaaaaatagtaccttagaaccatttttatggtgtatcagtgcattttttgtgctaaggtatcactgttaaccctagtgtggaccctttttaatgactttttaaaatcttgacgatgtccttttcacttctttcctaaatgaacattaatataaagccataaaatgttccttggagggttttatgagttactgtgttgtaaggttggggaaaggacacttggagccatttgttttatggagcttgattctgaagtccagcaccgcccctgacccttcagaggcacgctctgaggcatgaagcctttcttgaggacagtgagcactgccacttctccccgaaatacaccagccacactcctacacttgccacttccccggagtccacagtgtcaacctcaagccctgccctccacgagtagcctagacaccgtggagcagacgttactgatgatgcattgaacagctcttcttccacagtgcagatggattttccgttcaccagcatgaatcgcttttgccatatataatatcatgtagtacctgaaaaaaaaaaatgatgccaaagactagagatttggtcgaggacattggtttttctggctctttttgcctccggaactcttcttcagtttatatcagatgtggaagggaagcctaatctataaaacaaagatgggggtttgagtccccggggtttcccctcaccactgtgctaaccctaaatcagctttcaccacttacttgaaaaacccagggcccagagaaaccaaggtgtgagagtgtgaaaggtaagtgcaggacagatagacgataacgagggtgatataaataataatagcttacatttttttaggtcttcttgtgttccaagcactgtgctaaacacagactgtccccccaaaatatggcaaattgtgatgcctgaggcagagtatggtatggctgtctgggaactcttgaaaaggatattggattgcttgcaggcaagaaacaggccagattatcttggcagatctcgctctcactgtggttcttagcctttattacactgttggaatgggtttctcacaagtgatatcaagggaaaaaactagacggatatgtccagtgtatgtgtacgtgtgtgtgcacatgcacttaggacaactttgagccaggagtgtgagccggattagcacactgagttgtactttattctaacacatgcagctcagtagaagtctcatcttaagggacatatagaatgttgaggtagaaatagctcagaagaaagttgataaagtaataggatacgtgcttttgccaatctacatggccatatccttgcatgcttattttgacagaagagtcacagaacagagcaagttcttaaggctcattcattcccatttccctcttgacattttgagcaaaggactggagggaccaatccataaggggaatgcacctggtcatcttttcctgagcatcttgggatcaggtgctcttgggaataagatgatacgtatacccaagagcacttgatcagtcaggcagtgagtccatcaatccacagccctgttctgtgctggatcccatacctttgtacctgtgtggcaggagacaggaaggatgtgtggtggaaactccaggaacttagtccagctgaggagatgatacagacattggaaaacataatggaccaccaggaaatgataagcttaggaactcagagaacatcatttctaggatgaccagagaaggcttcaaggaagaagagaaatttaagcagtgcctcaaaggttgggtgggatgtgagttactcagctggggcagggagtagtctttgcagggagggaaactgctgaggaaagatacggaggtgagccgtgcacattgttcctgttggaaccacacatgtgtaaaggctctgagatgagtttagtgagagttgaaggctcatgttgaaaaacactgtgagaggcacacccagtacagactgtggcaagtgttgaatgcctggcggagaaacctagagccttttaaatagttctgagcagggaagggaggcaaggaaagcagttaaactggttcagctctcaggacaaatgtaaaatgaagggctcatgcttgtgtgtcagattgcaggtttgcttagaaagcacagtgcagggagaaacccgaaggagcaggattctgtcttctggagccctaaccaagggaggccgaagttggtgctttcattgaacgtccatgttctgacatgaataaatgccacgtcatgagtttgtggtcaactcctgtggtcaacttttaagcaagctttaaaacaacagcaaattgcttctatggaatttctcttacagcatcttgacattctggaaaagccagtgcagcagtcaagggagtaggtcctgtcctgtcatttacccaggcttcctagattcaacacatccctgtgggtcccgtcacacatctcaccctggcccatttaactgagctgggcctactgcagaccttcagatatttaatttgtaaacacttaataaagcactgtcagtaggtcggcttgtcttctctgtcggccacatcaaaatcaatacgtcccctgtgtattctgccatgattgtctgggctggggaatctaataggattaagtgtttggggtcctatctgacgccacagtccacagtcctagttagatgaggttaaagactggcttgccattgtggaggcacgattgcttaggggtctgaaaaatcattaaagcttgtcctcttaaacgttgattgttccctggtgatttattgacaaaacacaaaaaagtgctctatactgcactctaattatatgtatgaggccataagatctcatgggaaattaaataaaatttacagcttgatggttttatgctcctgggagacataccttcttaataagatcttatagctgggaatatttatgaggttaaagtccgtaggcttgagcaaaagacctaacctttccatgggaggtggggatggggtgcgttttgatttctttgaagataaatgatcgtaatgaaattttcaggggtttaggaaaaagtgttcagtaagacacatcaagcatttctccttaaaacctctggaggacaaagctgtaagggcacggggatttactgcgaccatttgtctcacataaggcccccatagtcctactccccacctctggggcacttcgtcctcctcctgtactctctgtggcttcctcgtcttattagcccccatcacactttgaaaaggtggggaggatcctaattaagggcaatgatgtaagaggtcaaggaagggaaaggaatttgagtaaggaaaagggagaaagactgagagaatcaatacatgttaagacagcccccagaggagtcactggacatttagtattttaacgggtcaccttctctttatgttaagggatggctgaggaccaggctcagattccacaaggattatcctgtgctgttctagacaaagaatcagagcatatctgggataagagggatttggggggagggcctctgcaggtgtcatgaagatgaagatgatatttatttgttacctttcttgactctgaatagagtgcttatcccaacgtctccgtgaatcctaaacgaagcttcatgcttgaaagtgggctgtttcaataagagtgaggagcatcgtttatgcagccccattcctgctgctttctctaatagttctgaaatggcaagaaggaggtaggtaggtagatagagagctgtcatatatatatgtgtacacacacacacacataattcctatgtattgaattatatttttatctactcaaaggaggataattgtgtggaactcaaagcggttgggacatgtcatatgtgatctatttttctgtttattttttctattgagttttttatatgaaatctgcatggccccttctttgtgtggggggttggagatggggagggcattgacagaagggttggagatcaagctttagagggacttggaacagatgggcacatcacctctctggggcccctgaatttgagagctctgctcccagccttttcccaccaggggagctcatgactggctgtcttctactgtgtgctccagtttatctccaagggtcaagcaaccccaccttgagagctccctacctaggctcatgtgaaaagcaaaggactatgtgatgaggatgaatggatacagcgtttgacctgctagggtgaggcaagtgaattgagaagttcctgactttcctcattgccaactagtcatgttcctcggcttccctcttccagaataaaccaaaataaaataaaagggactgcaaatgcccatgacttagatgtgttagagtccagcttctgtttcccccatttggtcctgattttcgaagtgaaggggagacaggactgagtggcatggtggtgagcaacccgtgtgcttagcccagcggctctctggtttgtcattgtggtatccctctctggaccacagtttcctcatctggaaaatgaagatctaaggctaggtgattttaaagtccctttcagctctaaaatattattttacagttgtaggatttatggaggagaacggcattccgctctatcccttgctttagccttttgaatgaaagtgagatgtctcatcagctcagatagagccagctcaagcccagtgtctcagataaaaggagaaagaaaaaaaaaacttattaaagatagctaagttcccttgataagcagcaagtgagaaatcctgatttaatttaaatatgatatttctgtcttcattaatttaaagcatgtatatgataatgtatccttttttatttagtggtctgccctgaagggaaagaaaggcttgattgtgaagcagaggggcaaaagcttgggtatattttaataaagatgaatatccctaaaaatgcttgaattattatggaagtaagatttgttgcaagttacaaatcaaagcctgaattgtcacttatctcctaatgatacttctacacagattattaatttcattttagaagcccaatgaatgttatattttatgacattgattaaacatcttgctgccatctaaccatccatccttttcattttcaaaaatccatatcggaatttaacaaaaacagctcataaatttgtattttacagcctagcaaagttgactggttctctactctacttaccctcgggcccattctgaactctgggcttgggccatttccactcttagaagtcagcttttccaaactgacatcatgttttgtggtcagagtagtacttggggatttgtttggaagagcacgtgtggcttctggagctgcaaagccaccaggggagttctgaggtggttggggttagcccctgacgggaactcagggtctcagctttcattctcattcttagacaagctagttacctccctcctcagtatcctagggataattatgccctccccagggggctcccagtgccactgtggggatgaatgagacagtagatgtgaaaggtcttcttgctctttagaggcaagcagtgtggtaatggatttaagagccaataaagaacagtgagattgtaggtttaggatcaaccttaggcattataggaaaggtgtaggatgacttgaaagcagggataaaagccttttgaaaatatctccaccatgttattatttatcaaacgtttgtcaaaagaagtacctctggacatagacagttctcaaaaaagatatacaaacagccaataaacatatgaaaaaatgctcaacatcactaattatcagggaaatgcaaagtaaaaccacaataaaataccaccttactcctgcaagaatggccataattcaaaagtcaaaaaataatagatgttgccgtggttgtggtaaaaagggaacacttctacactgctgatgggaatgtaaactggtacaaccactatggaaaacagtatggagattccttaaagaactaaaagtagaactaccattcaatccagcaatcccactgcttggtatctatccaaaggaaaagaagtcatatgaaaaagacatggcgcacacatatgtttacagtagcacagttcacaattgcaaaaatatggaatcaaactaaatgcccatcaatcaacaagtggataaagaaaatgtggtatatatacaccatggaatactactcagccatgaaacaatggcctttgcagcaccatggatggagctggaggccattattctaagtgaagtaattcaagaatggaaaaccaaatgccgtatgttcttacctataagtgggagctaagctatgaggatgcaaaggcctaagaatgatatattggactttggggactcgggggaaagggagggaggtgagtgagggataaaaggctacatattggatatagtgtacactgctcaggtgacggctgcaccaaaatctcagaaatcaccactaaagtacttatccatgtaactaaaaaccacctgtaccccaaaaaactattgcatttgtaaaaataaatttctgaacccttcaaaaaaaaagtatctctggtttcacgagactcatatgtgtgtttcctcaaaaccactgtgggctcatcctttccctggattggctcccattaggggaccccgtgtgttcctgtcacatttccttctttataattgtgatctttatgattgctgttcatttccatccagcgagggtgctggcacctggatcgccatgcagggtgcagctgtggccagctcttcctccaggaaggagacctgaagagacgtattctgagaagcctgaattcgactctacattgaaaaattaaggactggcaaccaaaggctgtcacttgttgaagaaaaaaaccttaattaaaaaataaataaataataaataaataaataaataaataaataaacctaatgaagctgagggtcaaggggcatcgggataaactgttttgcaagggttgatgacattaggaaaaataactctattaaatcagaagtctgcctctgccaggtaatccttaccaaaagtatgcaagaagcttgagagatcagccctagaaggaaaggtgccaccccagtcctccaagggcacagggcacaggggttagcatgtaagcttgctagtcaggctgctgaggctcacatcttgtctctcgctgtacccttggggaagttatcaaaccttgctgatctttggtttcttcatcagcaatagccctgtcacctagggacattgtgaagattaaatgaagtaatagtagtatatgtcaagtgcttattagtgcagtgtcaggccaaagttagtgcttaataaatgttagttgttgtttggccaggcacggtggctcacgcctgtaatcccaacactttgggggctgaggcgggaggatcacttgaggtcaggagttcgagaccagcctgaccaatatggcaaaagcccgtctctactaaaaaacaaaaaacaaaaacaaaacaaaacaaaaaattagccgggcatggtggcacatgcctgtaatcccagctacttgggaggctgaggtgggaggattgcttgaacctaataggcagaggttgcagtgagccaagatcacgccactgcactcccgcctgtgtgacagagtgagattccatctcaattaaaaaataagtaaaaataaatgttagttattgttgtcacgcgttggctggtagtctgtggtggtggtgctggtggtggtggtggtagtggtggtagtggtccttttggtttcgtttgttttgttgtttttgtattcccccccccccaaaaaaaaagaagaaaaggttgcatatcatcactttaaaagctgaagcagagcttttctaggccccacagggcctttccctgtaggcatggtggtaaactggtgtttagggacagagcatccttgagtgaggttggctgctgaggacagcccctccctatttgggaggcaagggagttggtatgataggagcgttactgggagaggacggtagccgcttagtgtgaagacttctccagcatgttgtgaaatgttcttgagtgacacattttgccctcctttttctgactcatctacctcatccttctcctttcctcccccgcgcccccctcccagccaaccctccatagtgtgctccaacactgg

SEQ ID NO: 1280 - DNA, 104054 bp, Homo sapiens
agcgtgtctgaaatttcaatgtctgaagcatttccaatgatttatgtatctgattgttgttatctgccagctttcactcatccttttgcctttccttacttgtttggtaatttttactgtgaattgcttatttccctgagaactttgtgtgagtattgcttgtttttcctggaatttttaggaattctttgacacctgggagaaggtggtttttaccagatatttgattatttcatgcctctagtgaaactacctgtgtgagaccatcttatattctcagggtgaggtttttcttttcagaccattttatgtaaattaaggctttaaaactctatgagagtcagcttgtcattatgcattatcagaagagattttttttttctgccggcaatactatttgagatgagaaattttcattgcaatttacttgagggagagggtagtttatttttagttcatctagcactgaatgtgtagtaggtcttttgtgtatagctctgttgggatcttctactagatgtcttacctggggtgggggccatgtgctatgctcttgatccctggatttgtgaagacttgaagccaaagctgaagttctaactagtttgggaaatattcataagaggaaacaaaaactaaattttttttcttctctttgctttatttttgacctgagtattgcttactttctgtctagctcatggatgtagattagaataatattttaaacttcattctgtttagtttttaaatcgttttcagtggaagtatcagtcttagtacctaatctcccatggcataaggctggaaatagccatgatcctgccaaacacggacactctgcaacctggaacaaaatattctactctaaaaatcaagtaattatgtcttttttcaataaaatataaagtataatcattaatgtaatttacttctttcattccagtcttcactcatgctttcaaacatagattatattattccaacccttcttaagtggaattagtatttcattattccataaggttctacaaatacctacaaagaccatcatgaattccaggtgctctgtaacctgatcaggttggagaactgctgatgcaaccaaatttaatcacttaatgttcttactaagcactcatttgtttttctgcttctatgacttgctctcactgcttgctatcccaaacactgtccgtttgtacatgttccaatgtcaccattcctttttcgggcaaatgcttcaaaagctactgtttctataaaactttcctttacccttctcttttgacttgttatgagctccttttgtagtttgtaatctccttaagagcaaatttcacaaatgttatatttgtaatatcttatgtagcagagtattctcacagtctagaacagatggttcttctgtatctgttgaaagaaatgggaagatagcaaagcaacataataggataattttatttttgcctactagactatctcaggatgtatgtgttttaaatcctaaaactggttagtggtatttcagttgaaaaggtcttgaccctttcccttctaacataacaatcctcatcataagtgagagagaagattgggtgagtagggctcagtgggggaagctggttcctttcacccaccttcagaaatccaggtatggaatacaggggttgttctggacctcaaaattacctttttttttttttttttttgacggagtctcactctgtcgcccaggctggagtacaatggtatgatcttggctcactgcaacctatgcctcctgggttcaggggattctcctgcctcagcctcccgagtagtggggattacagggatgtgccaccacgcctggctaatttttgtatttttagtagagacagggtttcaccatgttggtcaggctggtctcgaactcctgacctcgttatccgcccgcctcagcctcccaaagtgccgggattataggcgtgagccaccacgcccagccacgaaattacctttaaaaaggtggtctttaaaaggcaaatagggagatactaattgcaaaaaaaaataatgatgaaataagttatctttctgttttccactttttctgtggtgttccttttgacatttgcattccaaaccagagccccacaaataactgagtttgcactcttttggcaagcaaggactgctctcagatgtattttataacttcagcttatatgggaagaacttttctttccagagacggtttcatagtaatatccttcaaaagctcacattgtagaatatgacttttttttttctttgttgttatgtttgctttgttttggtgggttttattcatcatttcagccagcttatagaaagagatagaacttttgttggatactaaatcatgtctatcaaaagcactattgaccttgtgttgttaaaactaaaaatgtaagaacaaaccattttctaaggtttttaattatatgcactaaaacagagtaaggcctagatttattaatcattgggttatggtttgatgtggaaagaaccagcctataacttttccctttgtttaacaacgttattgctgaaaactttaatagacttaagtgtactggaactagggagtgaaatcttatctttccctgaacaccagggctgctttgttatggtgtttccatttgtggcataatgaatgtgtaggacgctaatgatgtggtctctaggtgttctcctactacacagagcactgataatgagctgcgagtaatctagtacgagtccctgaagatgaatcctgattaccttcatggggccattccgctctgctcccttcctccttgatgtttctgtaaagagcatttggattttgaagagagtattgtgtatttgacttttaattagatttgcagtgtgttgggttaataaactagggcttcttcttcttcagtttcctctaaagggatgtgtgtaaatgttgcacagtgggccaagagaacagagggtcataacaggcagcaatggtggtgtcgcccacttcatgccccagtcctgaaaagaaggcttatagtggctgaaggttgatttcatcccatggtccatagttacaaatggcttccaagctgccaaggacctgctaaacctattgcatctgttctgtacgaggaagcagtctcagaatgaaatatgacagttgtctgtcagggctgccccagagtcctgcaagttggtattatctgcttgcgttcagaaaacacatcaccgtggctgaccacagctttgtacttactgtgatcttagggctcgcatttttagggacaacttgccctttatgcctttggtccctttctgccttctgcttttgtttttctgccagttgggttcatttatcttctttcctgtgtgttttgccatgcttttcttattatagctttcagattcatcatggacagagatagaaagtactctagtgtctttatcccacctcagctctcagtctggtgtagagctaagggaaggagaattgccttcacagtcaactttcagtgtggtccctgaactttttattttgttcagtgaatccagcacatctcatattgtgccccagctataatgggtagtcctttcctgatcttctaagaaaattagatgcctggcttctgccttgctcttcattgttttttaagcatagtccttacatgatggtccgggccttccttacaggtctaattgtgtggctgggccttccttctgcatgcctattctgttttttagtttttgtttttcttttaagaattggggtctcactctattacccaggctggagatcagtggcataatcataactcattgcaacctcgacctcctggactcaagagatcctgccacttcagcctctcaagtagctgggactacaggcacacgccaccacacccagttcattttgaattttgtttttgttgttgttttgagacagagtcttgctctgtccccctggctggagtgcagtggcacaatctcggctcactgcaatctccgcctcccgggttcaagccattttcccacctaagccttcttagtagctgggattacaggcacatgctaccatgccgagctaatttttgtattttaagtagagaagagatttcggcatgttggccaggctggtcttgaactcctgacctcaagtgagccgaccgcctcgacctgccaaagtgctgggattacaggtgtgagccactgtgcctggcctgaagttttttttttttttttgtagagacggggcctcactgtgttacccaggctggtctcaaacttctgggcctgagcgatcctcccaccttggcctctcaaagtgctgggattacaggagtgagccatcatgcccagcctgcctatcctattttattctgaggctactactactccttatgggtagatccaaggatctgacatcattttcatacatcctgttcagtgtgtgagtatagaattgaggtaggctgacaacacaaaagtgggcagaggtttcccactcatccccgacagggattctctgttggcataggtgggctctggtccaactcctggccgacatgagcatggacaatgtggcacagttgtggctctgcatcttgtgtgtgactgctgccctgtttttgtttagcaagctgctgtgccaatttactatgcatgttgttacatattctgctctaatttgactgccattttgcttcagcgagacgatgattgtttatggcagggctgtaatgtgttgtcagcacaggttactcgctacttgttggcaatggcctaacattgcctgagacatggtgtcactgtgaaatggtttgacaatgttgagactgtagttatgttgagcagtaacaactgtagaggtcaagaaagggcatctaagaggaactgtgttcataggggaaagatggagaaggaatactaagtaggacagtagcaaatgtcatcaaagagcttcattttcacgcaattttcataattcagtctgttttctgtgaacagtgttggttcagctgttgctcgggagtagaagcacatttctgagttagaaatgaattgtgctgatcatgaccctatcattttcttctttgaacatttttagaaagttatccagcttgctgaagaatgcactagatccttgtccatgtgtgaggcaagggactcattgggccaccttcacagggtttcatttttggaacatttatctaaggactatcttactaccctgagagaccaagatgtaggctaccttaagtcgtatgaggctgctgtgaaaatggcatttgtttttttggctctaagaaattttcaggacctagtcaagcatgtgacaacaaatatttaatgatagtggacaaggtaaacttcaaaagtgactagaaacccttgtggaatctaagacagagggactctaacaagcttgatgacattttgaatacgttttgtattgattactgactcttttcccaataatctgtgaagctggctttctgtttggcaaggcagccccaaaaggaaccttcatcccatacctccatgcaggagtagcacagaacagcacccagcatcgggccctccagagtctgggagggttcggttgtctcatgaattatgtggtgcccttcaggaactcactttgacctctgatgcctttcctttcaagcaagtggtgtggaaaaatattaaaactctcagtaatgacagtttccagatatgcatatctttgagtggacaatgaaggcaacatttatattctgtccacgatgcgagcatggtatgcattctgcagctgtcacagagccttccttctggtaccaaataccttacttcctgacaggtatgacctctgagacctccctaacccctttctttcatttcatacaaaaatctagagcttggcttttttttttttccttctttttttgtaaaaagaggtttttccattttaaaaagccttttcagttcttaaacttgatcattgatatgttccacctcatcaaaaagaggagtgcagctaaactgacaatcagttcatgccattggcctcactcatcatcatgtcaaggacctggcatgcccattgagaagggcctctgtgcattctgtcctcaccaagcctaattccttcccctgttgatggttttgccagattctttgcctgttgatgcccatgccagggccacggtgcttatgccaaagcctttgacagaatgagtcaaatctggtgccagtcacccttggcatatgccaccttgttcttgaccacttcctaccagggatgggctgaaaagaatagtgtctgctaagagcttgtagaggacttttctgttaagtgctaagtgttgacattactccagtttgaatcagatcatttggaactcttgcttggatctctcaaagctgttgactcatttgtatcttggcctcacattagtggggtagataggagccaaaaagtttgagtgaagtcagaataaatatattttaagtgtggatctgtggagaagaaagaggtcccaagagcataatgaaaactgtggttaaaactgtgaatcaagaggtttgttttaatttgccattttcttacgaagttttaaaatattttctaataaagcttcttatttattgccttagtacattttctgttacttataacagaatacctaaaactagataatttatggccaggcgcggtggctcacacctgtaatcccagcactttgggaggctgcagcaggcggatcatgaggtcaggagatcaagaccatcctggccaatatggtgaaaccctgtctctactaaaaatacaaaaaaattagccaggcgtggtgttgcgcacctgtggtcccagctactcgggaggctgagacaggagaattatgtgaacccaggaggtggagcttgcagtgagctgagatcacgccactgtactcctgcctgggtgacagagcaagactccatctcaaaaaaaaagaaaaaatactagatagtttataaagaatgggaatttatttctgcagttatggaggctgaaaagtctaaggtagaggggctggggctgcatctggtgagaggcttcttggtggtggggactttctgaacagctccaaggcagcacagggtgtcacatggtgagggggtgagcatgctaacatgctagctcagttctcttccttttcttataaagctacctgtctctcaatattgctgcattggagattaagtttcaacacgagttttggagggggcatttaaacgatagcatatatatagtgcagcagtcccactcctaggtatttacccaagagaaatggaactatatgcttacacaaagacctgtaccctttttacactttttttttttttaagacagagtctcactctgtcgccctggctagagtgcagtggtgcaatctcggctcactgcaacctccgcctcccgggttcaagcgattctactgcctcagcctcctgagtagctgggactacaggcacgtgccaccacagctggctaatttttgtatttttagtagagacaggtttcaccatgttggccaggatggtctcgatcccctaaccttgtgatccacccgcctcgggctcccaaagtgctgggattacaggtgtgagccaccgcgcccggccaacctgtacactttttgtaatagccaaaaactggaaagaagcagtatacattactaggtgaaaattacagcatatagagataatggttatttctaagcacaaaaaagaatcaaactgatattcctaacaacatggatgaatttcagaaacattgtgctaagtaagagaaggcacacacaaaaaggtacatacttaataattccacttgtgttaaattctagaaccaacaaaacttatctgtagtaacaaaaagtagttccatgttcacctgggtgcaggggtgggaacactggctacagagttgcatgagggaacattgtgggtgatggaaatgttgtttcttgattgtggtggcagttatatagatacagacatatttgtccaaactcatcaaactgtatacttcaagtgggtacattttttcttttatgtgtattatacctcaagtataatgaagttgattttaaaaatatatttgttgtaatcccacttttgccacataaacagggtccagagaaatattaggtattccttctctctctctcatgtatatcctgatcaaaacatttatatgaacatattgaaatcagatttaaatatcagtttccctaatggactcagctggactcaagttaattgacttaataaaatttcgaatctcatttgttcctattttctcctccctacagttgttatctttactgttatttgaaggacttgaataagtgaattttgaattcagataatacactatagggagtaggaaagcagacccctggcctcaggagcgcctctttgatcatgaatgtctatgactgccattttgttctctagattcatgtctttatattgtctatttggcttatagttttttctatcaccatttttgttttcaactgttttttcactaaaagacaaaatttgattttcatgctattaatttcgtactaaaaagagcacagcaggcataattaaagcattttaagatgtagtaatttgatttaaaatattttactaagcgatatattacaaaaagttatttaattatctgtaaactttaaaagcaggtattagcattctatggctattgtctttaataattacattttaattttaattttagttttttaaatgtatgtttctttttgttgttgttgttctgagatggagtctcgctctgtcacccaggctggagtgcagtggtgcgatcttggctcactgcaacctctgcctcctgggttcaagcaattctcctgcctcagtctccggagtagctgggattacaggcacctgccaccacacccaaccaatttttgtatttttactagagacgaggtttcaccatgttagaaaggcttgtctcaaactcctgacgtcaagtgatccacccccctccgccttttaaagacctgacatcttagttgttactgtgaaattgattttcttgttttctcctcatcttaaccttgttttatatatcaaagtaaagaagaggaactgttaaaacttatatgaagtatggctgaatcttcaaaaagatatcaaatatttagaaactaattttaagctgcatatgttttatgaatggtagcaatacaatttataactgtcatttctgaaatctccggatttaggtctccattgccaaaaaatgtaaaaaatagaattatgacaagtgatctcttgaattaaaaccaaatgtttttgtattacaatacctgtgatgatgattccaaacaggcttctctttaataagtggccacagtagagtcatgatgttagcccttatatttataatgaggacaattctgggtcaccaagggcctggatatgggacccttggggcccactgtgatatttatggacatgaaatacagtcataggccatttatcagatttatcaaatttggaaacttccaaataaattaatttgacaaatatacataaacttcagtaaattttattagttttattttttgccctgtgtatttgcataaatgttactaggaaatatatttaataaaagtagaaggattttttttttttgcgtgatactcagctatattcttccaatagttgtggaacagcttagtgccttcagcagtggcagtctcctaaaacgattgtctatcagttaaaggttaactgagtatttggaccaagtagcaaactagaattcttttcatctaatctctgtttaatatagggatatccaatataacatccttgggtcagtgtagtacatcttacgttaagttttgtctctaatgaatatttatattacataaatgggaaaattggtgggttcccttggtagaaacatgatattggtatttttaaagtaaacttaaataggtcagaatttttatcctctagagaaaatttcacgtctgattaaatagtttacataaacttaatctttttctgctagatgcattataatctcagatattattcatgtagctattcctctgtgaaccataaaatgttcatttcttcaaaatgaatatgaagctcaaagcattagtggtcttaagagcataaaaactttattactttgtgcttcacatttttcaagtgactttggaaagccgaaacaaattttgcatttagattaatggaagatgttttccatgtgaaggaactggcaagggagcaacaataacaaaaatcccccaaggttaaaaatgtagtgcttttgattcttcccagaactgtgttagcagaacaatcatttctcagcatggaaaggtatcataattggtctatacagtggcaatactgaaaacgagtatgcttcagagaaagctaatatgactctacttaataatttccttcaagagcctgaatttgaatgtatgttccacccagcttgaggcaaacaatttgttcctataagttctagtggaagttaccggggggtcatgtaatttatttttgtcttgaagttttcaaaactgtgtagaaataaagacacgtttacttgcattgttccactagtaatttgatccaattggcaatgctcctttctcttcttctcaattctattatgttggaagagtggaagcgttcataaaatgttgtgacaaacaattcttcctagagacgtttcctctttctgtttgaacctctgatccacttgcgaatgttagcattctttttgtttgtttgtttgtttttgagatggagtcttgttctgttgccagactgcagtacagtggcacgatcttggctcactgcaaccttcacctcctgggttcaagcgatcctcctgcctcagcctcccgagtagctgtgactacaggcatgcaccactacacccagctagttgttgtatttttagtagagagagggtttcaccatgttggccaggatggtcttgatctcttgacctcgtgatctgcctgcctcagcctcccaaaatgctgggattacaggcatgagccactgcacccagccaaatgtttgcattatttagtaagtggttttttattatgggtctttacttacatgtgctgttattgtccttttcactgggattatctaggttttcaatctgtttctttgtattaattttttggctatgggactagttttaaagccctaccacagaagtagagggtctgtagttggagtacggtgagtaacatgagagaatgtttcctttttttccttgaagaatggatagttttaggggaatgtgtgcagatgtcagaagatggctacatagagaatgaagcatcagaaggtagacacaggtctctgcattgcaaatatcagtaacagggatgaagaaagaacagcaaaatttttagaaaaagtgtaaaggatggttagacacttagaccctctcttttataagtttgattgtgtacttctaagaagcagcaataagttgaaggtaaagttatctcaatactctgataagatgtggtctctggattcataccaaacattagagttcaaggcattccccttcagtttattttatattcctcaaatgtatctaattccttaggattaatgatttgtttctcttaaaaacagcatttattgctttaatctgagaaaaaaataagacttccagtgtttatatctacaaacacaaggattgaaaaaaattttataatcagcctcgctgctaattcttataggtgaagcaatgacttagaagaatggggagactggagtacatgatagttttgtagacagccacagttggcaaaagatggtggtgaggctgtccccgttgtaaatcctttatctccatgagagcaactgttgctggctagtttcttgtgaattaagtatgcagtttgtcttttttttaatgtgataaatgaacgtattttctaactggctatttgcttaataaaaatgagtaatataataaggaattaggggagcattggaaagataatcactgggaggtgagaaaaaaagttatctctctgcttcagtcccttattctcatctttatagatcagttctcccagtgagaagccaaatgggatgtcattctttgtttgtttgtttcattaattctttgcaatctatagtaggactgttgaggagaatgtataaactgcaggttaccagcaggtggaaggaggggaatgagggcaggtggtccataagcagaaatattaattcttgactgattgggacagtgaatattgaccaacattgaaaacattatattatggtcttatttaggcctgaacactgacagccagttgacaagtctaattttttataacttaaatgtggttcatttaggaaaaactgccatcaagggcaattcaattctattatgacaattaactctgactttgaagtaagtagaataaatcagtttatttctcagtaaggcccaaataaactgagattgttgtgaaaattatgcagtttgtgactacagtgtggatgttgtgtgttgggttgtgcagtgtacaacctgcaaagctgtatgaggcaacctggacattctactcctagctatatacccaaaagaaaatacatgtttctacaaaaccttgtacagaatgtttatagtaccatcattcataatagctaaaaagtgaaaacaacccaaatgttcataaactaataagtggataaacaaaatgtggtgtatccataaagtagaatattatgtagccataagaaagaatggagtaccacacgtgctacagcatggctgaaccttggaaacattatgctaagtgaaagaagccagacaccaaacggcacatactgattgtatgagtacatttagatatgaaatatctaaaataggtaaatccattgccagtggctgaaatggggagtgattgcttaatgggtatagggttttcctttgggggtgatgaaatgttctggaatcagacagtggtggggttgcacaaccttgaaaactactgaaaaccctgtgaaatgtacagtttaaaatggttaaaatgatacattttatgttgcataaaagaacatttaaaaaaattaatccagtggggtctgatggcaaattgacatgagggaacttttttgagggtgatggaagtgttatcaatctagattagagtgatggttgcacaactgtataaatttataaaaactcatcaaactgtactcttaaaatgtgggtgtattttatggtatgcaattatacctcaataaagctgtttaaaaaaaaccctctctgagtcattactgaaatcagtgccattttctgaatttcagaaatatcaaaggagagctttcctagtgtgaatttatcataaataatgtttggtattttttttcctttgacttaacgagagcctgagatgcagaaacaaatctgcacttccatgttgtgttacccgctttgggccatggcccatttgccagttgcagattgcctccttgtctgaaaatgggtgtgtttcttcatagtaactctcaattctattgttggtgacagcgcaataatggaactttcttctgtgtggataagccccttcagtgatatttgcaaatcaaatcatatctgctttttgtgctacattgtcctcaaaatcttctgattggtttggttatagacatccctatatcagctttcctgttctctttcagtttaaatatctgtatgctgtagcaaattgcattatgaaatcctctcacatttatcgctgtttagtgcatggaaatggcatttcctcattaccagtcaaagataaactctaaatgtttctttttttttttttcctgaagtatcaaattatgtattcaaaaaacttttctctatagcattatttctctgagctgtttcttttttccctcctgaatgctgacaccagatgcagtctgcatggacattagtcccagggaaatcttgtcttctacccaggacaaggagattataggaagcaatgctgactcttgttgtagattcacaatgtgctgacacgataataggacatgaatgggcttttggaatgccttttcctttgagctgggctgagagggggacagaggcagacagctccatggcctgaatttcgttagctgtgtgacaatgggagagataagtagatgtgacagttatgaatgatcctctgtcatgcactttcacgttcagattcagataaactgacactgctgtcaaacacaagctatggagagctgagacctctgatgaaccttctaatatggtaaatgggagtcttaattcttcattaactgaaaaaaggagatttggccatgtaattttctccttgctgcctgttttaaagattccaataacccagcatttacagttgactaggcagggattgcttttccccccctacacttgcaacatgcagactgtgaaatctgaggaaacgctgcttaaacccagacttattgccttggttatctttaatgactttgaaatgtattggcctcattatggaacagtgcagttatcaattcctctaattaggtgatgtgctcccataagaaatttaacattaaagcacaaaaatgaactcgttagaggcatctattgctgggaacttcagtatcaatggtgaattgaagatactgtgtttcgttaccaactcttctgcaccatacatctgactcctccttgaagactagagcatgggcatttttttctttttccttaagggtttaatcctcatatagcacctctaacacctttgatgacattttagtgcttctggatagtaaactgtgtgcctttgactaaatcgactaggagtctagggaagggaggaggtgagcagtttacatttaaatgctccacatatcagcccatctttctttcttggaatttaacccatggctatttactctttcttatgtaagtccaataaacttcctttctataagtagcttagtacagtctttgtttttatcacgatagggaccattatttgtttattaaatagtgatgctgtttcactcataaatatttcagctgtatttctagagaagtaggatggggtttctgggtttaggcttcagtgaagggactttaagtctcttaacccttctttacctcaatcatccatctgaacaaaaaaaatcattatagcctcccctttggggaaactacatagtttaattagtgttttctaataacttacaaatccttagagaaaagttatagtagaagcataagaaattatctttggggttagtttattattattgctattattatcattattactatatgggactagttgtttttttaaattggctacttgaaaatgtgtttcagatctcatggagtgaaatttacctttcatttaccttagggctcaaataagagtatactgaatataaaaatatggaacactaatttctttaaaatacctgaacctattaatagccaggagtgttaacttcgtcacctggaagaagatcctgtcctaacttgaaaatgttagaatgaaaaccttaatcgtctcctctcaaagggtcattgaggaagctgggcttgagtctgtgcagctgttcttcaataatgttatatcattctgaaccaattatcatccttaacccagatttgctttgaatctctgtggcatcttgactactgtctataacaacggtgattgccagacactgcctgatgctcaggtttctatcaatcctcttcttctcctcacagcaggtaggagcttcttggtgttccgctccttacccaggcttgaggaatagtcctactttttgccatgatgccttgctgcagttctggctcttcccttgtgctgttgttctctttgtcatgcaggtttcccagtatcttagtagaagccttgaacaattcctattaccttttcagaccttccttccaagaactgggggatgggggtgttctggtcttgtcacaggtgggtgccacatgtaaggacccactggttcatgggattctttgagagagtctgacgctcacttgtctgggttaaaagtctggtgctgacacctgctttctgaatgactttaagcaagttatttgacttctctttgcctcagtttcctgcctacaaaatgaagataatagcgcctgtcttatcaaggttcttagagaagattagatgcattaacacatgtaaagcacttagaacgctttaagtcacatagtaagcattaataaatatcagttgctaacagcttttgcttctgctctgttaccattttactatctcacctctctcatagcccataacagcaaaccaaactctttggctcttggtagatatattattcttaatgtttgagccctactatttgctattgcttccttttttactcctataatgtgtgaaattgaaataaaaaacagaattgaggccaggcacagcagcttgttcctataattccagtgctttgggaggccaaagtggaaggatcgcttaagcataggagtttgaggctgcagtgggctatgatagcaccactgtactccagcttaggtgacagagcgggaccttgtctcaaaaaaaacaaacaaaaacagaattggtcaccatgatattaaagagccatgaaatatattagcatgtcttttttctgcctatcccctctatcctaaacattccatgtagtcttgggaaataaattctttaaggtaggccagttattatgaatataacatgattatctattgtgttatgtttactgggttgatgccaaggaaaaatgaatatggcaggtcccagcaaataacaacaacaacaaaaatagtattgtctactatttcacagagggtgtggagttagtattgggttttgaaggatgaataggagtttatcagatgaggaggattgagaagagcattcagggcaaaggtatgtggaaaaattggtgtggtagtacacgccaatcctgggaccttcaagttgaacatttaggagtgtagtgtttatgtttcagaagcagaggatgagtggagagggcagcaatagaatggcattaagacccttgtacagtatactaaggagtttggacttaatcctgtgggcatgcaggaccctttgaaagatttgcagtgggaaagtgatcggatctgatttgctaactcattgcaatggctctgtggaagaatatcttggagaggggttcaagacttgagccaggggacatatcaagtagtgtttcaaatgctaactaccccctcctgcttctcacattgctaaatagagtgcagcagaatgaggtgtacttctgaagacaggtttttgaatcagctttccagcagtcccttgagtacattgagagggtgcatggagggaagacatatcatctttaccctgccctctccccatgttaatctattaaaagagatgggagcaaagctgctatcacattgggcttgactgaagacagaagtccttgagcatccttcccctgagtgcgggcaagcctcgtgcttgcagaggagaggagattagaataacatcttcactcttcggtgagagggcaggcagaccctcacactagatggttccaccccggagttcaggcttctcctgacaagtgttgcgagcatctgatgtccttggcctctcttctgcactgcttaccttacagcagttaagcatgagggcattctgtgtcttcctttctttcccttcagttgcttaaagaagatgagaatttgctttaaagaaaaatattaataaatctttataaaatggcattaaatagaaaatctcacactcttttcttcagaatgcttttcttcaattgccattgtatctttttgccccttccaaagtcttaccaattattattaatatatattatcataattacttgtagaaaatcaatagaattgcttgtctttatcagcagtgctacctttctacctctctctcccttttcatcctctcttcgtctcttgcgaattgttgtttctgggggtattattattgtaattacggaaattgataaaaataccatgacaatttcatgcctcagaattattacacagggtttataaaaaaagattattatacatcaatgcagtatttgttattcctaaatgattattccagaaatactaatcaaaaacatctccctgcagaatagtactgtggctttaatatcagctgctgtttctttgaatggggttgcccaatctttcatcaaagaaacacatcacccatatccctgtctttaaaaacagcaattatgtgtaaatgcctcctgatttatttgagccagggccactggccagtatgagtcaccacaatttattgctaaccgtcacttttacatgataggtctgtaacaaatatctgccgcatattgttaaattaatcttccatttaaaattaatggagttagactccccaggttcaatgtaatttcatgttcacgggcagggagggatgtgtgctgcatacaaaatgagacaaggcccaacgccctaatctttcatcaccttgaacctggagactaggacgcgtctcagcaccaactaatgagattgagcctgcgtctctcctgaggatgccggctcaaagaggcttttctgctcagaaatagcaggctctgtcttattttaataattcctcagatatgacaagtctgatgttatgtatgaaagagccaggcttgaaaaagagataaaatgaattttatatcattacttcaaaaccaaaccaagggaagtgtgttgtagttaaattaaaaaaaaaaaaagataggacacattttagtcatgaaatatactgactgtaaaccaggagtcatcctttcatttattttaatgcacaatcaccttagatttctcttctgtaatttttaaacctattcatgcgttaatcaaaataatgtggatgaaagcaggagcttgttcaataaacatttagatgaaaatatcagaggggacatgtaattcctgatggggtatgtcatactgaacctctgaagtcccatcgcttcttttggtggcatcttttgaaaatgcatcttttttctgtgtaccactaacctattactgtttagtctcttagactttaaaaatgcctaagccaaattactcaggggtattgggttctctcgtttttttttctgtctttttcacaaaccaggtaactattttgcatccatggaaaagaaggttttacagaacagatttcggctctcatacatctatagtacttctggcaaatggttgctgtttttttgtttgtttgtttgtttgttttaattcttagggaggactgagccccagagacaatgggacccttttcctaggtaaagaaaacgtctctagaaagacactaagttaagagccaggcaaggtggtgcacacttgtagtcccagctacttggaaggctgtgacagagaattgcttgagcctaggagttcaagaccaatctagacaaacatagcaagacctccagataaggtaaacttcctggtttttaaaaattctgtgagttgagttctgcttcctcagaggggaattctaagtatctgcactttgtgtctgatttatttattttatttttttgagacagggtctcactctgtctcccagtctggagtgcagtggcacgatcttggctcactgcaacctccacctcctaggctcaaacaatcctcccacctcaggagggagctgggactacaggtgcctgccacaacacctggctaattttatatgtttttgtagagacaggatttcatcatgttgcccaggctggtcttgaattcctgggttcaagcaatctgccggcctcagccactgtgcctggcctgtgtctgatttataatacaacatatgattgattttaaagctcttttttgtgatttgttgtaatttgggaccacaataattttttttccaaccccttcttcagacatacataataaaatttctaaagaagtagtattggtattatactacctatagcttttattattattattattattattttactggcattctataacttagaattctattttcttacaatctttgtatatttaaatgaacattagggatagaaaaaatgtaaactctaatacaagaatcaagtatagtcacttaattgacacgtgcagttttaaaaattatagtcaccccttggtatactgagggaattggttccagtaccccctcaccttcacccccatatatattcaagtcctgcagtgggtcctgcagagccctgtgtatgaaaagtcggccctctgtatgtgtgggttttgcatcttttgaatactgtattttaaatctgcatttggttgaaaaaagtctgcatgtaagtggatcaaaacccatgtggttcaagggtcaactgtgtatcactttgataggctatttataagagaagattttaaaaatattgctccatgtctgtacttgaataagatttagaaaatcttaggggtattttagaaccagataaattagtaaaaataatgatactgtaaattggaaaataaatgaataatagtagggcatctttctccatgaacctgaattgctttgctttcctctcttttgatgtctgtaagctgttgcgttttgtacagtgggcctcagggtgcttcgtgagtcccaaataccagatttctttttctctcttctacttatagtatatttgccttaagttcttgatattttcttctgccctcttttcttcttttaatatcttcagcatttttcttcttttttctttctctccctctttccttcccttaaaagggcttctttattttatatagaaactcatctttttttgttttgagacagggtcttgctttgttgctcaggctagagtgcagtagtatgaatcatgactctactgcagtctaaacctccctggctcaagcgatcctcccacctcagcctccaaagtagcctggacctcaggcatgcaccaccatgcccagctaacttttgtatttttttagagacagggttttgccatattgcccaggctggtcttgaactgagctcaagcaatctgcctgcctcagcctcccaaagggctggggttacaggaataagacactgtgcccagccttcaatttttttgttattgttgtgagtgagtgagtgagaaagagagagagagcgcaggttgatatgctcaagcttaaggtctgtaatgggtttaaagctccaagttttataatcggaatggtagagacggaaaggatctctgatctaatccatcctccatttcataggtaatgccatggaggcctgaaaaggttaaggttctcaaagatcaaaaatgtatccttttggaaagtattatagtggttcctcaaaaaaatttaacagataattaccatatatgattcagcagtcacacttctgggtatataatcggaattaaaaacagggacttggacagatacttatattccaatgttcatagaagcattattcataatagctaaaaagtggaaacagtccacatgtatatcagtttgtaaatgaataaataaaatgtggtatatccatagaacagaatattgttgttacttttgtttttgagttgcattttattctgtcactggggctgaagtacagtggcacaatcacacctcgctgcagcctcaaactatggggctcaagaagtcctcctgcctggtactacagacatgagctaccatgctcagcctggaacattattacctagccttaaaaaggatgataattctgacagtctgcaatacgaatgaatcaatgtaatttgaaaacattatgctgattgaaataaactacacacaaaaggataaatattgtgggatttcactgctatgaggtacctagagtagtcaaactcacagagacaaaaagtcaccaggaactgggaagaacagtgggatagggagttacccattcatgggcacaaggtttcattttgggatgatgaaaaagttctgcaaatgaatgttggtgatgattaataatgtgaatactcttaatgccactgaccatatacttaaaaatggttagaatggtaaaaaaaaatttgtatatttgccacaataaaatacacagacactggtatgatttggctctgtccccacccaagtcttatctcaaattttagttcccataatccccatgtgttgtgggagggatctggtggagagaattgaatcatgggggcagtttcccccattctgttcttgtgatagtgagtactcacaaggtctaatcattttataaggggcttttttcttctctgggcactcattcttctctctcctgccaccttgtaaaaaaggatgtgtttgcttccccttctgccatgatcgtaagtttcctgaggcctccccagccatgcagaactgtgagtcacttaagcctctttcctttataaattacccagtcttgggcagttctttatagcagcatgagaacgtattaatacagacacgcacacattcttttattacctgagaaaatttctggcaattagtatgtctgtcctcctctgcctccatctctgtagctaacatttggacattcctctgtttcagtttcagatttgctctcataatgtttttgaatgttacatctttccctttcttatttcagttttctttttttctgacattgagtacgtgctttgtgatagtcactagagatacaaatagctcagaatcaaagaaagagtgtacatgaagtattttcaagaatatgcctataaaatattcaacgatttctcagaaaatatcaattgtaaaataaataaaatacaacaaaactttcttatttgcacaaatgcgtaaagtacatgtagtctaatttaagtagtttttattttttttctctaaagtaaattttgtgactttttttttttttttgagatggagtcttgctctgtcacccaggctggagtgcaatggtgtgtgtgatttcggctcactgcaacctctgcctcccgggttcaagtgattctcccacctcagcctcccgagtagctgggattagaggtcccagctaccacacccaactaatttttgtatttttagtagagatagggttttgccatgttggccaggctggtccctaactcctgaattcaggtgacctgcctgcctcagcctgccaaggtgctgggattacaggtgtgagccactgtgcctggcccaattttgtgaccatttcatataatattataagtattcctttactaaggcaacctgttaatataggtctctcagttgcaggcttttcttattctatggattgactaagaagcccccaaaaatccttatgaggaaagatagagtcatgtgtcataagagaaggctagtaataggcttgagtttcaaagaaaagagtttatcagactgaggagtaaagaacgttggtaactggccttcaaaagatagttaagattgcatccggaaagatgtggggaaggggatgtaaaatggatagcaaggcaggatagcaacagggcattcttggaatagacaaccatccatttgttctcagtgtgaaatatacatggttttgtaatgggaattaaggccgaaatggcatgtcaaggccagtagttgagagctttgtaggtcacattgaagagtttgtatttggagtttgatggactcctaggatggatctgtccagtggacaactggatttcagacctaggagagcctctatagaggtattaattgaagcctttggatgatcgagattgtgaagatagaatataagacagagcctcttgagcatttctcccttagtgagaagaaggtggtgatacacagaaggaaccttcagcaaggtgagaatgatagataaaggatggactttccccaagaaacctggcaagggagtgatcaggagtgttaatactgtcacagagactttaaagaggatcacaaatgaggggaaaccttggattttaatcttgactcttagtactcaaggaaactgcatgttaagatgtggtaattaaagtattaaaatattctaagggtcccttgcactctccctttctgtgcccattgtgacagcatggtcacatcattgcttgaggcatgcaagagtgctttattgaagatagtattacggggggagattttattttgatagagagtaacaaatagactaataatctatcttaaagtaagtatcttaaagtcagtaggcaaaggagaaaaaaagatattgataaggaaagcatctgcaggacagattctagatttctgttttttgttgttgtgtatgtcagggcccagactatgtaaatgatagggcaaaatgtgagtagcaacatagtcttattagaaacctaaatatctacaaagagagcaaaaaactatcaagtcaagaatatgttacccattttagtaaaaaggttagatttcatttgccttgtgtatttgtgtgtgtgtgtgtgtgtgtgtatgtatgtatgtgtgtgtgtgtgtgtgtgtgtgtatgacagtactgtattaggaatgcttagtaggcatttggagaagttttgggtgattggtaacatgaaccattcttccctttaatctggtgcatctgaacatattcctgggcagaaggtatacctgtgcacattacagacgtttgtgggtacttttatttcattatcctcaagcaagaatacgagattgctatattctacattagaccaacttgttcttagcaagcacagaataataacctttcagtgtgaatgtttgtacataatagtagtaggatgtattttgtggtattttttaaatgaggattcattttaggcttggcacagtggctcacgcctataatcccagcactttgggaggctgaggcaggaggatcgcttgattgagcccaggagtttgaagccagcctgggcaacatagtaaaacttcatctctacgaaaagtacaaaaattagctgggtgtagtggcacatacctgtggtcccagctacttgggaggctgaggtgggaggcttgagcctgggtggtggaggctgagtgagtgagagtgtgtcactgcactccagcctgggtgacagagtaagacagtctctcaaaaacatacatacatacatacatacatacatacatacatacatacatatgtacatgcatacatacatgcatacaaatgaggattcactttaaaaagcattgaaatgtaaatatcagctatacctgaatgtttataatttaaaggtaagattgtcattaaaggaaaccttaggaatttctcagacatactgaaaatcagcccgaaagtgttttctgttgtttggttgttgtcgttcttttaggattttatggagtactctcattacttatcacttagaccaaaagagaatgtcaaactgccaacaaagttgttttttctacatttctactaaataatgttaagtagtcaggttcatctttggaaggaagattcttaagtgctttggcctccagtagtttagatgagacttcttaaaactcaaaatcattttattggaaaatgctttattttctgtctttgtgaattatatttataataatgcatttaatttaggccttgggattttgtatacctttgggtgggcctcttcctcttctccccctgcatctctaataagcactgaatatcaaattgaaaccatgatattctgaaatcggaaagtttctgccttttgcagcttatttgatgggaataaaaatgactgatggcactctctcttggacccttttgttcaactcacctatgattatggagcctattagctggagttacaacctatttaagagcagtgcttaccagtaatgggggccaaatgattttggaaagttcagatgtactggactccctgcagaaatgaattcagcactgaacatattgatgcagaacccgaacgaggctactccagtgggacaaagagaattgtgagctctgcaagaaatgagtgggtagtagaattaaagatcagatagatgttcggctcaagggcagtctcagctcttaagttcatcacagcaatttaatcaggcccaaatgagcgttgcccagaaaggaatcagccttcggtgtgacaggaaatggagtttatttaaaagattctttgtttctagtaattgtgtgttaaggttttccaagtctacactaaaattacggaactactacatttgataggtgatagcactttggtttaccttggttcagaagatgtactgttgagaagatttatacaagtcatgatcttgtccagaaggagcctgccacctcaaaagttccagctctatcgtcttttggattaagtaggccagagtgcatctttggctatagctatctgatgcccccttccattgtaaaattattttcacaaaaatatatttgtctacagtaagagttatataatatagcagtaaagaccacaaactttagaatgaggcacacctgggttggaatcccacctcctccacttgttagctatatgaccttgagcaaattacaactgtagttgaacacatagttctttacttacgaaatgagaataataattcctgcctcacaagattatggggagaggtcaattaaatgatgtagtatgtatcagttgcttcacaatgtctgcacataataagggctcaataaatagtagttacagctctagagctctctcatcttgtccctcacctcatttgcccactcctctactctcttcatgagccagagtgttcactgctttaggaataagtgagggaaactttttttttcttttttctttctttcttttttttttttttttccgagacagagtctcgctctgtccccaggctggagtgcagtggcacgatgtcagctcactgcaacttctgcctcccgggttcaagcgattctcatgcctcagcctcctgagtagctgggattataggtgcccgccaccatgcccggctgatttttttttttttttttttgtatttttagcagagacagggtttcaccatgttggtcaggctagtctcgatcttttgaccttgtgatccacctgcctcggcctcgtaaagtgctgggattacaggcgtgagccactgtgcccggccaaataagggaaactttttagaggatctttggcttcagtcatggagaaaaagaagaaactataaacacttggaggtctgaacagttcattgattgttaagaacccaaacaaaaacactccgtccccaaccccgacacaacaatacagtggggtattttggattgacacattattagcctggaaacctatattgacagccaggttatgattttacacatgtaataagaagagtctattggtttttcttctttgttgctcactagttcttaagtttgctcactaatgtataggtatttttgtctaacactgacaaaatttgaaaagaagtataataaatttattaggattttacttctctccttcatggacctggcaaatagtgtatctatgtctccatacccatatccacgttcttattttttttatctgtatctattatctgtctctgtgtgtgtggaaagtgataatgaatgaatgaatgaatgataaaagatccaaactatgaactttatggatatcggggtaaacatccaacaatcccttaaatttggtgcactcaagtaaaagctgaactggagagagttgaccagatcctcttaaagttaagctttttatccctctgcccataatttgtaccttgagatcctatagggatgtgcctaggcctgtgtgaatggcagcctcatctatgctgtacctgcagtacagaccagcctcatctgtgctttacctgtaatacagagcgaaacatatctagagaaagagattagtttgcaattagggggatcccacccattccacagcttggcccagtggaggttccctgctttgatcgtctcttggtgaagagaagaagagacagcaagtgctgtagaaagttttcttctttgtagttaaagtgatagggtggaaacaggagcatagaaaagacattcagagaatagaaagtgaccaaccatttgaaaacctaaaggaagacctgggttcaaacatttgttaacatacagagaagaaaaatatgatctgtttggggtattacaatccagtgtgtattttctatcatacttaccaaatgtacttacttgttgtaaacatttaatatttgtttagtgctttgaagattcggagtaatgtttcagatctacatattgtatcaataagcaaataacatatgctaagcacttaaaggctattgtcattctccagctagtacagagcaaatgtgaaagggtaaagactatgtaatttcaggtgcggtttcagtgaggaagccagaacagcagtctactcttatctgctgctttcttccaccccaaccccctgacccataacaacaaaaatcaaacccagaacaaaccgcatagattgatcaaagagcataacatgcattgttaggatttcagatatgtagacagaaagtcagattaagctttaatgataattttgagttcttggagcaatgctcattgattacaatgtgtgtgtgctggggagcaatatttggggtacccataccttccctgggcatgttaaccttgtggggcttgccttgtttcagaacatgtttcctattaaaaaaagatgactgtaaaatcgtaggccttttctagcatgcacctcaaaactcttccagcctctacccatcacccagttccaaagccacttctgcttccacattttagttatttgttacagcagtaccctcccttcttggtaccagtttttgtcttagtccactcaggctgctataacaaaataccaaaaactaggtagcttataaacaacagaaatttatttctgacagttgtggaggctgggaattacaagatcaagatgctggcaggttcactgtcttgtgaggcctagtttctggttgtagatggcaccttctagctgtgtcctttacatggtagaaggggtacacgagctcctagggccttttttctaaaggcactaattcactcatgaaggcttcaccctcatgacctaaccacctccactaaaggcccacctcctaataccatcaccttggtagttaggatttcaacatgtagattttgagtggacataaacattcagaccacagtccctgtgaagaaggtatttgttattctggcagtgcaggagcaagctagcacacttgccatatttagctgatagaagtaatgtgaaatgaaccgttaggaggagggattttgtggaagaaggaatggcggactgagcaagataaaatatggagaattgctccctcttcaagaaacgcctccatcctgatgtatatcagctttcatatccccatggatattttacaggcattgctacctctttaaacatttatgctattaaaaaaatcagaccaattgttgacataaagctaacatagcagcttctatatagacagaatatgaattttttatgctgttgatgagaagtttatgtcatttatatactatagtagggtagaagatggatttggaatcctgaaaaagctactgtttgtaccattcagaatattagcttgtgctttgaatcgaaatattaagatacctgtattgtcaatgtgagtgtttctgtgcaaagtggcttacatatgggtggaatgggagaaattgctctacctggagaaaatagcaatagttttctttcgtttatgttttgttttgtgaaaggaagggttaatagcatttaatacctgatttatctgtgcttctctgcaccattaaaagaatgaactgttgtggtaataaaaccatatttcattgaattaaaagtgccatcacttgcaagatgcaacattattttatgtacctctaaaaaactacactaacaaactgacatgtcaaactgacatgccattgatgttaagatgcattccaatttcagagatgtaaatatactttaaaatgtatatcttggaatcaatgaaatactgcatatagttcttttgtggtatgtgtatatatgtatgtatacacacacatatatacatatgccacaagagaataaagtatacttctatttggttatagtctataatattttgaatcattttactgagttaggttttacttattttttaaagttgctgttgacatctgtttgataccattcatttaacatggcatgaatttagaatctctacttagaatagtcctttggaagccctagtttgttgagttttcaaaagaaaaaagagtctggtgcaaggaggcagactgacattcaagtcagatcattttttaaaaaaggaaagaaaggagggagggaggaaggaagaaaggaaggaagaggttcatcctgtcagttaggaaccagctatcttacttttcaaagacaaaatcagatcatactagtatatcacaatcccgtagtttatctaattgcatatttataattcttcttggatggtgtctctcatcttggattacctctctcacccaaaatcatattttattttgttttgtcattataaaatttactatatgatcattgcaaaacaaaaacaaaaaattaccagtacatataacaatactggatgtcatatattaagttcacaataaattatggcgatttttccacatcaataccttatcttcatgtttcacatcaatacataatcttaatttttagtgactgcatattatatcattgtatagtaaaacataatttttaaccatttccctattgatggacatttagattggttgcagtttatcactttaatggcatggctgccatgtactttctttttgtcacacttacccagtgatcattttaggatcaattcctagcaatttctggattgctggatcaaaggctctgtcttcatgttattatgtgttgggaagggaccatttcctcatctgttcaccaatacaggatatcagccatctcccaccccaccccatctttacctacttgattggttaaaaaaaaaatctatttttgtttttattagcatttttaaaattgtagttgaggttgaacaccttttcatatgttttggccttttcagagtggttcttgataatagaaagcacagcaggtcagagagcaaaaggtcttaatgaacttccattctgcttcacagaagcctatgaggttttgaggtaactttctcaagttcgttataaagaagatgaaactgatagaaaataactgtgatgtagagatggggtctggcccactttcagctggtctactctccagcactggaaaggaagactgagcatcagaaagccagggaagatccctccagaggtccaggattgttctgaggaatactgaaatcaaaaactctagactccttcctgctttctgagatgcagggatttgacagagaggtcaaaaaagggcccctttcctctgcatgtgcagcttttatttactattgtttcctttttgttgtattgaaatgtcttcattgcttgcctttatggatacaaataaccggatactgtaatttgaaagtagttaacaatgaaactgcatagtatgagccatgctgatttttttttttagtgggcaaatggggtgatttctctatgagcctctctgctgtcagaagctcttaacatttgagtcaacatgggaattatatttggaataaattagtaaattcccattcagcatgcctataccatgtaatcttcaggaaccgtaatgactgtgtagtagagtatatttccaacttggtatttataaaacacatttgctctgagaaacccttcagtatttgttcctcaaggcccagccctcatgctgcctcctttgttagtcagtgtttattttgtaatagttgggacagtgttgtacagtggaaacccatttgtctttggagttagcccagacataaatggactcttaggcctgctatttactagcagtattctcatgtttggaaatcaggagcaatgtaattgttgagacaatttattttaatgagagtaagtcatgcagtaagcatcaatcttagcacatatacatgttgtctttttttgtctccctgaaatcttcttcagctgcttccatgtactgatatcttcttccaaattccttaagagccttcatctgggtcatacattgacatttatttgatacttaatattgatagttatctcttgatgtttgtgtatgtctttgtatccataggatcctccattagcacatgtattcattcatcaaatatttattgagccacttctgtatattaggcatagagtaagatgctggaatatgttaatgaacaggagatgtggtcactgtgccctcctaatgcttacatcccagcaggcaagacctatatgaaacaaagtttgaattactaaatgaaagacatggcagttgctattagcaatgttgtaaggggctgtgaatgtagactagcttgtacatgacatttgagctgatatctattggctgagtaagagttagccaggtagaggtgggagtgataagtctttaggcagagaaagcagcacgttcaaagactctgaaacaggaaaggacttgtttcagtggtgcaatagaggatgagcaaaatgttctcagagaatggagtgcagaaagcaggccttcagagaggtcattggcagcgtaaaaatggggtaagaacggcaaccttgtgcagggtcttgaaggccaggtgtaggttccagtctgtcacctgagagcaacaggaagatactgaagggttaaaggtttacctgtggaagagtatcagtaaaacataaatggatagattctaagtgagtctactttaagctggagtttggagtcgcagggtcctgcgtgtgtaccaccatactctctacacttttaaaactaaaacagaaagtattctaaaacataaaacaaaactggattgtattttcaactgttccttcaactctgaaatactatgattatgctagagtatgagaaattttattttccaaacaaatataaagatgtatttctgatgaaaaacattttcaacctaagctaaaaggaaatctaatgaaaactttaaggatcctttaaaatactaatattgtgtttaaagagaaaatgatacttgtctttaaaatgttttaaaacatttaaaatatgctactgaatataagtgaagagtggtagatcctaaagtagtatttcttagaagagtagaataggttatttccaaaatctttttcatggaattttagtgaaagctaccatagggatcatgttgtccagcctctttgtccttataaaaacatcaatatcttcataaatcaagaaaatgagtcccaaaattggacacatgagctacccattttctaagattttgctgaacggaactttgatcataggggtctctttctaaggcaacgtattagaaactcccagcatcactgtattccttataagaatcatattttttacattaatctccagaatcaaactacaagacaattaagttgttgcttttaccaggttgaaacttgccttgatttactatgaatgttggttgccttgatttcttctactttttgtctcagttctacatgttgttgttcttctggttttgctccttatgagattcgctggatctctgtatctcttcaactgtggtgagtttcatggacagggtcagaacttagggaaatgttgagaatagggtgtggtcctatgatgggtcctcctcttcttacaccttcgactgttgtaccactctttgatgttacaaagatgaatgacttgtggtccttggcccagagtttcatattctggataaattattatttatttgtagtgtacttctatatttttacatgctgtcagaatattagaaatacagtgtttcctgtcagaaatgccagctgagcaaaagccagtaagtcagatactaatgaatggattagcaaattatagggactaatgaaattaaataaagattattcaactaaactagtggctcctcccagtagtttagagcgttgctgaccaccttctttttgtccactcacatattagaattaaaaatgtcaaagtaaaattaaaataacattctcacctacaagaggtagggagaaggaaagtaatatttatctttaatgttattttcagttgtgcatttattatgtatatttttgcataaaataacttgtagtttttgtttggacaagccaatcaaatgagtctttaagatgaagaaggagagcgaacccacaagagatgagtttcgtatgtcttctcaaaaaaaaaaaaaaatttttttttagctcaccaaaaaatgttatgaaatgagaattttgaaaccttacctgtggaaatcacagtggtaatacttatatttcagcccttagatattcccagtggtgttttgatcttagatattcccccaaaggtgttgattagattctggctacagctgaaggaagagaatttttgctttttagctgaatagtaaaacaagcctctaaagatatgaggcatgggggaaaaaaactaaaggcttcttcaaggtggtgtaagggcataatttttgtcatctttattttaagagctctaccaggccagacgcggtgactcacgcctgtaatcccagcactttgggaggccgaggcgagtggatcacgaggtcaggatattgagaccacggtgaaaccccatctctactaaaaatacaaaaaaaattagccaggcatggtggcgggtgcctgtagtcccagctactcaggaggctgaggcaggaaaatggcgtgaacccgggaggcggaggttgcagtgagcccagatcgtgccactgcactccagcctgggcgacagagcaagactccgtctcaaaaaacaaaaaaaaagctttgccaaaggtttccccttagtaaagaatttaatacttgaagtcatcagattagatttcagacttcatttacccgctctatgcatttttttcgtcttcctgggtttggtctgcctgtgcttcttagtctacaggtgtcttttctctgtactgccaacctctaattggagatttattaggtgctcttaagtaagagaggaggaaggccaaaggagacagaaaatggagaagcaagaagaaactgatcaaggcaggagagggaggaactggagaggatggagataaaagatgtataaatgaagacaaatggaagaacaatgagatagagaggcctgaatggtagaaaaattctaaaactgagctagtgagaatgcatataaaataggggtctggtagaagaacttcagcaaaagtggtgtaaatcaatgatgagtaaattaatagggcaattgtgcaaatgggactcactcatttatactaagcgtaatacatcatgaatgatttagagataatgcaacccgtagggcataccttttaatctacccaggacccggtagagaatgctgtcacttcaagagtaaaaaggcagaggatcagaatattgggtgtgtctcttcattctaacagtgttaatgagatagattctgagcaacatgaaaattaaccagactcacaagcttagtttgtgatttatagattgaaaagaagcttaatatattccaaacatcttcctacaaacccaaaatatttaagtgttttgaaagtattcatttgaataggttaacatgtgtgattgccatggatggaaatgaaagtaaaatgagtcactgcacatatgatccaaggaacatctgagtgttaagtgggttgtaactgcataagaatccagtgctattggaagatgcatcagagtattctgagaccagggaataaaattctcttccatgtgctcccttctctttcattcgtgtgcctattcactcaccattcaataggtgtctatcgacagccttctgtgtggaaggtactgaggaatgtcctatgggttgctgcttctacctgaaacagaaacataagatttacatccctcaggccctcttaccagtatttttatgggaggatattgaggaagggaagggagaaagtgaatataagaagtggagagaagtcttggtttatagagctgttagggttccaagtctgctgttctttcttgattcagaaatggaagctcacaaaggttgtgtctggaccaaagacccaagatagttggagtgttgaggattagatgattttgggcttcccttctagttcattcttagaatttattcccagtttttgtgtttatgaaagttagagatacagtcttcaaccattaggagttagaggtgaaaataatagtaattggatgttaccaagtatgtaaacacttgtagggaagggaaatacataaataactaaattctctattaaattctgattctgaaaacttcaaaacagacctaatttagtaagaggggctgcatttttatatgtgatcccacagaatgcttctagacttctgtcactgatggggaaaaatcaaattattcaaagtcttgcaccatataacaaaaaagctaaactaagacgagatttcagggagtatagaaaccagcaatttgtgaaaaatcttgtgtatgaagagtcatgatgtagaacattcaaacaaatggatcacaagagatttctcaaagcatgtcttagaggtgagcaggcaggcatcaattttaaaattctctgttataaatgatcataagcttatgtttttctgtgtaaaggagaaataatttcccaattttataaaacaaattaccaatgatgtaaaaaaaacatttagcacagtattatatcagagggcatttaacattcttttgaatcatttgagattttcatgtttccatttcagagatcagggaagatgtgccttggagaggaagcatgtcttaaatctggaaatgatatgaagagggatgtcagcaacacttcatcctgggccagtaatagggagagtttcttttctctcgtcaaattgcttaaaggattctagttccgtttggtgtggtcactcacatttgaattctaatactctatgtgatatagattctgttgactactgttagcgtgaccccaatgagaaattaaacacttccctccttttcatttgcagtgtgttttagtttaaccttcatttgtttctcttttctccattcctcatcccaattcaggtatcagatcctttgacaattgttaacctgcccagctgggatttttggcattaagctatgactgtaacgtttctactaataaattagattttttaaaagagtgctgcttgccaagaagcaaagtcattacatagtgtgtatatgttcaatgtatggctataaaagtctccttagccaaacataatcgacagttaaaataaatttaaaataaccgtgctacctctagattttaaaattgttaaggtgaagataggtggtctaattttactctatttccatttttcttattcacagggtatatttgttctgtaaaaccacatatgtatcttatagtctgcagctgatgtatttatctgcctaaatacacatttctccaatggaatattctgtaatatcaagcatttcttttttagatggaaattaattttataacagttgaacatcatctttgtcaatcagcagctttatctaccataaagaacaaaaacgtacttggcgtggcctgctttaacttttgtagttcctatgtttaaactgaacagaggaatattatgtgaacaaattggaaaattatataaagaaataaaaatctttttactattatagttatctttaccccatagctttcaaaaaggcatttgaagcaatttaataaaataggaataacagtaagtactagatgtgagaggtgagaaaacaactttgtaaatcacccatctcacgaagttgcacagaggttcctgatagcccagacaatgaaataatgtgataattcctattttcagaaaagataactagctccttattttgttttgggtgtagaatgggggaagtggtatatttttgctaagttctaaattcttaggaaaatgttcacatgggttttgagagtcactgtataactgacaatgtccccagttacagatttccagaaaattcagacatggaattcatgttactcattttagttctaacctttgatgaaagattagggcattagattgaagcttaagtaagcaaaggcattcttcaggtgatgtggttcattctaatcagtaattttatgatggtgttcatattccattccaatgatcaaatggactagtaagcttgagaaataagacaaactagagagagagattattttataaatatgaaggaggctagtgaaattttggtccagatggaaagccacccactctcccaggtcaggactgcatagatgaagtataagcaaaaccgtcattcacactttgaaggtgctgctttagagagatgtcattatatgtggtgtcagatttttcaccctgttcagtactgggcactgatttttaaaaccacttatctatattttttaaatgtcttctgactcattggattgattttgtggacctactggtagtctttggatatcccccagttaatctttgcttccatgatgagcatttattgaattctattcttatgccaggcactgtactagattttaggagtacagtagtcaggttttccttgccttcatggagtctctggtcaaatactttggttcttatatagcggttcatgttccgacacgtggttacccacacaggctttagttaacatctgcatcacctgctgcacattctcatctaaaatgcgtatgtgaaagtacagttgtagccactcagtgtcactcaccagtggggctttaggcctgagactttccgatagcctctaattatgtaaaaccatgcctgtattcaggagtcagaagtgatcaaaatgttttaggaagcacaccgtcagcatagatgtgtcaactcagcagcaagatttttcattcttttaaagttacacatttcataaagaagaagggtatcagtgtaaacttctaaatgcaggacaaaatgcatgattggggatggagattggagtggacttgttcaaagagcagcagcaaatgagacattaaaggaatacataggaagccacttccaagtacttccatttttctttagttgtgattgtgagatggttccctactagttagagaaggaaaattttaaaatgctttgctaaacagatgatccttaaattggtcactgtataccgtgatgcagcctaatcaaaatggtattcctttgagtgagtgagccacagagactctcgccaaccccttgtgcagctttctattaacagtataaatactccattgttgtaaagcagtttatggttaacaaagcgctgtcacagacacgttatcttagttttgcagattgcctttgtacatgttattctcatttcctagcatgccctctatccctgctttgcctgcttagcaagctcattcttatccttcaggacataacaccaactctgcaaagtcctcttgagacccttctgagcaggtagatggtcccttccccgtacttacacaagccctgatctcatctctgttgtcatttgttcacatcactgtttctccctggagactgagtctctcaagggtaaggacactgtgtgctcttcatttttcttcccagtgcctttgtaaccagtcttcctgggggatactttgtaagtaaaggtgaatactgtatggtgtgcagcttaggagagcttaagccacttcctaagttaagatactaagtagtagataagagtaaaacttaagtgtcttaactcctgtttttatcggtttttctggtttatcagtttattgctcatctgaaaacaagctgtccacatcatactcatgctgttctacctgtcagagatatattacatggtaaatgtgagtgataaaggaggataagttctttgtcagaatgaggacatttcggttctgtcatcatgcctgaaatgcatgatttcacatgatttccatgtgaaataaaacattggtataaaagggatatggacaaatttgtggatgttagaaccacacctttttctctgaatttattttcttctcactcctacttggcatattccctgtcattgtttgagagtgtgcaccaatgtcctcgtctcagggacaccatttctttcccgctattagagtgtctggatgatgccgtacccttagtgcactgtcctgttgaaaatttggtacattagttattttaaggtttaaaaacattgctgcctacataatattccacctctttggagcatttgcattggagtgaccagtggcttgaagctctgtatggtggagtgactgatggtagttgaagactgcaaaagtaggtatctgagggctggaaggcattcctggcacccctaaaactaccccactgggggccatccaagcctgtgattaacaaaccctagttatttgctaggtagtttccacatggcatagtaggatatatatatgtgaggcacaatacagtgtttatgtgagaataatatagattatttgaatctaggctgcagaacctacctgaaaatgggttttacagttttgtgtaattgccttttctttgtgtttgcatagaaggcattgcatagctggaagatgatggcaattataatttattatgctgtaattgttacctaaatgtttttgaataagcaaaaatcacatctgtttaggaataagttgcacagcaagagaattccctttgaaatgaataccgtgttctcatattctgtaactgtacacataaaacaacatatttatttccccactgagtccattacattcccaagtcaaactgcatcctctcttcctttcccatattaaaccctttgatttaatggaggttttaactactggttctttagggaattttcagtaggctttgcacagattaggttattggaaagtatagttatttgcttgtaaagtggcagttctgtgtcaaaattgcttttctctggagctgcaacagtaaaaacgataagcttctgctttgcatccaaaatgccctgatgttcctagcatgatcgtttttcctttgcttcttgctcagcaccattcggtcacaggctggtttggacaggcgaatatgagcacatgtagcccagaggactttgatatccagtggtgataatagacaaggcctgtcttccattctggttgccactggtctgtgacaaccagtgttccgggcatggtgagcatagtgctgcttcccttctccgttaaataggaaatgcataagcctggagtcgttttgtttgttccacagaaacgtagcagttgaaataattgccttgccatgcccaggctaacaggatttatcttccattatagatcatgaagacataggcaagaatagtttactcctctaaatttactaggctactcacttcgaaatgatttcactgtgtaaaagagaacagtcctagctgtggcttagcctagaaaggctttgatacctagaaagatgaagggcagaagtgtattctctatttttctgctcccagctcataaaatagaattggagtttatgtaaatagcagatagcctgattttattttttatgccccagttgcaagttagtgtctccttaagatgggtcttaatcactgacgttgtgtgcttccattcagcacctatctgtctattaagtggcattctagtggcctccaagagttgagtactttattctgatcagagtcagcctgggtgaccaagatgggctgtatcaatctgttacacctcagacccactggaggccacaatctttgagtgtcttttggaagatactgtcctatgttgttctagaatgctgactcctactgcttaaacctccgttctctctctgtttttatcttaggccagatgtcctttataaattttgattttttgttttttgggttttgtttttggagtttggatctcttagttttcatcctgaatactgttccacactgcatatttaatcagttaaatcttggtctcctggctttgaccatcaaatgttactctattgcctcaactctattgagttactccaactcaactgctcccacctcagggtctttcactacccattcataggcagtagccccttgtttctcttcttcgtgaaacctgagttttccttattgtacttatctcaggcattaatggatctgtgaagaagtatgacgttaagcttaaaggatcaaaaactgggcttccctatgtatgtttcaagtttcatttgtgtgaccaagagagttcatagtatagatttgaagagttcaatcaagaagctaagatattaactcatcttagtaatagccttttgtctacttcatccatctgcccatctgtctgtcaatctgtatacattattgataacttccaatgttgtaaacactgggaataccaaaaaaaaaagaatgagccatgcacctttccttcgtaatgactacattaaagccccaagacatgaagctacttgctgagccttgcagctgacctgtggcatagtggagactagaacccatttctagagggatcttcctcatacttcccaaggtcagttctctttaggcctttggtattcctgtcttagttgttgtaagagtagatttcgactcatcaaacatttgtgatttggaagtatcgcatagttgaagaattgaagaaagctgatgggaacaaagtcattttcaagtttacttgagcacatagatatcatgttgactactttgctgaatattcagaatcatttatatttagtatagtaaaagtgaaaagtatctgtttttaaaatttggaaaacacacgaaatacaatgaagaaaactaaagtaacaaccattttactactctttttatgtatttcctttgagtagatatcaaatatatcagcattttcagcatatacgtacagttttgtgtcctgcctttttcccttcaactatataatcagcatcttcccacatcgtgagatgtgaattttttgaaaacatgataattaatgcaatatgttatttcaaagtaaaaactttttatttaactattattgtgtgtgtaactttattttctgtgtttaggttgtttctgatttttcacccttatcaaccatgctgaggcatgaacttcctattaataaatcattgtgtacatctgtcagtatttccttaggataaatttcttttagttctattactgcatctgaggaaattaacatatcaaagctattgatatgtatttccctgggtatacatttttttttttttttttttgagacagtgtcttgctctgtcacccaggctggagttcagtggtgttatcacagctcgctgcagcctggactgcttgggctcaagtgattctcccaccttagcctcctgagtagctgggaccacaggtgtgcaccataatgcctgactttttttttttttttttttcaatttatagagacaaggtctcactatgttgcccaggctggtttcgaacttttggactcaagccatcctcccaccttgacctcccaaacttctgggattacagatgtaagctgctatgctaggcctcccagggtatacttttaaccctgccttacaccacccagaattcaaagcatggaatccttgacccagtagccagagtatttcttatcttaagtttaggaaagactactctgtggtcaaatgtagtcacagaatttctttccaacaaagctgtctacgtagttaactgagaaccgtctccaaagggttgttcctcttgagggaggtttcagagaagagatggcattgatgtaagtcttgaagaagttagagctcaaaatattgtgaagaggaagataatttttttttttttttttttatcgagacagagtctcgctctgtcacccagactggagtgcagtgacgcatctcggcccactgcaagctctgcctcccgggttcacgccattctcctgccccagcctcccaagtagctgggactacaggcgcctgccaccacacccgggtaatttttttttttatatttgtagtagagatggggtttcaccgtgttagccaggatagtctcgatctcctgacctcgtgatcctcccgcctcagcctcccaaagtgttgggattacaggcgtgagccaccacacctgaacgatgaatttttctaccaggacaaacaggatgttcagaaggaagacattgttagaactgtacataatcttagacatcatctatcccagtggtttatcaaatattttcacagacaaaacattttttcaagccaaatcttgtctagagtactacaaactgattgaagtgaaatgtctccagttaaatcacagtggatgggagagctcggaattgagggtagaacctcctttgctcagctttcttagagcttcctatgcacctgaaaaacccaaagcctctttttttggttttttttgggttttttttgttttgttttttgagacggaatctcacttttttgctgaggctggagtgcagtggcactgtgtcagctcactgcaacctctgtctcctggattcaagcaattcttctgcctcagcctcccgagtagctgggattacaggcggccaccaccacgcccagctagtttttatatttttagtagagatggggtttcaccatgttggccagactggtctcgaactcctgaccttaggtgatccacccacctcagccccgcaaagtgctgggattccaggtgtaagccactgcacctggcccaaagtctctttaaaaaacaaattttaagtcactccagtttgaagtttaggacacagagacaaactgtgactttcctcaaggtcagtcagaagtgattctgaaaccacctttcagtactttaaccctgtccaaaagcagccattttagtgcttttatcactagatgttcccatgcaggttgagagagattatttctgttctgttaggttatgcattgttgcagtgtcccaagagataaagtcccaagatattaatgtaagtattagcttctgtaagatgttaccccaatccatattaaccatgtctggctgaggcatgaaggatctattaaattatatccaggttcctattaaatcactacactggcagtaatacctgggctcaccttctccttaacccaaattaacacatgctgttagtggtctcaagtctaaggcaagttcctgagatgaacaagtgactgggaaaacaggagaggagaaaattaaaataaatgataggctgaccttctcacaccacttgtggtttctcaattaaccaaaagccagacagctccacgttgctgttctctcagtaataggtttcaccctcccatttaatgccagcccacacgggtgcacacacagacacacactttgctaatcagattggcagcaaatagaattaaaccattaaggcaattaagcaattcttagataacatttgatcagttcaatgaaaatgcaaattcattcttcttttggagaaataagttgatggaaagtcatttcgtgttctataatcataattaactcttttccaaataaagattgcaatgttttgggcttggagctacacagatggaaatgatttttttcattttttgcttcactctgttcatccttttgtaatgcaccatgtttttctgcctccagactctttgggacatttaggtcatcttacctacaatctcttccttgtgcctcaaggcaaactctgttatttactctcacacatgatgactcatgcattaaacacctccttagaccctgagttcggaatagatcctacagcattctggaatgattttggtcggatattcatgtgttgtagatgcactacttggctgcttctcatttctctctattccccacacttacggtttctcctctctcacaagctggtggggaagagaatgttgcacccaaaaataggtgcttgaaaatgagcgtgtggtgtctgcattttcatttctagattggtatcattgaagcctacgttccattctgccaccacagcctgaactttcagcaagaaaatgatgagcaccttgcagcccgtgcttccctcacctgccaaggtgcctttgtgctctagctcagggtttccaaacctggtacatcatcagctggggacatttggaaatatttatagtccacagggttttaatccagacctatagaatcggtatgtcccaggtttggcttagggattttcttttgcttttgtttttttcctttaaaaaaaaaaaaatctttctgtttgataatagggatcagccagtcttaagtctagatgccattttttttctacattggagaccataacatgtagtctgatgcatgatctgtcaatgacacagaaatcacttggatccaaagaattttatgatagccttgcttataaagaaaaataacaccttatgtggcaggtcattttatagatacacacatatgaatagtccactgcatcatgcgtgtgtatatgtgtatatcaagtgtctttagaggtaggtaaaacataagaggcagctgttatcacctagggcaggggtgtccaatcttttggcttccttgggctacattggaagaagaattgtcttaggccacgcataaaatacagtaacactaacgatagctgatgagctagaaaaataataataataatggcagaaacatctcaaaatgttttaacaaagtttacaaatttgttgggccacattcagagctgtcctgagccacgtgcgggctgcgggttccacaagcttggcctagctagatattatatttaatgtatctccttttcagtcttaataaagtattgcagccaactcccatccagcaggacacatggacttagtgtgcctacctgcaggtttttgagcatgaatgtaaatattaatagaaaaattgtgaatgcttctcaggaatgtcaccagtgatttttttcccccaaagaaacctttagttttgctaatccctttactagtacatgtttgtagaacacatctttttgagaattttttggggatactgatcagctactattaaagccatcaagccagcggtgccaccagtgtcacaaggaagaacgatgttttgggaagggattgagctcagcattccaggaaatattttttacctattcattactgcatgcataggcttacattttctcaatttaaaaatacttctaaagggtgggcttttgggatgtagacacataatgttctcagcaatactgtaaagcctcattaatttgctaaacaaataagtgagatggtaaaggatattgcatagattgtaagggcacatttaatcatctgaggtttaactggctctaaaggcaacaccttttcaagctcttaagagtctatatttacatggatagtaggtcttcttccttcattaaacttgccctctaagaccttttagctgttagttagaattacattttgaacttcaggataattctatatttctttcttaaaataaattctttatatgagcatttagaccataattcaaactgaggtttcctataagttctgtgttatattttatttgcgtgcatagtgatattcataccacatctgttaaagtatgaagggaggaaaatgtcagcaagtgtattgtgtctctgctcacaataattttccaatgaaagttcacttaaatgagggattcatatatattaaggactgttgttggtgattagtacataaaaatgtgggtttttctcataagtggttttaaaacttcagactgagtacctcttttgtttaatttttgcacttcttggaggcataaggtattttagtatgtgtggatcttttttattgagtttgcatagtttaggagttttttggcttaaaataaaatagggaaaaaaagctctcttaaaatagtatcctttcttgaacccataaagtagggctttgaagacgtgcaacatttgtgaggttctaaagaggggattttgtggtgttctttccagtgcttccttccttccgtcctcaccaccctgctgtaatctgataacaaataactttccagtcagtcaatttaaattatatgtaggctgcaattttttaaaatttcataatggatgctatttaaacacaaacatacatttaaaaaaaatgccatactaaagtccaaaaggaatggtgacagacattttatttatttagagacaagttctcgccctgtcacccaggatacagtggtgtgatcttggctcactgcaacttctgcctcccaggctcaagcaatcctcccacctcagcctcccaagtagctgggaccacaagtgtgcaccacgatgcctgtgttttgttttttgtggtttttttttttggtattttttgtagaggcgcattctcgccatattgcccaggcttatctggaactcctgagctcaagctgtctgcccaccgcacccagctgacattttaaatatttatttatagagcttcattatttgtacagtgcccttaaagccaaaggcattgattaggcttatagaaattgcaattaggccatgcacagtggctcatgcttgtaatcccagcactttgggaggccaacgtgggaggatcgcttgagctgaggagttcgagactagcctgggcaacatagcaagaccttgtctctagtaaaaattcagtttaaaaaagtgggcatggtggtgcaggctggtattcccaggaggctagggtgagaggattgcttaagctggggagattgaggctgcagtgagctatgattgtgccactgcacttctgcctaggtgacagcaagaccttgtctcaaaaaaaaaacaatgtagtgagtcatagttatactaaatgggcttgaatactataactagttttagtgttatagtcattaaaaaacaccataattccaaatggatataccaattactgcttgcttatcttatgcatccttttcctctcctctctatcccccaaaaccactcttgaaatcttcctgtccttttgctcttatcctacctggccatctatccaccatttatctagtataatttccataataaaaccaccagcttgcattagtgtgttggttacttcaaaggtggctaaattagagactttggttaaggacaccaaattcttaccaatttgatggtcttgaggggcaggctgtctggctcatctcttttctatctgctgcccaccttttactgcctgccccactaagcacttctcatcatgtccgaggagagagtaagtgggtgcgtgcatgcgtgctgcaagtatctgcatggcattctttttcctgaaagatcttctttttttttttttttttggccatcatttccattctgtcctaatatatcctttctctttaaaaaccagcatctagccaaggcattgatgaaaagttttctttgagctcccttgtggctgtgcagaagagtttattcctgaggttgctctcatttagggttggaatctttgaagataaaatacttcttcctacctctcacttgagatcaaggaaacctacataagactcccagagcaaaaggaccctgtaacacttgtgccttggcattgccatatgctctgttgcgcaggaatggggaggaacggccatccacatgccacccccacttccactcggaaataatagggggtgacaaatggctgctgcattctattctgttttaccaggctgtttctttcctgccctcaagaggtttctgactttctgacagcagggagctgaggttgatctagcaactgggaggattgcacctggatttgcagaaatacacatgcacatgtgtgcacgcacacacacacgcgcgcgcgcgcacatacacacacacacacacacacacacacacacacacagtgctgctgcaactcccagagtatcacataatcactcttctggctttagtggttttcctttggccacactctgctcttgtttggcttgctagcacagtaatcagaggaaagacagagactctttgcactctaatccccttgtgggttacagtagtttcagatagaagacactccagagggtgctatacaatttggaggtttataaaggccatcttctggcccccatttccctttaagaaatgagcccctcaatctgcattatacatgttcccttactgctagaagggttttactggtgccctgacactcttctcttcctcacccctcccagagcaagaactacaaaaacatagtttttttctcattttcttttagatgtatctgctgccatttattttctctctggtgattgtgtgatataggaaggggaagcatcaatggcttctttatatcctaaccacattccttgactgggccctgtttcacatctctgactcctctagagattactcagccaacatgctgcccctcctcagcgcatcaccttcttgggtctcagggcttggcattttcattcagccttgcagttccatgctcatcaccaacactgcagacatctgctgccactttcctgcctaaagcaagggaattcctgtgattcacaccgtgagcagaagcaggggtcctcttctactcagcattatcccagtttgtctcactcctttagccaatatcatgaaactctgaaactttatagcaggatgaaaacttaagcctgtagtctaaagacccagaattatgagtgaggaaactgaggccaggagagccatgaatgatagtgtttacttgattgctgtttcagatttcaccagcttttattgatacttcagcattttacttagtcgatatatctcttcgtgtgactcaaagtatcccagtggagcacagttaactgccctggatccgaattgccactggaggccgtggcagtgtcggcatcaatagggatcacccatgaccttttatttgggatgtagtagggggtctgaagttgggaaagtctgaggtggtactcagttctgggttgaatgtcttgtgaaaatcctgtgaatacatcttgcggagaaacacagaggggaaaacttcctgttgtgagagcagggctggttcccttttaaaaaggtataggatgaatattccatatttgaaatacttgagaccagaagtgttttggatttttaacttttttttttttttttttttttggaaatgctctggtgaacatttccttagagtgtcatgtgacactcaaatagtttcagattttggagcatttcggatttgggatgctcaacctataatacccaaaggctctatttcagtagaatttattggtttgctgattatagcagtgacatagttgcattctagagaccttagaaaatgcagaaaatttcaagaaaaacatttaaattgtgctcatagtgaaactgagaggtgaccactcttaatattttgtggcataagcattccagtcttttatctttctcaaagtttcacataaactttctcaaaggccattaaatacttttccatagcctgattttttgtgaccacatagtatcctattatattgataataccataatttacctaacccatttttatatatttggattttttccaattcatcattattatgaataatggtgtatctcagtggttattactttgcactgcatttcttatgaaagtattgagtaaaaggaagtaaagccctctcagagtgttttgtaggctgtcacatttcactccataatgtcctagtgtttgttgccaccagtgatatatgaaggtacccactgaaatgtcacacctttttggttttcctttttaaaataaaaaataaaaaagacatttaaccatataatattgttcttatatatgatttattataatgtagattcacatctttgagttcataaaaatattgaatttggattctctccaatttcccttttagtagaaaggctaaagttcggtaagaaattctacttggaattttattgaattgagaaacatacttggatttctgtaactcatgacaagtaacaaataaacaattagccaattaattaaaatatctgttaaaaccttgagtaatgcagagatttagttaggcagtgtagtttaaaaaaatcaaacaaaccagacctatgctgatctccttggagatgaccatcaacaggaaagatagactttaaacagtgtatgttgacatagagcaagtttctaattttccatcatttcaaggtgctggaaattatatggacataaatgcctttataatatgtgtacatctggtgagtataaattctcagatttgaggacatttccaataaaagactcacatacaaagtataaaaccagtaagcaatggaatgctaatcaagtaatgaaggattcaggaaagaaaataaaattatgccaaaccatgtaggccaagaaatgcaagtgggaaaaaaaaaaacttaagctgatgtcaaagtcaaaataaaatgtagagacaaatctctaaatttaatgttttatttgggaatcatagaatcacatttggggcatgcaaacagactgggtggtcttcagcatgtccaaagaacaaaggaaagattgggggttttattagaaagggaaatgttacttacagttttgaaagaaagctcattgaccctagagaagcttgtgggagctgcccgggtctgattggtgagtgatggtagtagataaaactagtcttaaagtcatagcaggttgtttcagcagctgctaagtaaaactggtcttatggttacagcaggctgtttcaacagctgggcttggagaaaactcaattcttggagcatgtgctgtgtcttgagtactttttcccgctgctctgtcaactcttctttagttgggcatgacaagaatgatgcaatttgcataatcaactttcacactgagtttcctgtagcctatacaaaacataaatattagtgtttttttacctttttacagtttttattgtattgtctattgaagtgaaacattaaagttatcagaatagagaaacatttgcctatcactacacattgagaagatactgtaaagagacttgaacaaacactgggcagtatgatgcgtagaactttcagtctagtttttacaagaaaaagaaaagaactgtgctaaccattttgttcatcaatataaactcaagtaatgaggttaaattgtagttctttgcagagtgcctggccaccaggtccgtaatcgctggaggtttgattagatattgagaaagaaatctgcaaaccttggcaaaatttgctgcataattccaagactgctggttcttaaatttatctccatcaaaacacagatgtcctgtgagctggactaagccatctcactatctataatcaaattattgctttcttttttttcccactgaaagatcgaaaaagaaaaaatgggtaaaaattcttagataactgtttttgtaatgtgtatttttgttgaaccttgcctcattgtataatcaagtaacaaatatgaatagaaaatactattgactatggatggtacttagctcaacagcttattttgaagaggaaaccatcatgtttttaaatatgaaacataatcatgtactttacgaataaaattcttcctatttcttacaacaaaattgaacatttcaggatttaatggtgttccatagccactagcacgcagtagctcataatttcaaggtgtttgaccacatcggtcagtttgaaaatcatacctgaccatcactattgaacacctgaagtgcaagcatccatgatggagactggagctgtccattggctactgcctttcagactaggggtggcaaacctgaccctttgttataaaaatgaaagccctcaaacgtgttcttgtcctcacgaagatttttgtctctactgaaatgcctgtaggccatttttggaaattatagctagtgtgctcactaaagtttttcttatgtgccagacacatgctctagctttacatacaatagctgtaaacctcacacaaccttgtaaggtagagagcattattatctgtattttattggtagggaaactgagaggctaagtgccttggccaagatcaccaagttatgaaatcacacgaaaggagagcctagatccctctaccagcactccttcctctatatgcactgccttgcagtaatcaagacttcactaaaagcaatttcagatctctgcaaatgtttgaacaagagctctgttgaaatgccataaaatataggatataaccttagctttgaaacattttgaggggagttaccaacttaaaaaaaaaaatgtttacctttgagcataaccacatccgaaagagtcacagagctagtcacagaatgtacccctcgataagtaaacaacataacctgttgaataagtaagtagtttagtcttctctgcctgcatgttgctaaaaataacttttgctttggtatagaagttttgaaagttgtgtagttcaatgaatatttgttgacagtgattgaaacttacattgtttctctcatgctaatcttgccaagctttggtggtcttcaagtatttgaaacaagaaagggccaggccagagccctcgttttcagatatgggacaacaaccaggctttctccatttgaaggaagaggaaagagataagggaattgttgcagtgaatcctgtgggccccaggagttataacaattgttttctaggacatacccatttcactcttcttaattttctgccatcagcatttctggggatgtactaggaaaatggaaggaacatacccagcttccagggtttcagtagtaaagtatagactagtttaagagcaaattgattagatcacttctactcctatgatgtccatttctcatataaagataagctgagaaaggtttattttaaaattaaagctagttgtttaaaagtgcggctgaagttaactcatggattgccctaaagtattgagctgtgattataaaaaaatgtttaccaaatattgtcactatggctcttatgtagtgaagagaagaatttagccttaaattagttaaaatgtgcaaaccgtttagaacagtgcttaacatatagtaagtgctccataggtattacctatgctttagaacagtagttctcaactggtgtaccacacggcacaagtatatctttatcctttctcagacatgtgccgaaacatctatacacatattaatttttttttgtatagccaaatatgtaggtgaagtgcacactgatgtttcacttggctgaataaaataagaggtgagagacacagtgtaatgtcaagtctttgcttaccagagtgaaatggggcatcgcctttcgggtctataggggtgcactgagcagtcccgttaaaaaggcacatgttcaaaaagactaaccaggtgagcagcatgttaattaccactgcttttaagaacactggaaaggcaagtggttgtatggtagtagcaattacattgtaattactgtgacttagttagaagtttttgaaccccttttgtatttcaaattgccctgtacatacaaagtgggtcagaaccatcagttaagaattagtggggtcagttcctgtctgtagctattaaagtgatttatttattgtcttataacattatactatattaatttacacatagccttggaaaaactctttctcagacttctaggccagagtctaaatacatttatgaaacttctcaggaccaggttttgatagtgcggagatcagggagagcctaaaatcataagacttctctaatagagttaggtcattaaagaatatgaatatatgaagagtagggcattagagacaacattctatacctaacattttggtccaaatcctataaaggtttctcacatagaaagctgcctttttgcatgtactacagcttgtgtctctaatatcctttctgtaccaatacacaccacatatctgattattgttcaaatactcctcttaacttaccaatgaaagcttcagatcacttaaagagattgcagatactatagtgaacatagtagaaaatcattattctattgtatagtaaaacccatgagttacatctaaaatgttactactgtttttatgtagtctttaaaaaaagagattatgaaggtttacaattatagtaaaacttattaagtagatgcatcaataggaaaagaaaccattatcctttcaacccagtcctatttcataaatagcacatcagcgcttcagtgattaagaaacatggctcatctttgcagcatgttgcttttattactttttgcccacggacctaagaggggagaggtaaagtgatagaggaaaaagctccaaggcaaatcaagttcacatatttttatttaaggattctaggaactcgaagactgaatcaaacttgttacttagtttttcactggaataatggctctatttctatagtagagtgagtagaaggttaatggtatctgccattgatggtttactaactggttaaataactgattgaaatgtggtaaagggagatgaaaacaaactaaatctttttttttttttttggcccagattttcacgtttagatgccatgaagcttttgattgtgggtctaaagacaaactgtgacagtgattggaggcttcttttaggggtcgggagatatatggaaggacaaggaggacagaggaattcaatctcctatgcagtctctgcacctgttcactaagaaataagtcagctgaggccggacgcggtggctcacgcctgtaatcccagcactttgggaggccaaggtgggcggatcatgaggtcaggaaatcgcgaccatcctggctaacatggtgaaaccccgtctctactaaaaaaatacaaaaaaattagctgggcgtggtggtgggcgcctgtagtcccagctacttgggaggctgaggcaggagaatggcgtgaacccaggaggcggagcttgcagtgagcagaggtcgagccactgcactccagcctgggcgactgagcgagactctgtcttaaaaaaaaaaaaaagaaagaagtcagctcagtccaggcagtagactttggggtgggccttgatggaccataagacctttgctgccctgtgacttctcccttagttctcagtctgttcagaaaacaatttgcaacaacatcagagagaaatagaatgcaaaacacagctcccttttgatgaattggctcctggctcggcctgcaaaagataacatggtttttcccttagaatacttgtcatgccaaaatgatggtatcgtcctactggggtttttaaatgttaatacaagtaaaataagatggatttttttaaaaaatggcaagcgtttcttagtttggctctcttggcttttgtttaaaactgaagatcactaagcctagatttttgtgtctccagtttaaaaaaaagtaaatttcaaaagcagttcctagaactctccctctccataggcctgttgtgagatgcctatgtccctataagtgtgcttcaatctaccagctttcctaaaacaggttgatggcttagtggataaagatgggacttacaaagcctattgattctcttattgtactcatctgtagaatgggaatagcaatggtacatgctgatcttacatgatgtgaggatgtgatgaaataatacatggaaggtattgagactactgtctgggtcatagcaagcagttttgccattattatatttgtcatgacagttttgccattattattaacccaataataatgtcgtgtcccctttctccattcttgtctcccaaagatgtcacacattcattattgccaaaaaacatttttaaagctttctgtttttctggtacttgcagtgtggctgacgccagtagggtataactcctctgagaatgggtgctgaattctgttcccaaggcctatggggaaatctctttttgttgttgttttttgttttgttttgttttgttttgttttttgttacagtctcgttctgtcacccggggtggagtgcagtgatgcaatcttggctcactgcaacctctgcctcccgcattcaagcgattcttgtgcctcagcctccctaatagctgggattacaggtgcccgccaccacacttagcgaatttttttttttgagacggagtctcgctctgttgcccaggctggagtgcagtggcgccatctctgctcactgcaagctccgcctcccgggttcacactgttctcgtgcctcagcttcccaagtagctgggactacagcacccaccaccacgcctggctaatttttgtatttttagtagagacggggtttcaccgtgttagccaggatggtcttgatctcttgacctcgtgatccgcccgccttggcctcccaaagtgctgagattataggcatgagccaccgcgcccggccacacttggccgatttttgtatttttaatagagatgaagtttcaccacattggctaggctggtcttgaactcctgacttcaggtgatccacctgcctcagcctcccacagtgctgggattacaagcgtgagccaccacaccccgctgggaaatatcttaaaagaatcaaaataagaaagttactctacttaaatcgtgtgctttttctgtgtgtgatttatggtaatcttaccatggggtatctgattactttagaaagatccatttagcttatttttttcttctttgggttatttttttcttccttccatttgcacagcctccccccaaataaaaaataaagatataaagtctatcttctccctcttgtcagtttaagtaaaaagaacttttgcttccattttaataatagaatttgtgtgtatataatataggcagtgatttggcctcaagctgagtttagatttgaaaagatgagaatattaaagcttgtcagccagcccacaaaccacttaagtatttctgatctgacaggatgtggggtggagttctttttcttttctccaccaacacccctcacaattaaaataaatcagataaaatagacactgtgaaggtgggactgaaagtaggtgataggaaagggtggccccacaccaggaccagtacatatgcagaaattccgtccaaagtacttcaagggtctaggacagtgctgtccagtacaactttctgtcacattgaaaatgttctgcatggcccaacagagtagccacaagtcacacggggctgaaggcagatagtgtaactaggatttgaatttttaattttatgtcattttaatttaaatagccacaggtagctaatgtcttgaacagtgtaggactagaaaaaatagattttgacacacattctcatgtatgaaaaactgccaaagagcatcagattgctctagttgtggaagattgatttgggagtaaaagaacgtctaaactgctatcctgtggaagagaaatagatttctattttgttgttccatagggaagaaacaggactacttgggagaaactgcagagcaacacatttaggctcaggctaaaaaaacttcctcagaattagtcatacaaaattctactcagatctcttcgagtttaaggacgacccccaattctgagagtactcagggttagacttgatggcagtttgacgaggacctgcagttccccatttataacacttgtcccacacagagtcactagttgtgctaagtattagctgaaacattgttttcataagtgctctgaagctaccaagaccattggtatcattttattagacatgactattatttagctaaagacaatgtactttgagtcactgtaaggccatttgttctaaaagaaacaaaaagattctccttgggatcccaagcggaaccctgttgttctaacagtaaacatgctccccatgactacgataggtggcactggtcattcagttgttaatcttaaacttttcagtgattatttcacctggaggggatgctgacattggcacaatagcctttccaaatacccagaaaatttctgataataagcaaatggatgaactcacagtagttcagctgtggtagatgctctcgttgctggttagtacttgtagcatccatcagccacggacccgccggttcctactgttggatgtaacagattcatggaaaagaagccttgtaggtaatgtcacagcagtggtcttaaattgcaaagaatttctaccagcctcacgaaccagggcatggcatggaattcattggccctgcttatccccccgtggagacgtgggaatggcaggactgtgaatgtggagctcagttacccagcagaggggtaacgctctcataaagaactcccacagaattaattagccgcattttagcactggagactgcacctcttacatagtaggagcgatggttcagaaagataatgaaggcccttaggttattattgatagaccctgccttctttttaagcaggaggacatttcctcgttctttctcttgttaaaatgataagtgcagagcactctcattaggatgtagccccttggctcccaaggacacagtgagatttcctttccttccgtgcatgttgtctctctctctttccctgccatctcattctgacatttcaagtaaacaggcatacatttacctgttggtaggtgattacatactaataaaaactacaagtaaggaacactaggcagcccccattttacaaattggcatttagtccctctataatctcttctctggagaggagtaatatccacctggatgtaaggctgggtggaattataatgcagccctgttacacagatggctgtcttcgtctgtgacatgtgtgcacacgtagacattcttgcatgtgcttttctgtcagcccagattgatgtgtgcataggttaaattgctagagaaatcagctttctacaccagttgcatctgatacaaatttctacctctggctgggccctggtgccaagtgtttgctcattttgacagtcctcaaatttgttgctttagatttttttcctctcatcttaaaccctctagtccagactttcgtatcacactttattatgtgtagatagctctaccaagaatatcaagggtatctagtaaaatcaccctcaacttccatctccgccatttaacatgaaaacattgttattcatgtttatgtcactccctctggagaaaaacatgttcttcattcccaaggtcaaagccatgttcttcaaccaacgcttacagtctcctccatggttttgtcacatcagtcattcctttccctttgccttgtacctgctgtctttttcaccacttccctctcagctcatgaactctagcgagtttcctccaatctttaaaaatctaaaggagaaaccacctccatcttgtgtgtctccatccctcaaggtcaaagaacttttatgcttgctgtcacccttcataacccgtggatgaatagttactgtatcctattgtgctaataaaatagtttcttaatacccaccaatgactttctaataaaatagcttcttaatgcccaccagtgaccgcattctgcctagttgacaagctgttccactttggatctctctcatcccatggactgcctgactttgccactccttgttcccatccttttctgtatctttgtcaggctctcttctctttctccttaaatattcgtcagtatcccaaagtttatagagaatgttacttaacagcatggatatgaggaacaggtaggcctgaattcaaatccttgctccactacttatatggctatggaaacttgagtaaattagtttttctgagtatgttttctcatactgacttcagatggttgtgaggatgaaattagcaaatacatgccatgtgcttagcagagtgccttaggtcactgcccctggcctgtctttcccctcttcccactgttcatgctcttacctgccattgttattctttctgttcctggcctccttcgggaacccaaaagccacattgtcaaccacctgccagacacctttctcaaatagaaataactatccctttttcccaaagtaaatttctccttccccaacttggcttgatagtctctctcaagtaggaagcacagatgtccatttgacctcctccctctctcttaccctcatatccggtcgacaatccatgtctatcctagcccctggattcttgagtctagacctttctttgattcttaataccaccatcttggctaaggcttctcctacctccagcttagattattgttctggcatcccaagtcgttccccatctctattctattgtaagcattctccctgaaattgtacatatattatttagttgccttctcaagttgttctcctttgtactttccaatcccttattaacttttggctgaaggtttcatagccaatctgtagctcaggggtagaaaggcaaaaatggttgatgccctgcatagagttagaactcattaaatgctgaattaatgcagtataaaataaagcaaaataggaagtgtagtaagtcataatgtaataagaagtggggataagtggttgattaaccaaaagttagctttccattgataaatactacagaattagttgtagaaaaaagagatttataacttgatcttcatttctcacctgagcctatgacaagagggtaatggattggacaaacaagtggaaaatctcagctggcatcaatgggctgtcttctgctcccacccagtgggtgtgaagtcactctctggctctctgtatacctctccttccagccattgctgatggagccaggtctctattttttttttttttttttttttttgagacagagtcactctgttgcccaggctggagtgcaatggcatgatctcagctcactgcaacacccaccttccagattcaagcgactctcctgcctcagccacccgagcagctgggattacccgccaccacatctggttaaattttttgtatttttagtagagctgagttttgctgtgttggccaggctggtctcgaactcctggcctcaagtgatccacccaccttggcctcccaaagtgcttggattacaggtgtgagccaccacacccagcctggatctccattcttgatataggtgttttgatcctaaggagacaatcgttggtgaatttgaaacagattcttcaggaaatatagtgcaagaccaaaattgggtcccaggaaaaatcatgtgatacttcgtaatgcaggtctcttgtagacacaagaaggcacacttgctcgtttccctgggtttggtttttgttttgttttcttccccctatgtctcacatcctctcctgcaaccccaaccctccgtaccgcaggcaagaaaacattgatgtttctgcatctggcagcatgtctctgggagaagaggccggcggaagggagtttgatgtgtgagtgacagatccccaggtaacaccactggggaacacttgatctgacctgtttgaaggtgaaaactcaccaggtcacactggaaacagttgctgctgggcatggctttgatccttgtttatctttttctcttttttttaaccttcttgaaaaaaatgttttgtacaaatggatactttttcctgtgtatattttgtctgctggagcatttgtatattttgtgtgtgtgttccttgtcactgcagggcggggttttgtaaccttttgatgcagattgtgaatcttaatgaatttgtcatttgccatggaaagatgtttgttcaaatagagcagagacattttcgtccaacaatattacaggaatattgtgtagaaaataatgactaatactttgagcattccatgttggctcccattttaaacacttcatgtattaacttgtttaatcttcagaagaattcatttttcctggttttcctgttgacatttgatgaaactaaagcagagggaagttaagtagtttgcctgaggtcacacatttagtaagtgagagacccaggactcaaactcaggcaggggttctagtaccagcagtgtttatcaactgctttccaaccctgacaagcatgagtgggcacaagcatggagcactagggcttacaaaaagctccctcaggctggcacattgcctgacttaaaggtaccgaaggcatggccctgccttcaaggtcattattgcatgctggttagaggagaaatctgtctgtctcatttgcggacgtgtctccgttgctaagtagtgtcaggcatgtaggagatgcttagtacaatctttttggattgtatcaatgtaggttttgaaaggttattagagcttgtgaatcatcaaggttgaaccataatcaattaacaagaaaggggaatctgagacttctaaaatgtaatggtcatgacttgctacctttagaaacaccagcgaaaaaaacctgtggtgtcggttggatcatggctcttattcactgcggcgtttttaaagctttttcaaggattatgtggggatcccaggctcctttatgatttataaatctattatgcatgtcacgtagagattttcatgacagaatcgtcagatgaactcattcagggtataatattgtaggagaagggttggcgaggttgagggggatgccataagaaaatgcctaattcataggtagagtgtaggacagaaatggatggggactggaggccagttaggacgacactgtagaggccagtgtgaggagcaaggacgtgggctagaggaggaggagatgagcatggggaggaaagtccagggagagttaacaggacctaccgactagacaagaggatccagggaaagagaatgaagcattgttaggaaagtttcacagtatagcggcccaccgataaccttaagaacctacaaacctaacagttttaaaacgatgagcttgaggctcagaaggaaaggcatgttaagctgtcatatcaggttgattgaatagattgggtaagtctttcagacatcctaccaccaccttctgccccatgctgttaattctttaagcattgggaccatgagttctgtctagcagtgtgggtgttgagaccacatgaatcaaggaagagggcttctagaggcccaagggctgtttgctgtagaggaggcagaggagggttccaagaatttcagaaggcactgtatagctctgccaggaagtgtttagagaactgaggtgcagcccccacttctcattacaacattttactaccatcaacctctcagcagaactgctgcattaggtacctagtgtttgatttgaactttgtatttattctccatgaaaaggcaccgtgcccattgatgtcactttggtgctgctgagacagaaagtgagtattttatgtgctgtctcttttcaagcaagatggaagggtcttgtaaaagtggtttctaaggaataacctaacattttaaagatttatagaacaagcatccacttaccagttcatttaagttttacaaaacatctctgcttctgccttgccatgtcagcaaaagattctgacatttaaataaataaaatatggtgggatataataaagtgcaaaaaaaatgatgcatcaagttactactgaaaggaatattgaggcctgagtcatctccctgctgctgtctcccaaacagaagatagctttaatcttcaggctctgtgttatttaaataagctgagggatttgcgagttgggggatgctgccaaatgtatccactgaagataatgatcccatttcagatctgcaggtctattttaatgaaaggagacaggtgagggtgcagaacagaaatgttcatagcacctgaccctccttctttccttaggagtttctcaacccagcgaaattggtgagatttttaaaaataaatactttggagtatatcatgaggtaggattactgtagtgagacagggagcagtaatggcagtcaggaaaacctgtgtatgttaaaaagtgtttgctaagtctctcctgtgtgtttagtgttgtgggggttttagtcgaaacaaattagggtctcagccaacctcaaagggtgtattttctcagtctttattgattcctcttggtttcctcagggctcagaacatccaacaccttaggagcaaatgtcctttgaatgaataggtttgggatgaggttctggaagacactaacacaaacaaccttgataaattacatggtagtgacttcatcacattcttccatctagtcggagtagctggcctttgaaaattacccttatgaagcttacattttactggagaagccagacaaaagaatacgtaaatgaatgaatgaatgagtgaatgaacaaaacaaaattatctctcgttcatagatcaaattgtcctaaacttgctcattaagacttacttagctatgcattttataccactgtccctgagcactttaatcatttattaattattcaacctctacattgctttaggtgaactggaggcatgagacaagtttgggatgcagactttttctttttattgtccttaagaactataatatatgcagttagttagaaaccctgtcctattggtacttttgtttcagtgaacttgagtttaaactttaaggcacagaggttattacagtatcatcttcaggaagctactggtactgaaaagagcattcttcatgccaccccagtatcatctttgtactcttacctttgtgttgagaagggatacatgtcacttataaaacctgggtatgactacgcaagccaccttcacatttgggatagaagattctacaaaagtaaaattcacaatctttgtacatacacagaagccagacttaccagcatgtattaaatctgtctttattttggatcatggcatttatggagatcactaagcaggcagctcatttgaagtgagattcagaacacttacttattttatccatttagcaaacatttacttaactcctactgtgtgtactacatcactggggaagacaattaggacccagtccttgttttcaaggagtaagtactctagtccaacatgaaacaactaatgaaactgagcagggataggcaaggcagaggtaagtgtgccttggaagaaaaggggaagaagaaatggtggatgttgaccaaggctggcactaggtaggctccaggttcccctgggatgctagttttagaggtggaagggcagttttgaagtctcatttcaggagcagggagaggctgtgcgttgatggttccagtaggatggggaaaggaggaggagtcagtgcagttggaccaggctcttgtctgtccatctcatctctccccagggataggatgacaaggaccccagaaatcaacagtgacaccagctgagtgaccacaggcagtaaacaccttacaatagctgctttgatttgtatccttgctggcgtatcttaacaacatgacgacatttaccaaatgaatgactgcttaccaagcaccagtctaagtgcttcacccatgttatcatgtttaatcttcccaattttgtgagataggtagtattattcccatttgaaaggttggaaatctgaggagtgaagaggtcacccagctagtaaaaggtagagatgatgcaacagacatacatgtccatgcttgtttgactgtaacacgtttactcttaacctctaagcaatggtgctttccttaatatagaatgtccttcgaaacatcccaatgccaaaattcagcatattttcatattagaatagctttgcgttaggtctctttttccctgaacatttcttttctctgttttgcagaatcttgttggcctcctttaaatatcattataaatgttggcagtgttgttttaaataattgtgaacagaaagtaaggaagcatatgcactctgatctttttaaagcgatttcattattgtaaaaaattctggttacaactcactaaattggtagtttggagcacctttgggtgtactcccagatactctctactcccctctcctccctcccacaaaaaaacagcatttctaaccacagtgactaagtcatgcacttctaagttagaaaatttatagatgggggaaaaatgtagttgaccagataaatatgcagatagttgggacatgtctaaagtgaaacactggtttcctgacacatattcattaaacatacagtcatgtcacaaaaagagattatggtcaggtgaatttattattatatgtccctcccgccccgagaatagtaccctatagtttatgaagcatgttgataatgaagttatctgtttcatatactctttatgaaaataatattttcccaagaagcctgaaaaacttacttggtcagtccaagtgagaaaaaattgaattattttgtatttagcattttaatccccaagttagaagggacatttaacaactgtactaaattcaaaaggttacttagagacagaattcctctttagatctaatatgattgtctggttttaacagtttggctttacaggaagacttggaagaccagcaaaactgccctttatttgtataaactctgcttgcatttgtgactttttttaaagggaaaaaataaaattctttataggcataatttttataaattaaaatacattatagtatatttatgtgggtgaagcttaggaaattctttataaaatgaactgtattttgaattggtcaactgctacattgtccaaaaatgggaatggtgattctgtggatgaagtggaagaacaaggctattctttactgtcaaaaagggcctttatgctatggtttaaaatctttctgcaaagcccttggatgttataccacacatcctgtagctcctacatgccaaactcccagctttttttatgtggagccccaggaaaaggtgatcacttacctgttagcctcatgcctggtggtgataagaaagatggctttggtgatactaactgaatgcctactagaagtcaaatgtgttgttgtttcaattttatggcctctctgctggtgagtatttaaaatgagaatcgagcaagtgaaagtgtgtcatagttttttgtttgtttgttttttaattaagaggaccaaaccaaagaaataggcccattttgttgagagaggcagtccaacacagtggctcaaagttccagagcttgcctgcaagctcaggcagatgctggtaccaggaatgccctgtacggataccaattcattcgtgggagatagtacaggggcaggtaatgctgaatcccagctccacttatgtccagagcacaagtgatggcacaaagccctagctctcttcatccttccactctcagcactttacatgtgttgccttcctctgatttgattccaagctcaggccccagatgggggcctcccagcaacatgtccctctccctttcctggcttaaaccaattagagtgggttctgaaactggagctggagtttatcccacagaaattgaaagtacagcagggatatttcccaaaggaaagttaggatactattttactaagaagattgagaggaggaggtgacaaaaacaacagatgtctgtacatatgtgagggtggagctgaaattgcttggtttctacagttagcattcgctcaaaacaggcagacctaagtttgcaggtgaggccagtccacaacccaactcagaggctgagacaagcaaagtaagtggaaaggagacggatggtagaaagaaataatatctattgggtgtctgttctgtgccaggatctttatgtttgtggcccagtgtacgccttgtcaccctcatgaagtggtattggaaggtttaaagggtttggagataagggtaaagatagatgtagagtcagggtcagccactgtagccaagagctttgggtagttccagggcaaactgaggaagcagacctcttagagggtaaaatgggttatgattttctaaagaggaaattcttctgtttgacctagatgtgaactgaataatcacttctgttgtttggaaagccataaagccagccaaccatgccacaatcctgatctcgcaactcacatatcttatttttcaacaaggaaaatcctttcaaagagataaatgtgaattctgtgtgccatgtatatatttgtaccacatttaatttcattagctataatatcatgtagctgtgcttatttaactgcttagcccagatggtaatgccttctgaagaaaaatggctacacagtgtaattgaacatgtcctattgacagagttacaacaacccattttccccattaaatataggtgattcaataaaatgaacacagagtctattactctgccaccatttctagctgaaaatgcaaggaggaaatgttctacaaggtgaagaaatggcacagttatgttgcatgcagtgggaggacaggcgtaaaggcaggcctcctcctcccgccttggacaaaagaggagctatttgttgacactcagatttggttgggaaccaaggggagaaccttggcgtcatcagctaagacctgtctgaaagtgatgatgatagcagatgtgaacatgaaaactaggccgtacattttggaaaatgatgtaaaaggatttggcttctaaatggaatcaagtggtagaaacagttgtgttggctctcagcagatgagggtcttgggtcttatgaatgttgtcaatcactagtataaaaatattctggccaaattagtatatgagaacaactatctgatgaagctatcactgcaaatatttttgtattcattgaaaaaaaattgccaaggcagaaggattgcttgagcccaggagttcaagaccagcctgggcaacatagcaagaccctatctctacaaaaaattttaaaattgactgggtggggtgatggtgtgcatctgtggtcccaaccactcgggaggctgaggtgggaggattgcttgagcctagcggttcaaggctacagtaaactgtgaccataccactgcactccagcctgggcaacagagcaagaccctgtctcaaaaaaaataataattacagggttggcctccctgatcctgtatatattgtctatgaaattgacaggtttggtgtggtctaagaaagtaagtcatactcgacactgaaactttcctaggaagagcactagagatgatgtgagaagatgttattgaggaaaagtttgggaatggcaccttgccatgtggcgggacttattgcagttgctatgtgtatattttttcttagttttcttcatgttttatgagtaaagacttacagtcgttctctgtctttgcttatggggaagttgagaattttagagtcaaaaagacccaaaagcccactctggcttaccctctcattttcctgaagaggaaagtgaggcccagtgaaaacccacacaactcaggagagatgagccagggtccaattgtcccttctctcattactgcattttgcccttattccagtgctaagggacttttggggatgaaaggagagaagtgggaggctggaaggagtgaggtttcttgtcctcacagctagtcacccagagaagcttaagaaatcattacaggcattgtggctcacacctgtaatcccagctctttgagagactgaggcgggagcatcgcttgagaacaggagtttgaggctgcagggagctgtgatggtaccacttcactccagccggagtgacagagcaagcccctgtctctcaaacaaatataaaaataaaactgaaaaaaagaaattacttaaaatatttttcttatgtaaagaagtacaaaatttgaaacccactctcctaaacaataggaattcgtacgaagagtgatgggcatatattatgcctccctcttcttcactcctgtccagtgtgtcctagatatgggcgtcacaatggctagtatatacctaaatgaaatgacaaaaagtgaagctgaaccttgtcttcttatggagaatatattcagaaggtagaataaaaagatattttagggtgattgagtttaaacaagtagaacctggtcactccaaccccacccccgatcagattctcaaaaattagacttagaaatcatagtcctggatgttagtcaccctttctgcaagggaattgctatctgaccttgcatattgcatgtggacaagttcagagccatcagatccacctgagaaaggaggcaggaaaagagggcaagccttatcaagctgctgtggggatgaatccagtccggtggaagaaactatcccacctctgagccctgccagcacaagccatctgtctgcatctaacaacaccatgggcctcagctctgaagcccctcccttggtgactcagcaatcaaactgttcattttgcacatgttttgtgtttgattcatttagtcactgagtcttcagtttctctgcctgctttttgccctgctgatggggaccagcctccaggtcagcacagcaggttgagcctagagaggcaatcacagtcccaggatgaacttttttttttgtccctgaaaggggcctttccaggagactccccaggggctgctgatatgctcttccaaggctttcctgattgtctgtccacccatacccaaggggaactgatgtttctatcctctcccataggccttttctaggctttttacccacttccagcctgtctcctaggggcctgattggccctctccacttctcccaaggcagcctttcttcacttgcctcagccacctaatctctgtcccaccagttttggggttttccttactccatgcgtttacctttccacacttgcacatgcacacagcaccgcatgaaaactcctaggaatctctccttcaacatggcttaatagtccttcttacctaatttcccagtgacctctgactcacagttacacaaaggaaatggacgtacacctggagcccagctgacttgggctaaggttggtcatggctctaggtttggtttaccttattggctagaagacagtagaggcccaggcactgtgtgctttatggatcgtctttctaatttacttgaacctgggatccatggtcacttctaagagatcaagtctattttactctaagtagtttctttgagtaaggttggacatttatttcccttgacataaggtaaacaagtgtgcctatgagtgtggcaacaatgaggagacattgaatcctcaagtcacattggcatgcttgttgaggcttttaaacgatctcagtatcacagttcttggtaataactgtaaaaacataatcacaggtggcacttggcatgaaaggtatgcttggttcttttttttttttttttttgtgacggaatttcgctctgtcgcccaggctggagagcagtggcatgatcttggctcactgcaacctccaccttctgggttcaagtgattctcctgcctcagcctcccaggtagctgggattacaggtgcctgccactgcgcctggctaatttttatatttttagtagagacagcattttgccatgtttgccaggctggtctcaaactcctgacctcaggtgatctgcccgccttggcatcccaaagtgctgggattacaggtgtaagccaccgcgcccggccgctcagttcttacataatgagggcatccatggatttttaaatggaggtctttatgtttccagttccgtgtcttcccaccttcagaaagcactattttgctgaatttgtctaaagggcagtagcttctagagtaaccccaggagcaggtcttctcaaaatgcctatttatcagcctttgcatgagttttgtgggagctggatagaatggaaaaagaaatgaggaatgttcttcagatatgacattgtacagatctattcttccaaagaaatttgccttgagaatagtactccagacatggaaggggctctaggtatttaggctatggcagaaggtaacttgtaacatcttttcagaatttttgcaacctctgattctttatttgacatttttctttcttaataagatgcacagctagtacagcagcatcctgtaatccatggatttggatgttctgggcgtaatcatccctcaaaatgcaatacaggtgtggttagtctaagccatcttcctgcaaaaactttctattcctcatcccctccttagactccctgtttttgtaatatgttgtcaactgaaccacatttatcataaaatttatcattttctttgtatttctactgagatctagatagtcatcaacatgggacatctttccagcttgaagcaaaaattcttggtacttaggtatctcctgtagccttggtagaggcatgtgtggttaggcctttctgaatattgaaaagagctcccttatcccccagttggatccatggaactcctggtcccaaccactgaattcagcactgccttgtttttgcctcaataccacaatgatggagagaagctctactttaggattcttatctgacaaattagacagcaggaccccttctaccttctaatatattagatttaataaaataggcatatactctctactccagagaaccaaatgcctttcagcttgggaaactaaaatacaggggtgtttgatttgtgtgtggttttgcttgtttgttttgagactgagtctaggtttgtctcccaggctggagtatggtggaatgatcatagctcactgtagccttgaactcccaggctcaagcagtcttcccacctcagcctccctagcagctgggactacagatatgcaacaccacacctggtttattattttttttttaatagagacaaggtcttgctttgttgcctaggctggtcttgaacccctgacctcaaatgatcttcccacctttgtctcccaaaatgctgagagtgcaggtgtaagccgccatgcccagcagagtgagttgttttttaagatcacactgcaagtttatgtaagaatcacttgaataactttttgttcctgttgggttaagctggtgggctagatgcttggaagttgtagaccttactctcaagaagtttctgtgcaagagagcaaataagcaataagtaaaattaaccacattcagcagtaaagaatgattttaagccaacagtttatgatgcaagatttaagagaatggaaaagaagttatttcttttaaaaaaatcgtttgagatgaaattcacgtaatataaaattaacaattttaaagtgaacagttcagtaggatttagtatatccacagtgttttacaaccactgcttctatcttgttcccaaatattttcatcactccagagtaaaaccccttacccattaagtagtctgtacctatcccttcctccccattgcccttagtccccagtaaacctctgatctgtgttctgcctcttcagatttatctattttggaatcatacactctgtgaccttttttgtctggcttctttcacttagcataatgttttggaggttcagccatgtatgtgtgtataattactccactcctttttatagctgaataatactccagtatttgtatataacatgatttgtttatctgtacatgcactgatggatgtttgggctgtttataccttttggctattgtgaacagtactgccatgaacatgtgtcacatatacttgtttatgtacctcgttttggttcttctgcatatatacctaggagtggcattgcaggacgatatgatacttctacattaaactttttgaagattgccgaactattttctagaatggctgaaccatttcaagttcctaccagcaatatatgagggttccagtgactccacatcacttccaacacttgatattttcctttttcttaaaatagccactcttatgggtatgaagtggtacctcattgtaaatttgatatgcattttcttgaccaatgatgttgagcatcttttcatgttttttggccatttttatatttttttttagagaaatgtctactcaggttttttgctcatttttcaatttggttatttgtctttttgtcattgaattgtaagcattctttatgtattctggatactagatacatatgatttgcaaatattttcactctctaggttgtcttttcactttcttgataataaatgccttttgatgcacaaggtttttaatttgatgaagtcttagcctgtttattctgttgtaacaaactacttgacactagagaatttataaacaaaggaaatttatttcttacagttatggaggctgggaaatccaagaccaagatgccagtagatttgctgttgggtgtggggtgctcgctctgtttcaagattacaccttgttgctgtgtccaagtggtggaaaagcaaaaatgccaaactctgtgtgaagcctcttgtataaaggccttagtcccattcaagaggaaggagccctcatgacccagcctcctcctgaaggcctcacctttaaaactattgcattggagattaaatttcaacatgaattttgagaaacatattgagaacatagcaaagtccagtttatctgttttttcttttgttgttaatgcatttgatatcacatctaggaatttatggccaaatccaagatcatgaagatttaccactttactttcttctaagagttttatggctttagtttttatatttaggctgttgatccacgttgaattaatttttgtacatggtatgaggtaggggtccaatttcattgttttgtatgtggatatccagttgtctcagcatcatctgttgaaaagattattcttttcctgttaaatagcttaggcatcttgttgaaaataagttggccataggcatatgggtttatttctcaactctcaattctatttcattggtctgcgtgtctatccttatgccagtagtacactggtttgattactataggtttgtaattaagttttgaaatcaggaagtataagtcttccaacttttttctccttttacaagactattttggcgattgagggtccattgcaattccatacaaatctgtggatcagcttttgcatttctgcaaaaagatcactagaattttgatagagattgcattggatctgtacattaccttgggtagtactgacatcttaacaatactgtctcccaacccatgaacacagggtgtccgtctatttattcaagtcttttaaaatttcttttagtaatgtttattttataattttcagcatataagtctttcacctttttggtgaaattgtttcctagatatttcattctttttggatactagtgtaattgtattattttcttaatttcctttttagattgttcattgctgatgtgtagaaaaacagctggttgagaatttttgcatcaatgttcatcgcagatattggcctgaaattttctttttttgttgtgtctctgccaggttttggtatcaggatgatgctggccttataaaatgagttagggaggagtccctttttttctattgtttgtaatagtttcagaagagatggtaccagctcctctttgtacctctggtagaattcagctgtgaatccgtctggtcctgggctttttttggttgttaggctattaattgctgcttcaatttcagaatttgttattggtctattcaggaatttgacttcttcctggtttagtcttaggagggtgtatgtgtccagaatttatccatttcttctagattttctagtttatttgcatagaggtatttatagcattctctgatggtagtttttattactgtgggttcagtggtgatatcccctttatcattttttattgtgtccatttaattcttctctcttttcttatttattagtctggctagtggtctatctatttttgttaatcttttcaaaaaaactagctcctggactcattgattttttttttttttgaagggtttttcatgtctctatctccttcagttctgttctgatctatactggcaaaccaaatccagcagcacataaaaagcttatccaccataatcaagtcggcttcatccctgggatgcaaggctggttcaacatatgcaaatcaataaacataatcgatcatataaacagaacaaatgacaaaaaccacatgattatctcaatagatgcagaaaaggccttcgataaaattcgacaccccttcatgctgaaaactctcaataaactaggtattgatttaacgtatattgaaataataaaagctatttatgacagacccacagacatactgaatgggcaaaagctgaaagcattccctttgaaaactggcacaagataaggatgccctctctcaccactcctattccacacagtattggaagttctggctaggcagtcaggcaagagaaagaaataaaggcattcaaataggaagagaggaagtcaaattgtctctttttgcagatgacatgattgtatatttagaaaaccccattgtctcagcccaaaatctccttaagcagataagcaacttcagcaaaatcccaggatacaaaatcaatgtgcaaaaaccacaagcattcctatacaccaataatagacaaacagagagccaaatcatgagtgaactcccattcacaattgctacaaagagaataaaatacctaggaatacagcttacaagggatgtgaaggacctcttcaaggagaactacaaaccactgttcatagaaataagagaggacacaaacagatggaaaaatagtccatgctcatggataggaagaatcaatatcatgaaaatggccatactgcccaaagtaatttatagattcaatgttatccctatcaagctaccattgactttcttcacagaattagaaaaaactactttaaatttcatatggaaccaaaaaagagcctgtatagccaagacaatcataaggaaaaagaacaaagctggaggcgtcatgctacctgacttcaaactatactacaaggctacagtaaccacaacagcatggtactggtaccaaaacgtagatatagaccaatggaacagaacggtggcctcagaaataacaccacacaactacaaccatctgatctttgacaaacctgacaaaaacaagcaatgagagaaaagattccctacttaataaatggtgttgggaagacctgctagccatatgcagaaaactgaaactggaccccttccttatactttatacaaaaattaactcaggatggattaaagacttaaacataagacctagaaccataaaaagtctagaagaaaacctaagcaataccattcaggacatagacatgggcaaagacttcatgactaaaacaccaaaagcaatggcaacaaaagccaaaattgacaaatgggatctaattaactaaagagcttccgcacagcaaaagaaactatcattagagtgaacaggcaacctacagaatgggagaaaatttttgcaatctatccatctgacaaagagctactatccagaatctacaaagaacttaaacaaatttacaagaaagaaacaaccccgtcaaaaagtgggcgaaggatctgaacagacacttctcaaaagaagacatttatgcggccaagaaacatgaaaaaaactcatcatcactggtcattagagaaatgcaaatcaaaactgcaatgagatacgatttcatgccatttagaatggcaatcattaaaaagtcaggaaacaacagatgctggagaggatgtggagaaataggaatgcttttacactgttggtgggagtgtaacttagttcaaccattgtggaagacagtgtggtgattcctcaaggatctagaaccagaaatagcatttgacccagcaatcttattaccggatatatacctaaaggattataaatccttctactataaagacacatgcacacatatgtttattgcagcactgttcacaatagcaaagacttggaaccaacccaaatgcccatcaatgctagactggataaagaaaatgtggcatatatataccacagaatactatgcagccataaaaagggatgagttcatgtcctctacggagacatggatgaagctggaaaccatcattctcagcaaactaacacaagaacagaaaaccaaacaccgcatgttctcactcctaagtgggagatgaacaatgagaacacatggacacagggaggggaacatcacacaccagggcctgttggggggtggagggctaggggagggatagcattagcagaaataccttatgtagatgatgggttgatgggtgcagcaaactaccatggcatgtgtatacttatgtaacaaacctgcaggttctgcaaatgtatcccagaatttaaagtgtaataataataaaaaaagaaatacagctgatttttgtgtgttgatcttgcaattttgctgaattaattttattagctttggattttctgtacatagaataatgtctgcaaatagagaggccatttctttctttttcttgtctaattgccctgggtagaacttccagtgcaatgttgaatagctatagataaaagcaggcatcttcatcttgttcatgatcttaggaagaaaagctttgtctttttccactgagtacaatgttagctgcaggtttttcataaatattctttatcatgttgaggcaattcccttctatttctagttttgtgagtatttccagcatgaatgggtgttgaattttgtcaaaggctttcttgcatcatttgagatggtcctgtggtaagtaaaatcttaaagagtaggactgataacagatacagagaaatgcgattctggagaagtaagtaactaacttacagtggtaggtgcatgactagtatctgcagagattagtgcacaatctaaatcactgtgtagagtattgggggcagaggactgaatgcagtacaggcaagggcagattctgagtagatcagggaggacttgattgacagattgccttcatcttgtctccattctggagatccttatggtttctgagcccagtcaaactaggaattgtacgccttgctcattgttctctccttctgtgtcttcacttctcttccttctattgactttcatgtccctctaacaatctttcctttttaattttggtagaaaagtgtcatgtaaaacaaagaaaaaatggagttttttggtactgtgtgataaatcttatgattttttagaatttaggagtacacataaaattgagaggtgagccaacttttttgttggtttatttctagttatgtatggagatagacctgctaaccagccaacagctagtgtcagggctgtaaattagactggaggaaagaatgaactgcacatttctagctcctgggccaaggttcctgagatttttgccagccctcttctagacagcagcttggtacctcagctgtccttctcatcagggagacagatggaacctctgaggtttcctgttgaggcgtctcagaattcaaagttgttatgatgtgtgggctttgaaaatgccacacgtcagggaagctgagtttttgtttctcaggctttcttatattgagcatgtgttcctttctgtctttgtggcattaagtttcattatgtgtgtccccaagccttttcctggaatctcaacagaggatgggttttagctctgttggaagttacattccattaagtgtgctcaaagatctgctttactacacactctctcctgcccaattcttaggccagccccttttcctctccctactcttgtctaattagtcctctccttcaaaaggcagccctttcatgggattctgctccccgaagtagtgggccctgacttaagggccagcccatctttgtccatggccatacttatcagggatgtgactatttagctctttaaccaggagtctgtcctttctagagaccttccagcatactattaacctaagtgcataggcagaggagaccaggagcacttggtacaaatgttaatggctttttcattagcgtacttcatcacagaattccagctgttggtggcaggaggtgacagtgaggcgtctcttggataagaaggacgtggagatctacggagatgaaaactgaaaagatgcatatgattagtcatcagaaagatgtttgacttctaagttttttccaacagcaggtatggctgcatggaaaatgcatacatccattgttgcaaggcctttatttccttatcaccatcatcaagcagtattaatgaagaagccaattgtgcatgacatagtgcaggtctctgtatgtagttatggaaaacgcttccacagttaaattgagtatggatatgtaaagtgattaaccaagacttgacagctcacacaattctttaattgcagcaagcatctcaagtaaatacataacttttaagaaaatccagaactataaagtcttaatttttgaaacaaatcatgatctttcacgttacaaacagatctttctttctaaaaagatgattcacaatcttttatgctggaacatcaaacatagattttactttacttctttttaaaataattggtttgttaacagttaggaaagccatacgtgttatttgttaaaaaaataaaaataaaatggaacaataaagaaaatgtatccaaactataaaaagcaaaagtcaccaacttgtcccagctgcaccccctccaccccacccatgtttctgttcccacaggacaaccattgctagcatttctctctgtagttcatctcttttgaaagtacatatgtaagtgtgtgttaaatgattatttcagaatttatattgataaatgcctatgttttctattatttcaatttgcccacatggagggtgattgttttttagtgtgttcccttagcttctggaatacaaaagctgatgcctgtataccttgactttgctgacggcagtggtagtgagtttagtgctttctacttttagctttatgttttgcactatttttgaattatatcaattagctatgatgtatacacattcaggattctttaattttgggtaaaaataattcttcactctgtgcctacttagctaagaatatctttaacagaggcagagctgtgaaaccaccgagcaccaacactgcctctctggcttttgcagggacgcttgggtttcaggctgtaactcttagttgcattagcctctgataacttttttgttaattgataagtatgtgtatgactcatcaagatgctggttgctcagtaagataaaattatattctctaacactacttctcctttagaagcttacttacctgccttggtgtcttctgtctcggtcttactttgttttttagtttgtagtttgttcttcagcttactaaacctctttcattgactgtggtattggctaccgatttaaaaatccttgaagacttaaaactcagcagacacgtacagggtggacccctgctttttctcaagtctcccttcatctccaggaactgaatttttcatgcagtaattaaaatttgtaggtcaagcctcccatggcaccgtttgctgctaatatgggaaagcagtgatcagattcgcttatgctgctcttcactgagctgagacttaaaggatgaagggtgacattttcccccattttgtaaattaatgccattgatctgcctaacaagaacaaagttaggcttcaaaataccaaatgataaagagattaagactttaaatggctttccaaaaggcaacctctattgtaaggctccgagctgactattgaactttcaattagaatttctaataggctattgacttaaatggacaaaatgttacaagtgatagctttcaagatgacaaagattgcttcttacgttctggaatattactttatgtagcgtgcactgttctggagggtgaataataataaactgccctccccctgtagagtgtcttctgcatctgtgctatagttttctcaaaggtgaataaatgcattttttaaaggcatttttgaaatacttgctttttcatgtgtttgctgaacacaggttttatgaaacctttcatggcagggaagtcccattagtctttagcactgtggcactattcttcttttatgaaaaatagcccatgtggtatgtatttctctgcacacatgtgtgttcatgcatgttaacatgtgtgttcacagttgggacaccagcagatctgttgtctatcattgccatgaggatcagtccctgaggccttgctctctgcctcagtttactgttgttggaagctatgattcttttccacaatgggcttgcagtgtagtgtgactcaatttaggccttgttgtgaaacactagctctaatacatttttaaatactaattttacaaagaccagctacctcttctaggataaagggttaatattatgcttatgttacagtgcattaaaaactctaattaaaacagcattacattcccatctgccaatctccagtaatcttctttaattgcagtaattaaactatatttacatgttcagaatacttgtaatttagcaaattgcactctctgctctacatttaatcaaacaaccagttccagtatatttagtgtggaaagaagtaatttcaatgttttgattactatagcagatttgacagagtaagtgcccctctagtagagggcttgaaagggaaggcaaacatgaaatatagtcatggttttgattgtcatgtgaatgcctaattacatgttggaggattaactattaaagggtatcatggttgcagttgatgtttagaaacagccggtattacagatagcatagactgtcttttaggaaaatttcacaagaagttttctctttaaaggttgtgagatcataggaaaatttagtgaaaagatcgcctacattgtataattgttattatgtcttctacctgtgatcccaaagcctgctatacaagatggttattttagtcttcccagttaaagcccagaagaaattcaatgataaacaaccaagagaaattgcaatgattatatcaattcagggatgagtattccctcatttcggtatcttttggcaagtctggttgactctggagaggacatgtggtttcctggaaaggactcatcagtagaagtcaggctttttttattttaccttttgctgctgttgttgttttaaaccatgactctctactaggctgttccacctaacccatctccagcctcatctcttatttatttatttatttatttatttatttatttatttatttattttgagacagagtctcactctgttgcccaggctggagtgcagtggcgtgatctcggctcactgcaagctccgcctcccgggttcacgccattctcctgcctcagcctcccaagtagctaggactacaggcgcccgccagcacgcccagctaattttttttgtatttttagtagagacaggtttcaccatgttggccaggatggtttcgatctcctgacctcgtgatccgcccgcctcagcctcccaaagtgctgggattacaggggtgagccaccgcgcccggcctggcctcatctctttttttcttggttttctcattttaaaaacaagtaacagtgttgtgaatattgattagattcaaaggaacaatgtcttagtcatctcaaagctatttttaaaattcttattgttattatctctttgcaccagtatgaaagtttctgtttctttatctagataaatttgactgggatattgggtattgccatcaaatctctgttatccaaaacaacgtgctaatttattcaacacagaaatataagtaatactctctttttcagtagcttctttttaattatttgatgttaacagtatttctgagaatttttctctctctccacttcggggtcatctattgtattaataaggattatgaattaatgaaaacaaaaagctagtctagcgtacctgtttaaaccaatgtgaaaccttgcttcttgaccatatgaaagagcaaagctactgaattgttaaaatgatatgcaggagtgaggatccaagattttcttcatgggtcagctagtaacttactgtgatactgagagcaacatgtttgactgatttaagtctcagattgttcaaggtggggtagagaatagggcctggatttttttggttcatgaagagtcttgacataaagtaagtattagactttagactgtcacaggaataaccattcagttcaaatctacactcatttctgtgttagattagtgagaatttaacttctgaaaaaagttcaggcaaaataccgctgatgtactgcactaaggagatttgagagtgccagagatactttgaaaggaaaagagatgtaatttgaagtggaggacagggctagccagggttaaaattgcagctcttttacttagctatttaataccaagcaaattaccttatcctctgaggtcttgtctgtaaaaatggggataataatacatacatagtactacactattagtttttctctcctatgacttgccatctgtgtccatgtatggagagaaacacacacacacacacacacacacacacacaccccgtaataagttaagagtctttggaatggtaaatgatttgaacataaataccagtacacattttttttaataatgcagcataaatgtcaagatatatatgcataagggatgaggtgtgcctagaagctgtaatatctagaattttcgcaaaccttatttataaccatttgtttctgaaccctaacaattcttttctgaaactgttaactgaaagatctgaatctcactatttatttcacactcttcacatagaggtgctaatgagcagcagaataaccccaaaaatggtccttaatccaaacaccgagaagtcaagttataagtaattaagaatacactggatggaacatacctacatggcagctagcatctgtgctttccagaggttgctggggacggttagttcagttctcatttttgatcctctttggaaactcaggagttaaggtcagcatcctcagtacaaaggtacttgaacatgtatgaatctttgccttcttgaaaactttttatcttgggaataaggaacctgatacaaagagaatctctagtatttcattccatcgagagaagttttgacatttacaattctgctaatttcacacatcatttcgcagcatgcaggattttggcgcctgccaaggggactgcaaattctttttggaaaaagtacttttttgggtgttggaagagttttgagttacagacacatttctttaatagtgttcttgaaatgtccatgtggtcttaatatgtaaatcatatgaaactcaaaacccactcctgaacttactcttccaagaaagctttaaaacagccctcattctaatagtaaggctgttttcctcttttccaatgtttatgtatactgtataatgtttactgtataatgagtttattgtataataagggactctgatttattagctcttcattattctcattctgtcagcttcccaataaatgctacaacccttggcagagacatgagtctcaatcaggtgatatcattgctttttaatgaactcttcttaccggagtaacagcattacatgtgaaataccttatcctgcattattaacggaccgcagcataaaaggcacaaaggcactgagaaggttgcactgaaaaatggggcagaattcattaccaattcgatatactgtcagctaacagtctttgattatcatatttacccttctgaaactgtgaaaaatcatgggcggagccgctgtgaacaatagcatgtgtaggcattttgtaaatgttgccttagttgtttaatgcccaggctgactgctggaatttaacacagtgacaactttctcagatggggcatgaaaaaaactgtgatattttactacctgagaagttaagcactgagatagttaggacccagctctcattagctgaatggtagatttttctaattagttctttctagtgcaattagcacgaaaagagtctaatcacctcatgtgaaaccaatctaatgctcagaaaagaattcccttggcctctctttcagattggatcttaggattttcagtctgcctccttaaagaatggaatctgttagtgactgattatttgaacggtaaggacagatctgtagaaaaggcaagaaatggacaacttattgacttgcagtgcaagtttggctggagaaggtgtttagaaatattcattaattggcagttatcacttcaactataggttctggttttcttgatttctttcattttgaaatgggagacttgggcccgggacagctatagttcagcatggctgcctctctggagggcatgaaacatactgcacattagaatcaaatgcattcggggcctgggactactgggcttgctttcttagcctctgcagtgcccagattcccccatcagtttttgctaatctgtgtgttcagggctttgcctgtcctctctctctccctgccttgcagtcatctgtaggcaccacattcatttttgaactgttctctaatttctagtgcccatccatcacttcacatttcttaagtaagccaactctgggcatctcagttgatattgttcatttttaactggaaaggaaactataatgacagcatttctggcacataattttttctttttttttttttgcgggggggaagtcgcttgccagaagatcgatgagaaaatgctgagtatgtgtgtatttattatcaactatgcagaaaatgggcatccttgctcatcaggctacagagggtgacaatattgaatttccattgttcatcccatcactgcccagtagaacttcccatgatgttggaagtgttctgtacctgcactgtccaatacaggaggcactagcgacatgtggctgttgagcacttgaaatgtggctagtgagactaaggagctaaattttaaaatttcatttaattttaatgagtttaaatttaaatagacccatgtggctaatggctaccatactgaacagggcagatgtagatctcttccacctcctaaccactgtaccccaccttacacatagctgcatccttaacagagaatacactgccctccgcagcctcttgctatccattctcttcagctttgccttaaaagcaatcagactttttccagtgctgtctggagtttgacacaaggcattcccttggcttgtgctatctgtagatcattctgtatttcaccgtggcagtgttttgttctaaagttggaaaagaccttgtagttttttaaagagccaaaatacaggattgtttctaagaaaggaggtggccagaatcagtaaatttaagctcatttgtggaagcttccaaatctcaaacctagggcagtattgaacacctctccaaaaagtcagattaagtatttgcaaatggcttcaacaaactccctctctatgaaattttaattatagttgattaaatattcactttaatcatcttaattaatgatatttgacaaatattttagctttgcttatgatattcacttgctctgtcagaactctccagttcacactgaaagggtaaagttaacaacctggacagacaggcccatcatgtgtgttatgacctatctggtttcctactcgcatggttagaaggctcattttattgctttgaactctggaattaatcctgcttaaaggagaatagtaagaatactgtggttttctgctcaacagaatgcatgttcatttattccacagacactaattgaaggcccattgtgtgctagtaattgtggtagtcactgagaacgcatggatggaaagacactatctatcccactggattgtaacctcaagccactggaacataaacagttaaaagtactatatgataaatcttctggaagacgggtgatggaatgtaagggaagaaacactaagtggtggtttcaaaacagaaagacttttaagatgtaacatgtaagggaaattttatggatataagggaatacaagggagagtcttaaggggattacaggattttgcccgggataaagagaaggtggggcatttgtgaaggggattatgttttcctaattaactgtattcttgaatgtctttgaagaaaggagtctctcctttcttcattttgtaaagcaacagtgtgtgttagaggaattgctgttaggaaaggaatgaggatatttggtgtgtaactgtgagtgctgggaaatgaaacaaaaggcagccctacctcaggtcctggaaaggcacatagtggtgtgagtgttgcagcccattgaagctacatcctcaattctggaaactaacaagaacagcattagggtgaggccagagatccacctaaggtgcaaaatgtaagggggcactcactttgagggtcgtgcaggttcaggatcagtactgacacaaccctgagaatgagtgtctcctaaaattgtgtgccctagacaccttacttacgccctgaaacatcccagccctgggtttttgtgcagtgaatgggcttgaaaagcaagtagataagaatctgaaccatggaaatatggcagacatggcagaatagaaatcaatgagacctatttgcaaggtaaagtcaagagaacctagggcagaaaaaaatacgaggcatgagagaggggaccctaattgtcctgtcactgaattctggggatcttttctattgcctgatactgacttttctccaatttctcatattcctcagctcctgccctgtcctgaaggtcatgcccagttcaaattcagcccttacctctttgctaagtcccatgccctcaaccttgttttcagagaaggccatgagaactggagtttttaaaatgtccaactctagatagatctgctttactgagtggtcttaacacattcagagaactgcattcttcttggctctctaaattcagtgaccttattttaaaagatgatcaacatgggttagaaccttttgaggattaggagacattttagcaagtttatcaagaataagcaaagatgacatttggctagcagtatgtctcccccaccccatcctgcaaaaccattttttttggagtgaagcttttccatttgacaagtttagaattaccaatactgcttgcaactccttccttactccaaactctgggatgttttcaggagggactcttttcttcaaaggcatccaagaatatagttaattaggaaaacatgcaagaaaagacatcttggctcctctggccgcctgttgtactcttccagcatatgctattacttgtctcagataagtagacaggtggctgtttgcaaagcagggtccaatgtgcctttgactcagagaagtttggaaacaaagccctctgtataataagcttctcactgtatgctgacgtcttctgatcttgcctattccccattacctacagtctgaaagaattttgtagggagtgtgtggtattctgcagaaggctattgtagcataacttagacttagccggcatttattgggcttagaatcacaaaatctcaagattgggtgactactggatggttatctaatccaacttccctccagaaagtctcccatacagtttttcccgcaaagtggccctcgagccataacttcctatgacagagtgcttactgcctctttgttcaacgctggtgaaacctcagtgatacttataagttaactttcattccttcagcattcttctctttagtgttaatttctttgatggtggtaccactttccaacttttatatgtggcctcttaaaatcagcttacccagagaaacttcctgcctagctcctgatttatgtagcttctcaccaccatgccctttctcccttcttataggggcagtttcacaattttgaagctccttgattcccttgagccattgtcctttccaaaacttgtcactatgaaaagtagactatgttttagcctttgaactataaaatctgcctttcagtaagcttagctccatattttgaggtctctagatccccccttagtatgcatcatgagacttgtattactcgccaagactctcatgactttcttcaagcattcagttttgtctaagaagccatcgtttgatccagaatggagtagacctaattatatctcctgtttttttggacttgaaatttacttcaagcctgatgataacctgttggtcagatgctctgccattaactaaatgacaccatcagcaaatatccagatagttgaggtcccagtgtcctgaatctgtggttttataatctatgtcagaagtctatcattttttttttcacctggctgtcatctggtatattctcaaaaggatatcacttttcttcttatccaggtacgtgccagtgtgcttcatctctcatgctcatggatctccatgcaaattgatctgcttttccaaaaactatttattaagcattattatgtgtctggtactatgtcaggtggtagagctacagtggtgagcaatggaaatctacgtgttttttgacatatgacactgcttttccacaatacctttcccaccttaaatcctatcccatgagcctgggtgatactcaggagattatttttatcatgtctctaaaaatctctgcttattttataactgatgatacatagacatctaaagagatgagggcctcacacagggattggccatgagagaagctttcagtgctgcgatctgaggccagtctgatctgacaccctcttaaaggctttcaagtataggccactgggttccacatcccatacctcttacctccattgtggctagtttctcatttgcggaggaggttagagatgttactctcttcccctccaccttcagtgtaaatttctcttaatcaggtcagctcacctccccaggcaagcaaacacatgtctctctgtcttcctgagctacccccgggaaagtctgcattattttagtaccatagacacagtctagaaatctgattcctatgggttgacaacatcctcatgacaaacccttcacctaccacatcatcttatttttataatcaccgaactttgttaggatgaagaactagagcactcaccaggcacccaactctgcgccaggctccatggtccccaaatgaagcttcctaggtctcttgtgtccaagccattcccctcacgtgaaacaacatgaataggtagagataagtggctttgtgacttggaacagacagtagcccaagaagaccacatgcctcccttctggccacgtgaactacatgaagcagtctcctttctgttcagccaagagtccgtgccatctcagtgcttgttttccttcctgtccctttatctggctctgtgcatgactgtttgagcagcctgtgtcttctccttccagccacacagagtactggtaacttctcacaggatattgcggtgtgcctccgtttacactgtctcttcttcctggatgctttcctctatcccctgcaatcacttcttacttacctgaaacttacttcttgtattactgcttaatgacagcttaacttccatgatacctccccacctccttctgctcaattctaggtttgagtatgtgccttcactaagtcctcccataatacctaagcaggtctctatcacagtccatacattgtttcctgtgtgtgtctgtttcttccattagactataatttccttgaggactgctcttgtgcctcactcatctttgtgagtacagtgccaagcatacagtagatgctatttaatgaaggtgggcatgtatgggtgaatattcccagtgtttcaggatgttttttctttctcctctggcttttctattctctgctcacctggaatgagagcggataaaataatacagacaggaaaccaggaagcagaagagaaccccagccacctacctacacttccccctcttagatgccctgcaacagagatctgtcctggggactccacctcatctttgccagcggtgtgcagctggcttcctaaaatccacccagagtaggggttagcttgtcagaaaaatacaaattggatgtcttctgcagggctttgcacagtcccctcagcacccacacttctgtgtcagggaggggatgcagggacacatctccttctaccctctgggagacttgtagtctacggctccaggagatgactccctggcctagaggactgtatccttaaaccactctctgctctgctggcttatgtcatcctcctgctcctttgggtagaagttctagagtcttatccacaaattgtcaccagttataggcttgagtaggcactaaatatgaaacatgaataatgacatgagccagcagagcagagagtggtttaagagtggtttaagggtcagagggaagggaaatgaaagccttggaggatttcagattcactcactcttctttaccttatagcctgtgctgcaaagtcagagtaaagaaacttctgttctgcctcattgcatccccaccacaacaggctgtaagcaggagctactccatgttttaatataaggaaactgaggccccaaaaattaaaaataactttatagtaccagctagccattggcaaaacacgattatacattcagatttgtccaattgtttccccatgtaaatgagaccacagattaaaattattattgtcaattaagaaaaaataaaagaaacccctgaaaagaggatctgatatgtgtctaactacctttaaatctccttgagataaattataaggtgttgtttctattgagccacccccatcaccagtttctcacaattcagtgctcagcaggcagtggctactcaagaattccagctggctgggcacggtggctcacgcctgtaatcccagcactttgggaggccgaggcgggtggatcacaaggtcaggagatcgagaccatcctggctaacacggtgaaaccccgtctctactaaaaaatacaaaaaaaaaaattagccaggcgaggtggcgggcgcctgtagtcccagctgctagggaggctgaggcaggagaatggcgtgaaccccgggaggcgttgcttgcagtgagccgagatcatgccactgcactccagcctgggcgacagagcgagactccgtctcaaaaaaacaaaaaacaaaaaaagaattccagctaagtggcagtgaactaatgagatttcatcacagagcatggtgaacgcttttctaaggtctaaatatgtgctctatagttgtcatggagggccaaagaaatgaagaaaataaagaacaatattagtcttaagaacttttttaaataacaaaaatgactgagttactaaggtcaggaactattctaatgcttttatactcatctcatctaattgctccaaaccccatatgaagtagacactactactactatcatgacccattttacaaatgaacaaactgagtcttgaagaagctaagtaacttgccaaagcacatcccagacttacaggcagtctggctcagagacctctgctcacagacactcctcttcctgggtctaattcaagaggggtgacgtgcgacttagagcagcctgtgggcttagtgattctgctgcttggtgcacagcaagacagaccataatcagcactagaataatagaatttttataagtgattaaagtaaaaccaggatttagagattgagagttgattgttaaaggataaatgatatttggaacatcttactggatttgattaaagtgaaattcaaaaaccatcacaaagagaatgattatttaccagtggtacttgaaggactttttttgtggcttaagtcattggcactccaatgcttaaaatctctgtgctcaaaaccagaatgtaattgatccttagaaaatcagaggttagcgccttctttggcaagctacttctgagctttgttacactgtaacataatcatcctttgaagactgagatctggttttccaggcttttttttttttcttcacatggtgcctggtatcttctcttgaacataatagatactttgagatgggtggacaaaccgaagtcattttatattgctttaggggctctgaatttaagaaagagttgatttctgaaagaaacataatagcaaagattacttaaacacaaaaatctcatttctgttcttaatcagctggacgtcaatacccaggttccagtccaagtgtcacactgtgcctctataagttaatcttttctggaagggaaaccaaatatgaaatagtatcaagaactgggacagtgttggaacaccctgcatgtcctctgttggccactacaaaaggttaaacaacaggagaggctggattagggtttgtgtttggaagtgcatttgaggcaagcttgacagttaagctcatggccagtactacatgccacagcaagaggacaataggagatttaaaagtgtgagcaggctgtggccaaatgctggaattcatgggctaagtagatgaagagtggatggagttaactagtaaacaagtttcatggtccttgaagagacctatttttttttatggtatgaatttaagatgtacaacataatgttttgatatacatacaattagtgaaatagcgataatttgatatttcatatatataccaaaatgattactctgggtgtattatttccttctcatgctgctaataaacaaatacctgagactgggtaatttataaagaaaaagaggtttaatggactcagttgcacatggctggggaggcctcacaatcatggcacaaggtgcgaaggaggtgcaaaagtacgtcttacatggtggcaggcaagggaccatgtgcagagtttataaaaccatcagctctcctgagacttattcactatcacgagagcagcacaggaaaaacccaccctcatgattcagttacctcccacctggtccctcccatgacacatgggagctacaattcaagatgagatttgggtggggacacagccaaaccatatcaacagggaagcaatttaacatatctgtcaccttccatatttaccctttttatgtggcaagaccacctaaaatttactctcctggcaaattttcagtctacaatattattaactagagtcctcctgccctacattagatctctagacttaactgcaagtttctgctctttgacctatatctgcccatttcctcctcctccctacccctggtaaccgccattgtgttttttgtttctatgtctttgactgttgttttttagatgccatatatgagtgagatcatgcagtactttttttttctgtgtctggcttatttcacttatcatcgtgttctccatgttgttgcaaatgacaggattttgtcttcttctttttttttttttttttagatggagtctcgctctgtcacccaggctggagtgcaatggcacaatctcggctcactgcaacctccgccttccaggctcaagcgattctccttcctcagcctcccgaatagctgggattacaggcgtgcgccaatacgcctggctaatttttgtattttttttagtagagatggggtttcaccatgtaggccaggctggtctcgaactcctgacctctggcgatccacccgcctcagcctcccaaagtgtctggattataggcgtgaggcaccgcgcccagccgatttccttcttttttaaggagatgtatatgtgtacacacacactacagcacattatcacattttctttatctattcatccattgatggacacttggttgatttcctatcttggttattgtgaatagtgctgcagtgaacatgggggtgcaggtatctcttcaagatgttaatttcattttctttggagggattgctgtgttgtatggtattctatttttaaattttggtggggtcttcatactggttttcacaatagctataccaacttacattcctcctaacagtatacaagtacctttttctccacaaccttaccacataagtgttgactttttctttttcttttttcttttttttcttttttgatacgaagtcttgctctgttgcccaggctggcgtgcagtggtgtgatctcggcttactgcaaactccgcctcccaggttcaggtgattcttgtgcctcagcctcccacgtagctgggattacaggtgcctgctagcacacccaactaatttttgtatttttagtagagacagtggtttcaccatgttagccaggctggtctcgaactcctgacctcaggtgatccacctgtttcggcctcccaaaatgctgggattacaggcatgagctaccaggcccagccttgaccattatttttaatagctaacaattattgagggcttaccatttctatgagtctaagcactttacaaatatttaatcttcataacaatctctgacatagatactactgttaatcccatcacacatactaaaaaactgaggcacaaggagtttaaggaactcgctcaaaatgtcacaattagtaagtcatgaagccagccagaacgcatgctcttaacccctgcactgttctgccaactctttggagtggtttgtttcagttgtcagtttttgtttgctgtctctgaaaatccttgctcttacagtgtcagccagagtcctgcattgatcacatggcctaacttgcctctctcagtacagtgactttttaatcttcggctgcaatcctttttttcctagactgtaaactccctgagggtagaaagtctgtctcattcatttgtgcccattttaatgaatgttgaaagggagcgtcaggaggggttatctagatgcctgtggatctagattattcatcatccactgggatctttattggtgttccttgtccccaaggagggagtcagcagcaacagaaggcagcagagatctcatcagtgttcatcaaacacatgttgagtgcctactacgaggtaaacagaacagacgttatcttctgtgccctctcagaacttaaggtacagcaaagaaacaaatgagataagcacaggtgtgataaatgcttgtttaaaaaacattttaaatgaaatgcttcgtttaaaaaaagcgaagaggctgaggtagagaataatggaggttgggtggggtaggacctactttaggtaggtaggcatgggaaattcctcatcgaagaagtgacattctaagcgaagatttaaccaacaagaatgacatagctaagaatgagaagactgctggggaagctccttgttggcaaagaaaacagcatctgcagaggctctgaggttggaaaggctttgtttcatctgtttaatagtggaattcagtgacactcattagttacctcttcacacattcccgccaaacacttgtccctgagtctgttctttttcattagtggttcctaatccagttttcaaaactgctcaatatttggagaggttttgaccagttgctctggaaacagaggcggttccaccatagccaacagagttcagaacataaattgtccatttatatccccatttgtatcttaagcttagcttgcataggactcagcaaagcaatatgtcaaattccttatatttgttatatctcttttttcactgactcaaagcatgaaaaatttgaaattaataaaacaattttttagatgatcagagattcttttttctaaaattttctaaatactatggttgtgtcccttaaccacaggcatggtggtttcactgcattttactcaagagaagattgcttacaaatatcacacaggagacctttctagtctcctgcaggagggtggctgacccagggaacctccaggcaagcaggacatatgccaagtatcctacatgtggacagtgtctaacttgatccgatctttctccttccccatgttttagttaagtcccctgaaagcccccattacccactgttcataaagggtctgtaaattatttaagagaaggaaacacagcctttatcccatcggatttttcctctcaatcacttgagtcttttctctgagcacacacacatggcccagactcactgtcaggggagatgtaatgccagcatctggtgttaatatctattgttgacattttgggaatgagaacatgagctgttagggaagatgtttgcttgtacctaattaatgtcccattgtatcctctcttgttgtcagctctgcctcaccatcctgccttggcattttcttttactggctaactttaaaagttaattatttctctgttgaatgttaaatgccaccggtttttaatgccgttccttggtgtgagttattagttatcaaaaatcaaaatgatctgtgcaattatcagctctttacctaaagccactgttcttgctaatcgcgtaaagtgtgatagcatttgctgatgtctggcaacatggatctttctagcagatttaagtttctcactcagtacattcctgtccctgtctggctttccttgtggagatcagatacaaagtcctggtacatcatctaatggaaacaattactgacagggccaagtcttcaaggcccattttgcttgaatctcaaatcactgttaaaattcatttggcaactccaataagtacagagagtaatgaggaacttcaaatagaatatttcctaatagctttcgtaaaacatgtcttggtaggagatcacaactctttctttacttgagattggtttataaaaataatagtacaagttccaactaacagctactaagtgcatactctgtgccaggctttgtcattagcttttcgcatggattatcttaatcctctcaacaatcctgtgaggtaaagtcttattattattcccaacttaaagatgagcaatttgaagactaaagacttgagtaattaatgcagcatcacatggctggtaagtcatgggccaggatccccagccagcagtcactgcagagctgcactgtcccaggcagtgactgtgactcacacgtggctactgagcacttgaaatggggtgagtccaaatgagatgggccataagtgtaaaacctacgccctgttcctaagctttagtcaataaaatagcgtaaaatgtctcgttaagaatgtgttcataccaattacatgttgaagtgataatattttggatgcattgagttacaggaaatatgttattaaaattaactttttgtttctttttcacttctttaatgtggctactagaaaattttaaatttcctgtactgcttgccttatatttctattagaaagggctgctgtgtgtgtgtgtgtgtgtatgtatgggtgtgtgtgtgtatgggtgtgtgtgtatgtatgtgtgtgtgtatgggtgtgtgtgtatgtatgtgtgtgtgtgtatgtatgggtgtgtgtgtatatatgtgtgcgtgtgtgtgtatgtatgggtgtgtgtgtgtgtgtgtgtatatatacggagagagatttctggagtttttcttgtcttaacgagtttccgatcctaaactattgaggaataggcacaaatttctgacccttcctcccctttctggttgtttcacttccagaaatccgacagaaagtacaaatttttacatctgagtctctaccaagagcccatctgttggctcttctcaagtatggaaagatgaaacactgacatgccaggcattaacgagatcaaaagcagggctaatgacagaaatgtggctgctgttaaagtgtctccagaggattatcggggaggactttttgttctccttacggcgaccccctcaaatgtcttccagagagtgcctctcagttccagttcctgaagtcctcctttgccttcctttccaatccttgtccaccactttcctggtccacctccctctctctcctggacgcccatctctggggtgtctgtgcagctgaggcggcccctctgttaagcacttctgacacgaggcaggtcttttttccctgccagtgagagcagagtgtataatggtgttgccctccaccggggatctttgagaagctttatggctctagcagacatgggggaaccaatcacaggcactgcagctgatatatgacactaatatagggttcacttttattctcaacctaaaaaaagatagattgttccaagtttagacaggctgtaaaatcatgtgcttctggaaccatgctgccttacccctgggaccactgtaattgctttacatctgtacaaaggttccttgtaatcgggctttctgccttcatttgtcttcttttcagcctcttagtaaagaccttaattggtcttagtggggcttttttcagttagtgcaactgtacctttagggctgaacaagtaccagacactacctgcggggagaagtgaggagatgggaaagacatcaatactcctttacctttaacagtttaattaatgtgctcagaacaaggagcagtttgaagaaattttggctcctctgggaccctgctacagatcagacataactagggttaggtggaattttctagatttctttcctgcttcagtctctgtgaacactcattagcctcataattgtctcacagtaaactgctgtatcaagtttcagtctgtctctttggaggatcaagttgctttatatcaatagactgaagtactaggggatgtgtgtgaagggaagtagcctctaatttcttctgtttcttagctactaattatttaataatacattttattgcctattaaaatgtggcataacttgcttgtcagcaaaactagatggaacctaatcatttgaggagaaggataattggcacttgtacagatggcttttattgccagttgggtttgttattgcagatagaattccttgccaggtttcttggttctgtttgtgggctggtcagtgttgtgagggggttacttactgtattacaacccaggcggttaaatgtggtattattgcaaatgcagtgtgtactcagttatagatcataaaggcttctgctgtgtaggtactttttttcttctcctccccccacctccccacccctggttttaaaggaccctagtgagttttgtaccacactgaaaattaccttatgtgctggaaaatgcatcagtggagactttgtttaaacaaagggcgtttttatgatggatagaagtggccaaaacttctggatttccatctagtaaaaatttgtgtaggaaaattggaccagtcccagttccttagtagaatttcacgaaggttttcctgttgcttcaaaatgaccccttgaggaatgttgtataaattccagaaaattgctcccaatgtttcctggagcacattaaaaaatgaaggagacacattgtgtgtgggatagtttggtaacagaattagttcactgggtagaacagaggggatcccaggtagttgggctctaagtgggaagcgttggccaacatttgtaactggaggcagatttggcaggcacttgggtaaggaacattttggtggtaatgaagtaggcaggaacaaaccgcgcaggggaagaatgcttcacactgccaggctttgtggcccagagcctagcattctcatccccaggtgcccagctcctctgccttcccaaggtgctcaagtttgctttctactcagatatggcccagtttcactggcaaccacctcccttatttgttgaaagtatggcttgtgttctgacccaagagagccatttaaaacctataatgatgtccatctttgtacgttttctgggtccc

SEQ ID NO: 1281 - DNA, 3411 bp, Homo sapiens
atgattgccgtcatttaaagtgtttaaccccttgataccattctacagaagttactgaactaaaagcccagcacttgacccttgcaaaaattttgatgccttttccacttaatacactgaagttttggtttcaaagggtggtcttaagaatttcagctgatacagcttacatttacagcagtctttttaaaaggagcccaagaataacttaagcactttgtattgaaacataaataatgtgtaagattaagaacaataactatttgcttatttgttctgaaagaaagggtttattgcagagaattgactttcaggctggtctgtattccaggctatcttgtaaacagggtaagttttttttttacattaatttatttatctatttttgaaatttcagcttttattttagattcatggggtatgtgcaggtttgttacatgggaatactgtgtgatgctgaggtttggggtgcaattgatcccatcacttaggcagtgaccatagtactcaacaggtagtttttcaactcttcccctcaacaattagttccccatgtctattgttcccatctttatgtccaagtgcatccaatgtttagctcccacttataagtgaaaagtatgtggtatttagttctctgtttctgtattaattcacttaggataatggcctccaactacatccatgttactgcaaaggatatggttttgttcttgtacatggctgcatagtactccatggtgtatatgtaccacattttctttatgcagtccaccactgatgggcatctgggttgatttcacgtctttgctattgtgagtactgctgcaatgaacattcgagtgaacatatctttttggttggagaatttagtttcctttgggtgtatacccagtaatgggattactaggtcgaatgatagtcctacttttagttctttgagatatctccaaactgctctccactaatagtgatttaaaaaaaaaaaaaaaaaaaaccattgaattatctcacatttccgttgagattttttacctggtagaaagctgaatatggtggttggtgtttaatgggagattgtagtagatggaagtttattatgattcacggtagagtcacagagaagaagataaagttatgaaatgttgtgatttcatacattagactacttgaaattaagtgcctccatttcttccttcctcctttccttcttttctttccttttccccattctgcttattagtcataggataagactagtgtgactttttgagttagagcctctggtgctttttgtactttatcttcatcaaagctacaataaagtaaactccccacacacagacacttacagagtttcagatgacttcatttcaaaagggtctcctttctcagggctgtgctcttgtagtggtgtgtgtgcagtgcagaacagtcagcctccgtcagaacaatcaagcagcatagagtggtgtaagggaaggagtccatggcagctggctaaggtggcaggaagtatgagtgcatggggcatgtggctcaccatacaagttgcttggactgctgatacaatgggattgcaataaatctggggatctttgtttagtggaccacagtttgaacccatggacttgtcagcaaatttttggaatgtgtcattgctttggaggccagggcctttgctcagattctttaagatgtctatggcacccccaaaataccccacatatatttttgtcattatgatgtcacttcttaaaaagtatgtaggagaaggatctcatgacattgttatatcatgttattgtctcatgatactgtcatatagtctgatgcaaagttgtgcagtgaatgcttctctcaacagctttctttataatgggatttgaggctaggaacctcagtccctgtccttgagaagcatgactcctgacccactgtcatttctcctgaaagaacatcaggaaaaccagcctgaaagcatgccccacgtatgaggagcatcacagcaagtgaaagtagctgcattttgttgatggaagggtgcagacacagcatggggaagcaaacaaaagtggaattcttgccacatttgctttgctattggtgttctcccttaacatgcatattatggaataatttttatatttttaaattttcttttatgtggagaccaacagtttaaaagatggaaaatagattttagcaatcatcagaaagacagagaaatttatattcagattagtgaacactgaatctcatctatgtggtctcgggactgtggcacaataaaattcaagttggcatgtgagcttaagcaagtcatttaatctctctacaccctggctgcctcctgtgcaaaacagaaattggacaattgggcttaaaattacttcatcactaaggtattataattttacagtttctaaaattactagttcattataaataatctgctaacttgtattttaaaaattctactgaatcaggcataactattttatagagctctaattttatttaaaaagtgttgaaataactcagctctatagagtacaagcataaaagcagtgtgagaattttgtgatctagtttaataaaaatgaatgagtaacttgcatttcttcttgaaaaaaaaaaaaaacttcggtgcttttgtgacaatactgttttccatatcacagaataatatctggaggggacccaaggattatgatagtccaatttcctatcttagagatagaaagtctgagagagaaagagatcaagtaagtaaattactgtgagaaagaaaaatttagtcttcaggaaatcctggctaatctcactcctgatcctatgacctcaaataacttctgttcaattttgttttgttttattttgagagagtctctgtctgtcacccaagttggagtgcaatgatgtgatctttgctcactgcagcctccgcttcctgggctcaagtgattctcctgcctcagcctcccaagcactttttctacaggtgcgcaccaccacgcctggctaattttttgtatttttagtagagatgaggtttcaccaagttggccaggctggtctggaactcctggcctcatgtgatctgcctgtctcgtctgttcaatatgttttaaaagactaagataaatcatgaaagcactgctaaaagaaattcttacattacattttagtaaacacagctaagggttaaaacaatgtatttttaaggtagctactgaagaaataaatctactttatatcatctcttgtcagttcaatcttatcacttctctcctacatttctgtgatatgctccaacaaaacctggctactctcagttctctaagtaagccatgcccttttctgcttctgcactttgctttactcttagcctaaaaattagctcacccc

SEQ ID NO: 1282 - DNA, 16192 bp, Homo sapiens
acaacccattagcctagaatttcatctcttcatctatcatttcaattatcccctgatttctctggggcatttgataaatgggagaccatttacatttggtgcattaatgaccttggtacattttgaaaatgtgtcccctgcccccattatatatgtatgttttttaaagctacctactaggtcttcaagcatgctaagggacagaatgacatccatgtaactccattacttggacatcattaaaaaataaaattctgaaaatgtggtgtttccatgatgatatgatgttattacatctataaaaataagtaactatttaagggttaaaagatacctatagaaaaagaagcagaaggatattgttccaaataaatgtggacattttggttttcttccacttttgagtctactgcccaaagcattttatattagagttcgttacaaaacaaggtgtttttgttttagtggtgatttttttaatctatttttttttaccatggtgagaaatttgtttttctaaaatcctttgttggcttgcccccaaatgtacaacaaccaaaagccacattatatataagatatatagtaaatatattgtttatataaaatataaagtatatataaactatatatttatatataatatattaaatattttatattatataatacttaatgttaaatgtttacatatgttatatattgtgtgtatgtttctttcagggaggggagggtggtgtggtagaggggcacaccagtaggctgtgctctaccattactctagcagcctcagatgaagcagagatgctccaaatgaagctgtcacccggttttcttgaatataatttggtcatcaagatatttgaattggaaacactctggaagaaataagtgtctactatgaaggagctattgggcatttctactgcctttgagctcccaaagtttaaattttgtgagcaatagttaacagtctagttctttaagaatactatctctctacagaatactatctaactagtgtgagaccctggctttcaattttttttatattatttgaaacacaccaattatcttcattgaaaagaaatttatatttcttcaatgaacttatatcaaatatgaagaatcatttatgcttttgtctcttttcctggttttttgtctttgatttcctggttaattttgtgatgttgcttgccacatctttgataaaataaaattctgtaaaataagaataaacatatttttgttaaaggtgctttgaaattattaaataagagatttgagttgaacactttagagaattggtaaatcaacaacatttctgagaaacaaaagctattgatatttttctttgaatgtaatatttaagttcgtatctcaatgcaagcgaataattttagggctaaaatagtagcttacaggtcagttaattcaccatcttcactcccttgtagaaactgagatatttgaggtaagactgtgggataatatttattactagacaaaagtttctttataactttgtcaaaatccagaaggtaatggttggatttgacttgaggagaactcctgagtttcagctctgtttcccagctcttcaaggttacagtctagtctgttttgacagatggctcctttatgtccagggcctctgagcggacatgtgcaaacctggaatgcactagaaaaggtcaagtgttcattgcgatatagccctcaattgttatcttttcggatgacaaggatatattctatttatctatatatcttctggcacctaacacaatgtttagcacatacaaggcacttcataatttttgatgagtgaataaatgagtgaaagaatggctgaatgaatgaacactttgtttacttagaggttactagagccatttacaaatcatatgggaaatactcaggatgcagatagtaaagaaaaaaaaaaagactcaatgccagtgagccacagaaattaaagtcaagagagaaaattggaaatcatgagatttatttatgtgggaaattttaatttctgttcaggtaactcagatttacttctttggcttttctcttttgggacaggcgtcaccggagcaccagccaaatgtcgaagttgggaactgggttctttattgttaggcgtagactggtacaagcattttctgccagaagtatcagttgaaatctgggcccaaggggccagcctaggaaaagagaaaaggtgaggttcagctaccagaaaggagctgaacaaggagccaaaagagagaatccaggtcaagaacacaaaactaagattttaagttctgttagacacagggatcacagtaaagcagactgttaacaagcaaggaggaggaaaaggtaaagagtcctgaacagttgcctcaaatttcaacctattattttgtctcaattttctgaactcaccgatgaggtatgtggaaagatcaagcagagttgacaaatgttttcagacttgctactccactgatgagcagccttgaatttccaattgcatgctggactttctcccgagtgtttctttggcactgcatatttaacatatctaaaatgaaaaataacttcccttgtattttattgtcagaaaaaatagtccaagattggaaatgggtgaaaaagattatagggtgtctatcctttcagtggagcgctaagcatttctgaaagcttagaagttaagttgttagaaaactgatagccatgcaaatgattcctcttttgtcccattgagacagaattgatttctcctctatggaaaagatgatccaaatcactgtattgccttttacatgatatgaatcagcttggcatatattaggaaattatttcaggattcctgattatctatgtgtgtgtgtgtgtgtgtgtgtgtgtgtgtgtgtgtgtgtgtgtgtgttttactggtttgttaataagttgaataaaatctttaacatattcaatttgcaggagagtcatgtttttaactttttgaaaattatattaacatccttattaactattaatgtttccaccatcctaaacgcttggtaccattgaactttctacttctctggatctccattatataatcagtttccaagttaaatgctcttcacttcaatccctttttcactgttaatgagtcagtttgagtccctgctattttgcactaaggctgatccaatgatccaatactctccaaagtgatcttccaaatctgtctcccacaccattacactccaaactgaaaagccaaatctttccatttaaacctaggtcattgggacttttttggctcaaaaatctcatttgacttcctattaactaacaaatccagtccccaaatgccagcttcttaatagagatcccagttaccttcctaggcctatattcacttggattagtgagctagaggtgccgtaacaaactaacacagatggagtgtcttaaacaacagaaatttatttccttatgatctggaggctagaagtccaagatcaaactgctgggaggattgatttcttccaagggcctctctccttggcccatagatggtcatctctgtcagtgtcttcataggttcctccctctctgtctgtctgtctgtgtcatattctccctttctcataaggataccagtgaaattgggttaggacccacccatatcatctaattttgttttaattatctctttaaaggccgtatttctaaatacagtcatgttctaaaatactggggttaggacttcaaaatgtgaattttggaggaaaaaatttagcccataaaactcctaaagaaagaaaataaaaatacatgtttgttgaatgcataccatgagtcaagcactgcattttatactttcacataagttaaaaaatgattgattcatttttcctgaattatcccaatccagattttacttgtaatatatcacctcagctaagattccttccttgttaagaatcctggtgtcctcctctgagaggacacatttttcccttttacactactttcacattcttcctggtttgatgattattttgtactttattttttccaacaatgcattattaattccttgaagtcaaggccattaatgactcttagaatgcctgtgaagtatatgacctgttgttcagaatataaatatttgttaaataaagaactcaaaggaagaagggaaaagtttataaaagaaagaagggagtatgaccaaggttttttggcaaggggtggatgaggcaagggaaagaatcatgaaagatgttcgagaagaaccaaaattataaggctattaagtcagaggttagtaatatatcacatttggaacctagaggttctaagactctagactttttatcttttaattgatggtgttcttagtaaattatattccatttaaatagcttcacaccataaagataaatgttttaattctgacatcaaattattttagtattggtcctcatttccattctatcaccttgttttgaagatctgctttcagttagatcctttgtctttcacaatcagctggggtgtggcttaggaggacaacttaaatgtgttctgcaatttgccgatttggtctggtttttgaagcatgaaaagatttgaaggccccagctaatgtgtattacacatgccacaccccctcaactatgtctcagatttgtgagggtgtgatctataactccatctactgttggagtgctgggaagggaagagcatggtccctttaaataatatggaaggctggaagggaagtgctggggagaggaggacgtggtccctggttagggctccaaccccatgggcctaggtgaagacaggcacttctgccttccaacccaaatgttgcattttcccagagcaccctgacccgccaagcccccctcctgtgcctataaaaacctgagaccctagcaaggcagacagaagctgctggactgtgagagggacacattggcggaagaagacaagcggctggacattgagaggatgttgaggggagcacatagacagaagagcacactgaccaaccaacacaggcactctgccaggccatcaaggtgctggaagaggcagagtttggccaggagagctggggctgccgagtggcccaactccaggtgaagatcccctcccttctggctccccatcaggctgagagctacttccactcaataaaactttgcactcattctccaagcctatgtgtgatccaattcttctggtaaaccaaggcaagaaactccgggatacagaatccctctgtccttgtgataaggaaggggttctaattgagctggttaacacaagctgcctatagatggccaactaaaagagcaccctgtaacacacgcccactggggcttcagctgcaaacattcactcctagacactgctgtggggtggaagccccatgacctgcccgtatgtatgcttccctagaggtttgagcagcctggcactgaagaagcaagccactcccccatcgcacgccctgccagggggacaagggaacctttcccatttcactgtcaccagactgtgatattttttgctgtgaaaattcccaagacaaatttgtttctgtggcacatttaccattgtaacatggagctatagatatgatggcttcagacatatcagccttagcactttattatttttttcaagtcttaggctgctgtgaaatttttagaagtttctgtttccctggattatttttaaaaacatcaaatcattcctttaatagagtatattattattcagatcttttctgaaggaaagtttcatctgatttctaaatttaacggtatgcccttatctcaaaatttcagtcaccatccacttaccatgtacttttttcgttattgaagcattccagatgcttcctttttgaaaaagaaaaaaggactaaatttaacggtatgtacagagactattgtgtgtgtgtcttgggaggagtataaatatgagctcccattaaagtaagatcttctaaattgagaattgtaagttgtttttatgcttccgttcgtgtggctctgtgctgtgtctgaggaacataggaatgaagaagacattgtgttggctcacaggacgtctatagtcacctgaggaaagatacaaataaccaagtatgagttaactagtggtttccaacaaggaacgactgtacccccaggagacatttgccagtcgagatggggatttacagcaggaagttagatatataaatataaagattagcagagcactgggctaaagatatatatatatatggtagtaataacacaatagttcttgaaatcaaaagactgataaaattatccagcaagagtgtgtgggtgatgaggacactagatgagggacacctgcaatcaaaaggatggacacaaaggaataccaaagataactgaataaaataataataatattgaacattttgtagaacccatactatttttaaaaagttctcctaagcacttatatgaatgctcataattagcctgttattgtcagcgtttttgtataatgattgaagcaggaatcaacagtatcaaatgcaacagagacatcattacaatgagtactaaaagtgtccatagatctggcaattaggaggtcattggaagccagagcccagtgggtagaaaagtaaaatgttgatgggcaagtagagaagtttaagccaaaaaagtttggattaaaaggaaaggaaaagaaaataaatgaccatgttataatgggaacaaactaaaaagaggtcatgtttttcatggtggaagacatggaagaatgtaagaggagcagccatcgtttatacacctcgaggaaaccgaagaagatgccttatcaactctgagaggactgggaagtttgacaaaccaggacaggcaaagagacataagaggtcatgcttgggcctcaactgaaattggacactacttgctctgtccgtcagtccaacaactcctttttgaaatctctctcctgataagttggacttatctgaactatgctttcaggaggacttttgcctgtctcatcttcctcacttatcaggacaacattctacaaaaccaaatcacagaaacagtaatactattatctgcctcctttactcctaaaacccagggaattcaatgaccagtgaaaaactgcacactgtgggacacacacaggctatcctgagacatgagggttccccaaatgagtgttacagaatttgctaattctttgtggttgttttagcagagcatgtaaatgcatattgaacacttttttccattaatgcaatgcttatatggaagaatatttttccttcgctgaacattttcctacttctgtatcttagtctgataaaaatatgttttccatattatttctagtctctatcatttattcaactacaaatactgaatatctactatatactaggtgctggtttgtcagatgcacacacgctgtgacactagaagagctcacagtctataggtaaaacagatagattaatagctatttaaaatggaaaagtataagtgatttaatagatatagtaaatgattgtgtaagctaatgcagtaagtaactataccctccctcccccataaaataagttttcttctcaaatactgactcactttcattttttcaaatggattgtcaagaatagaaacaccccattctctttgcttgatgaattttttttcctgtttctttctctcttttctctttggttctcaccctgccaattctctgcaggtgctccttttatattctgaaatcccagttaagggactttctcactgattataatgacataggtctgttttcacagctgtaattttaaagtttcttaataatgcaatgttttaaacattattctgaaatgctagaaggtttcagggtgctcaaaaagtaaacaggctcgtataaaaagaagggaacagttataataaaaaattcaacaatttgtatcagatcattggcacttcattgaaaatctcaagctcttgagacaacaaaattttcccccaaggggaactaattcactagacatgtgtatacattagaaccagatgaaggtgatgcagtgaaattggaaagacaattcctgggcttattagaagctggagaccaagtatttgtatgtctactgacttctttggccttggcaagaatcgttttcccaggagagcagatttggggaatttgcatttatgttcatgatcacctttgacatctgaaactctgaggacttgacaccgagtattactattattataaacagagctcccaagctgttaagctcaaactgctactttggtgttaacaagaatgggtgccacatggtgtgcatatgctgtttgtgaaagtaaatgatgctttaagagtgttttactctcaaaaggaagtctactaggcagatagcttgtattgaaactctgtatatgttctcatttgaccatcataaacaatgtttaaagagccaaggttgttacttgagaataaatcagggagctctggaacatttgggtggatatattcactacaaagcattagagacatttccccctatgtttatccttttaaaaatgtatgtatttcacttcaggtctcgatagatctttcagattgtatcttaatagagcttcctcagcacagaagtgatttatttctttcaatggaggatttacttgaatctactatttaggaatttagcataactgggtatagaattcctttaccttggatagactaaaaaactcccaagactgatttaaaacaatttaaatgttgaataatgctatttccctatgcgtttgctttgtgagttaaactgatgaagatttaatcttctttttcacagtttcttttgtctataaaactaaagatccatttttataaaagatttttctttactttgttttagaaagagatttgatatctgaatggtagtggtaatgaaattctctgtgggttaggctttgaggaagaaatactaacgtgaaattaatgaaatattaacaaataaattgagttcataatggtaaccatttccctatgttatatgtgataacatataacttatgtatacgtagttttgagctttgcatctgatcactcttagccaacaaatcttttctaaaaataaggcaactggggaaacctataataaataacttagcaaaatgaggcgatgaacttttcagctaccataagccttttctccccctttaagtaatgtattttatcaggactgaaattctaatgtatgataacctgaaatttgagtttaaaaatgaacacaactgaaatataataaggcatttttcatctcttttaatattttatatattctcattcttcatgagaaatggctgcagcacgcaagctgccaggttaatcttgcttaaatttggcaatcaacaagtaactttgtgcacaaactgttggagtaccatgcaaggcaagcaaaggagtttagatttgatgcaataatagagggagagctatcgacagagcaagagaataataagatgcaaatgccttttaaggacaattagtctggaaaccaagaaaaaaatgggcttggcggaatgaaaacatacagacaaagagacagcatttgtatcatgtgaagaatctggcatcaactcagaagccttctttttcacctggcgtgattcaaagtaaattacagtgaagaaaaggccattaggctcacaataaggagacttggtaacttgaagaatgtatttttaaaagtatggaaatagctgtcaacatgaggggactttgaaaaggaagttactggggatataaatagatgtaatgggtataaggaatgaagcctgaggcaggaaacagaaaaataatttttaaaaagttgccagaggaagaagcaacattatttccagtttttagaaaagacatgagcaattcactacaagagttatacacaatgaagatgagtatgtttcaataattaaattagtgactttggggaaaaattcaaattgctgagtagagatcctaaaaagtccattccctaaccagttaacttctaagcctagataattcactattaaatatttaggcatatcttatattttgggattcagcaaatggttcgatttcctatgataaattttgtaaatgtgtttactttcccaagtgacagatatttcacaagggccataagagaggtaaatggggagattctttggtttccctttttaaaggcaggaagcagccagttcttggtttgcataaagaaactggaagaaaagcacagagataaaatagaaatgttcactaatattttcatgagtcaagttttatagccacagctgtctccagcaggaatggaatttacagtgtcaatgggtattagaaagagatgggctggaggaagaagattggaaggatgggcacttagcatgtatgcagaagtgaactaatctgcctacatagcaggagctgaattttataccaaaactttctctgcaattataaaaggctttagatgtttagtttcaaagacatgcaggttgaccagcagtttaaagagttgtgagctactggataatgatctcaatccaactactttcctttgcccaaatagaattcttcaaccatcagcagtaattagttggcttttagcttttgggcaccagacaatggatcgtgatccatagtggctatcatgtgggagatgaggctgcaggtgaaaggtgaaaggaacttttcacttcccaagcttccaaaaagcaagtgtcttctcctatttttagcctgctatattaatactatatgtgtgtgtttatatgtgtaggtgtatgttctaagtcacatttctcttggttacttgctcctttttactgaagatcatttacatttggatctatcatatgccaattctagttaattatgtttatgaaagatcctggtcttagttaatgaaagattaagaacagtgtctattttttccttttattatggatctttactcttactgaaattttctgttttaaaagtcaaaataaaatttagcttataaacagtttagaaagtttatttttctagtcttttctagttatggaaaatgtaatatttgaaagacaagtatctataacaaatcaaattgatgtttaaacacaaaagatacatttgccaaattgcttctcctccctgatgctactttagggacatataaaacaagaaatggaaattaatttttatcatgtgcatgtcggtttccctttctctgaaattcactgatttctttcaaatttgaacactccagcttttatctcttctggtcttcagtgctagactcccccagcttttctccagttctattgttgtgacagtatcacaatttactttcttcattttgaggatttgtttgtgttgttattcctattttttgtgaaaggaaaataaatcttggggccccaaaatcactaagctaaagggaaagtcaagctgggaactgcttagggtaaacctgcctcctgatctattcagagtcacacctctgctaactgagataaatgcatagctaattgcctctttggagaggctaatcagaaactcaaaagaatgcaactatttgtctcttacctatgtatgacctggaagccccctccccacttttagttgttccaccttggcttggagttgtcctgcctttctggactgaactaatgttcatcttacatatgatgattaatgtctcatgtctccctaaaatgtataaaaccaaactgtgctctgaccaccgtgggcatatgtcagtcatcaggatctcctgatgctgagtcacgggcacacatcctcaaccttggcaaaataaagtttctaaattaactgagacctgtctcagatcctcagggttcacactgccctgtactttatgggaagcaagccagcaagtccccttagtagttgatcgtaaccttggcctgcaatatcatgatcagcaaatgatgcatcattaggtgtcttcgactgagagaggagcaattaccccatgacagcaggatcagagaaatcagactgatcaggataaagaacataacaaacagttgggagaacatgaaagaatatatacatacacagcataaaaaatgtaagtgcagttaaaatatcattacactaagaatctaaagaattactgggtttcagctctgccatttctgcttaccaattcagtgaccatgagcaaatgacaacttcactgagctacattttccattttgaaacatgtagaccctaaagtctgccaggattatggtaaagaaagcatgagtccttatgcaaagcatgtgttgaatactattcactcttaaaaccatattatgctggaactgtgaaagagaactaaagctggctgaaggagggccatagggaatctgattttgtttccttcctccctgtatagttcaggctttgcaaagtagtttggtttaaaatctaggtgctattttctagacagagtaacaatttctgtttactgcttttattggccaggccttgcctcccaatccagacacccagttctcattcgctctttaaataacagattatttcaggaaacaaagttatttttctctaccttggaggtggtcatggtggtgttcttgcccttgctcatcttctaagttaaatacagttacccagcccaacacatcctcctgatgacctcatgctgaacctacttttgagcattgttctctgggctagcaatcatctccagccttctcaaagtgtcaaggcagcgaaacttggggttcaagaaggttctcaagttattgaaagaatgttcttcacatgtaatgggttggttctgaaggtggcatagtaggttttgccccatttttctttcatgtatgccatatttctgcagctaaaggtgagagtattgaaaaacattaacataaaactgagagctttgatttttatcttcatgtttaaacatctaagggataacagtaaagtaagtatggattactatagaagactcttgtacatttcagttgccatttctgcacaataatttataccaactcttaaactacaaaacttgtttgttcctttattaatttatcagctagcaaaatatgtacttgctgtgacactagttaaattattcacagaggcacatgttctattaggccctttttttctggggcccattctggtgattttaagaagccaagataggtggcttgaagattttgacttttgcataaacattgtaagagctcattcattctcagtgctgttcctgaaacttcatcatttctccctttgtgaatattatttgatatctgatcgtctttgaaaaaacagttttctttgggccccttagctcaccagtgtcctctgaaacaacctggtttccttggcatctccccctcaccctaatttctctctacttgttgcctcgtatccagcaacctccaacttattgatttggcttgatttaattgggagcgccccatacccaggacaggttttcccagtggcagctgggagtatgaatctaataggcctggtttggttctgtgaccctctgtcgcccctttctggccatagcctgtcactgaagtttaccctctggacttgataatacagacagcagccgtagtacagaacagtttgcaaactatcagcctgtgtgccaaatcagcccaaagaatgctttgtttggttcgtataaattatgccaacatttaaaaattagcagacatattagtccattttatgttgctgtaaaggaatacctgaggctgggtaatttataaagaagaggtttattttggctcacagctctgcaggcgatacaagaagcgtggtgccagcgtgtgtttctggtgaaagcctcaggaagcttacaatcactgcagaaggccaaagggagcaagcatatcacatggtgagagaaggagcaagagagagaagggagggatcccagattcttttaaacaaccagctctcacatgaactgccagagcaagaactcactcattaccaacgagatgccaccaagccattcataatggatctaccctcatgacccagacaccacccactaggcccatatccaacattggaggtcacattgcaacatgagaattggagggtatacacatccaaattatatctagagatttcagggccaggtgtggtggctcacgcctgtaatcctagccctttgagaggctgagacaggaggattacttgaggccaggagttcaagtccagcctgggcaacatagcaagaacttatcttcacttaaaaaaaaagtcagatgtggtggtgcttctgtagtcccacctattcaggaggctgaggtgggggaactgcttgagctctggagatgaggctgcagtgagccatgattgtgccactgcactccaggctgggcaacagagcaaggtcctgtttttttaaaaaaaagagattttatataaaatttacagcttctcttaacatagcagaagatctgacaatcttaggccagctttcttcttgtggacaatcttactcttgcccaccactcatggtgtagactggtcatttgcatctagtgcctgcttcactcatttctgttgactgccttgtcccaacaggcatttggactcccaggtcaagtacaaaagtttattcaaatagatgtggtttatttgtgtgtcttggggaggaagaatgatatctaatttcttttatgaatatgctcacaaaaaggaattagaaatcagattgagattctttagtacatgaaggtgaaaattgggtatgttttcttcccatttacaatatatttgtaccaagattcactttttatcaaagagaaacttttctgcagtttaaattgtaggatgatggagttctgaatatcttaggtaacattattatatggatgaatatatttgcattctatcaggttgaatatagaaaaatcattatatacagatgttaaagaaactatacaaagtactaatgtataaggagtgtgtgtgtgtgtaaccgtctaatgattcatgttttttctcttttttattatacttaagtggagtttccagggcaaacacaggtatacagtcataatgataaattatgtagtttaattcagcttcaccaatgataactcagatgccattttcaaatgcattgtgagaacggttttttcacgtttgcttctaattccagcaaaaacacctaattatagaacaacagtagcaaaaaataaattttgctcagggaaaaaggttttatgagtaatcagtgcaaagcagaaatctcttgctgcgaataatgtgggccagctaaggtttctgtgaggttttttgctttggcgtggtttggctttgtactgcctgggtgacctcttcttctcatccatcacttcatcagaaaatcaaaagacagcaagctcctagccagactcttgttcaagataaactctatgacctcctaacaggttactagatcttttatgggagttcagctgaccacatgacttcttatatttgagaacttattcatgagccagcaaagctctggctaatgtcacagaacttgacagcactagtgctgttcatggcttcatctttagacatagctattctatcctgttccctttcagaaactcaaatgaagggccgcgtcttataatcaaacatttcagataaaacagcttatttttccctgagagcatatgtgtcttctattaatcctaatcaactagggacagactgaaaagaacactctaataaggtaatagtactgagtattttgctgtgacatcccacaaaaatgagttttctgtgggatttggggaggaggtaaaaaaatgaccaagaaaaaaaagaccttcaagaattaaatggcttagagataaagcatataaaataggaatgcttttattgcttttgtattttctgaggacaattctgccagtgaatccacaaaattgtataaatacaaatatatcacatttgcctgctgtgattaaatttctctgattacacaactatacttgatacacgggaccaatgcatcattttttttttccttttgtaatcattgttatatccacgcttataatcaacattcatcacagctaattagagtttctttgtctgttgtttctga

SEQ ID NO: 1283 - DNA, 62528 bp, Homo sapiens
gaagacttcgttaaacatagacacctcaactttattagtagaatcactggctttagagcatctttgaagatcaaaaagtgagaatctagagaggtgaaatcaagagactctgaccagtgacacaccttctcagatgctctggggcttatggaggtatgcatggaagttaccagcatatgttttaaagaaagtgatttgaataaagcattacatgagtgtgttgggaggtagtcatgctgaggtcagaattagccagattctttccatgtcatctgcaatcctttcatctaacttccaaaagagtggttgctggaaaacctaaagaaatgtttaattttaatttttttaatttttttttatttagagacaaggtctctcactgtcccccagcctggagtgcagggggcaatcatcactcactgcagcctggccctcctaggctcaaacaatcctcctacctcagcctcgagtagctggactacaagtgcatgccaccatgcccagctagttttttaaaaactttgtaaaaatggggtctcactatattgcccaagctggtctcacactactggcctcaactgcttctcctgccttggcctcccaaactgctggaattacaggcatgagacactgtgcccagcgctaaggaaaaatgtaatatggcatcttttaggaaaaaagtattctggacttaagcttgaaatttgtgctgctgattttaataaaataacatttagctgcctccagtgtaaacctttcacagattctaaaagaggtgttttttgtgttttttttcttgcaatttcagaaatgtaaattggctattatagtttacaaggtaggtacatgttttgttatataaataactcagaaatatctctctggctcttcatacaatacaatctttgcaaagtagaaatatatcatgaagactaagtgaaataaatataatcatagccaagttttgattttttaaaaaaagaatattcaatgtttttattagactcaaaggtctttacaccccctccaggccccaggctttattaaggtataattgataaattaaaattgtgtatttttacagtgtacaatgtggttttgatacatgtatattttgtggaattattaaatcaagctaattaacataactatcacctcaaatatttatctttttttgtgatgagaacatttatgatctattcacttagcaatttttaaaatttacaatatattattattgactgtagtcaacataactctccagaaattatttatcctttctaacagaaatattgtatcttcaaccaacatctcatttctcccttacctcccttcccaggccctggaaaccaccattctgctctctgcttatacaaattcaaattttttaattccacatataagtaagataatacagtatttctgaacctgacgttcacttagtataatgtcccccaagttcatccgtgttgctgctcatgacgggattttcttcttttaaaagactgaatagtattctgttgtgggtgtcttttttctttattcatttctttatgcattcatctgtcaatgggcacttacattgaacatgggagtacagtaatctcttcaacatactgatttaattgtccttgaatatataccctgaagtgtgaataatggatcataaataaattccttttttaaaaataaatcactcagtttcaggtactctgttataagcaaggaaaatgaactaagacagatattaaccttttatcataagtataatttgcaaatattttctctcattccataagttgtcttttcgttctgttcattggtgttttttttgttttgttttgttttgttgttgttgttgttgttgtgttgttgtttctgtgcaggaggtttttagtttgactcagtcctgtttgtgtatttttgcttttttggccggtgcttttgaggacgtattcaaaaaataattgttcagaccaatgtcaagaagcttttcctctatgtttatttgaatagttttacagttcaggtcgtatacttaaacctttaattcattctggtttgattttgtatatggggtaagataagggttcaatttcattcgtacacatgtggatagttattgaagatactgtctattctctattaggtgttcttgacatttttgtcaaggatcaattaaccataaatttgtggattagtttattggttttctttctgtcccattggtctatttgtgtattttatgccagtaccatgttgttttgattagtgtagatttgtagtatttttgaaatcaattagtgtgatatatccagctttattccttttgatcaaaattgctttggctattgaaggtcttctgtggttctctatgaatcttaggatttctttctatgtccatggtatgtatacatttacctatgtaacgaacctgcacttcctacacatgtgtccttgagcttaaaataaaagttggaaataaaaaaattaaaaatgtgggaaatattttaaaatgcaatgagaattttgataggaaccacattgaatctgtagatttctttgggtagtaggggcatttcagtagtattaattcttttaatccatgaacaccggatatctttctatttgtttgtgttgtcttcagtttctttcatcaatgttctatagttttcagtggacagacctttcacctccttggttacatttcttgccaagtatttcatttttattgatgctattatatgtggaattgctagattgatttattttttgaataatttgctgttggagtataaaaatgcaactgatgttttgtgctgattttgcatcctgcaattttatttaatttgttttttagttctagcagtttctggtagagtctgcaggatttcctatatataagaacttgtcatctgcaaatagagacaattttatttcttcctttatattttggatatcttttctttctttctttttttttttttttttgcctaatttatctgtctaggaattccagcactatattgaatagatgtggtgaaagtgaacatctttatcatgtttttgatcttagaggaaaagcctttagcttttcattggttagtttgatgttagctgtgggctggttgtatatagcctgtacttagtcaagatacatttcttctacacataatttgttggaagttttttcatgaaaggatattgaattttttcagatgtttttacttcatccaatgaggtgaccatatgggttttatccttcactgtgttaatgtggtatatctcatttgttaatttgtatatattaaacaattattgcattccaaggataaatcctacttgaccatggtgtatgatcctttttttttttttttttttttgctattcctatttttttttattatactttaagttctagggtacatgtgcacaacatgcaggtttgttacatatgtatacatgttccatgttggtgtgctgcacccattaactggtcatttacattaggtatatctcctaatggtatccctccccatccccccaccccccaatgggctccagtgtgtgatgtttcccttcctgtgtccatgtgttctcattgttcaattcccacctatgagtgagaatatgctgtgtttggctttttgtccttgcgatactttgctgagagttatggtttccagcttcatccatgtccctacaaaggacacgaactcatccttttttacggctgcatagtattccgtggtgtgtatgtgccacattttcttaatctagtctatcattgatggacatttgggttggttccaagtctttgctattgtgaatagtgccacaataaacatacgtgtgcatgtgtctttatagcagctatgatttataatcctgtgggtatatacctagtaatggaatggctaggtcaaatggtacttccagttctagatccttgaggaatggccacactgtttccacaatggttgaactagtttacagtcccaccaacagtgtaaaagtgttcctatttctccacatcttctccagcacctcttgtttcctgattttttaatgatcaccattctaactggtgtgagatggtatctcattgtggttttgatttgcgtttctctgatggccagtgatgatgagcattttttcatgtgtcttttggctgcataaatgtcttcttttgagaagtgtctgttacgaaatgaaggcggaaataaagatgttctttgaaaccaatgagaacaaagacacaacatactagaatctctgggacacatttaaagcggtgtatagagggaaatttatagcactaaatgcccacaagagaaagcaggacagatctaaaattgacaccctaacatcacaattaaaagaactagagaaggaagagcaaacacattcaaaagctagcagaacgcaagaaataactaagatcagagcagaactgacggagatagagacacaaaaaacccttcaaaaaatcagtgaatcaaggagctggttttttgaaaagatcaacaaaattgatagactgctagcaagactaataaaaagaaaaagagagaagaatcaaatagatgcaataaaaaatgataaaggggatatcacaaccgatcccacagaaatacaaactaccatcagagaatagtataaacacctctacacaaataaactagaaaatctagaagaaacggataaattcctcgacacataacaccctcccaagactaaaccaggaagaagttgaatccctgaatagaccaataacaagatctgaaactgaggcaataattaatatcctaccaaccaacaaaagtccaggaccagatggtttcacagccaaattctcccagaggtacaaggaggaactggtaccattccttctgaaactattacaatcaatagaaaaagagggaatcctccttaactcattttatgaggccagcttcatcctgataccaaagcctggcacagacacaacaaaaaaagagaattttagaccaatatgcctgatgaacatcgatgcaaaaatcctcaataaaatactggcaaaccaaatccagcagcacatcaaaaagcttatccaccatgatcaggtgggcttcatccctgggatacaaggctggttcaacatatgcaaatcaataaatgtgatccagcatataaacagaaccaaagacaaaaaccacatgatgatctcaatagatgcagaaaaggcatttgacaaaattcaacagcccttcacgctaaaaactctcaataaattaggtattgatgggacatatctcaaaataataggagctatttatgacaaacccacagccaatatcatactgaatgggcaaaaactggaagcattccctttgaaaactggcacaagacagggatgccctctctcaccactcctattcaacatagtgttggaagttctggccagggcaatcaggaaggagaaagaaataaagggtattcaattaggaaaagaggaagtcaaattgtccctgtttgcaggtgacatgattgtatatctagaaaaccccatcgtctcagcccaaaatctccttaagctgataagcaacttcagcaaagtctcaggatacaaaatcagtgtgcaaaaatcacaagcattcttatacaccaataacagacaaatggagagccaaatcatgagtgaactcccatttacaattgcttcaaagagaataaaatacctaggaatccaacttacaagggacatgaaggacctcttcaaggagaactacaaaccactgctcaaggaaataaaagaggatacaaacaaatggaagaacattccatgctcatgggtaggaagaatcaatatcgtgaaaatggccctactgcccaaggtaatttatagattcaatgccatccccatcaagctaccaatgactttctttacagaattggcatatgatccttttaatttgctattacgttttgtttgctagtgttatgttgaggaatttgcatctatgttcatcaagaatattagcctgtaatttttgtttgtttgtttgttttgtttgtttgtttggtgacacaaagtctctctgtctcccagactggagtgcagtgccgtgatctcagctcactgcaatctctgcctcccaggttcaagtgattctcctgcctcagcctccccagtagctgggattacaggtgtgagcccttatgccctgtaattttctttcttgaagtgtccttgtctgacttttctatcaggatgatgttggctttataaaatgagtttggaagtgtttcttcctcttcacctttttggaagcatttgagaggaataggtgccagtttttaaaatatttaataaaatataccaatgaaaccatcaaatatgggacttttcttttttggaaagtttctatttactgattcaatctccttccctgtattggtgtgttcagatcttctatttctgagatgatccagtcttgatagattttgtgtttctaggaatttatccatttcttctaggatgttgcattcattggagtataactcttcatagtagtgtctcatgatcctttatggtgctgttctataaattgtaatgtcgtctctttcatttataattttatgcacatattctttttttagtgtagctaaaggttcatcatcttatcaaaacagcaaatcttagttttattagctttttctattgttttcctagttttaattttatttatatctactctgatctttctcattttcctcctgctggtgaattagggcttactttgttgttctttttctagttcctcgatgtataaattagttttttttttttcttgagatcttttttctctctcaatgtacgtcttttttgctataaacatatctcttagcactgcttttgctgcatgccatatgttttggtaagttgtgtatccattttcatttatctcaagatattttttgatttcccttttcatttattcttgacccattgattgttgagataggtgttgtttaatttccacattttggtgaattttctaattttcttcctgttagtgttttcaagttttaaaacattatagtcaggaaagatactggatatgatttcagtcttcttaaatttcttaatacttgttttatgacctaatatgatctacttggacaatgttccatatgcacctgaaaagaatgtgtgttttgctgctgttggataaagtgttctgtatatgtctaataggtctatttgctctacagtattgttcaagcccactgttttcttattgactttctatctagatgatctatccattgttgaaagttggctattgaagtcttccattattgtattactgtctacttctcccagcagtcatgttagtatttgccctatacatttacatggtgcctttttgggtgcatatacacttataatcattctgtaatcttagtgagttgactctcgtgacctcctttgtatttcataatagtttttgtcttaacatctattttctctgatataaatagccacctttcctctcttttgtttacatagaatgtctttttccattccttcactttcagtacatgtgggttttaaaactcaagttaatctcttgtaggcagcacataatttaatcttatctttttatttatgtagacactttgtgtcttttgattggagaatttaatcaatttacatctaaagtaattattgataggtaaagacttactactgccattttgttaatattgtcctgactacttagttccattctgcctctattattgtctttctttgtgatatgtgattttctctagtggtattatttgtttcctttttcttaactttttgtgaattttgtacagttttttttcttgtagttaccatgaggcttatgtaaaacatctcatagctatatcagactattttaggctgataacaatttaatttcattggcattcaaaaactacactttaccttttcctcctgcatgttttatgttatttatgtctcaatttacattttttgtatttatcctgtccattaacaaattattgtaaatacagttattttaatactttttttgtatttataaaccaccaggtttatttacataccaccattacagtatcagagtagtctgaatttgaccatattcttaccttataatgagttatactttcatatttttcatgttgttggctgacatccttttgttttaacttggaaaattcactttagcatttcttgtaagacaattccagcggtaataatctcccatggcttttctttgtcttggaaagtccttacttatctctcattcatttctgaaaattagatttgctgggtatagtattctttgttgacaggcctttttgtctttctttctttcattttaacatattgaatatatcagcccactctctcctcacctgtaatgtttttgctgaaaaaactgctaataatcttatgaactttcccttgtatgtagcaagttgtctttctcttgttttctaacttctgtcttatgtttgacttttgaaaatttcattattatgtgtcttgatgaagatctctccatatttaatctatttgggttatttgggcttcatggatatggagattcattttcatctccagatatggggagtttttttaatcattatttcttctggcccctttatctttctctgccccttcttgaactaccatgatgcatacattgtttcacttgatcttttctcagaatttctgtaggctttctttacacctttttattctttttttcttttcatttccctgtctgggtaatttgaaatatgctttctttgagcttgctgattctttctttgcttgattgagtccactgttgaagctttgtataaaattttcagttcagtcattgatttgtagtgccacaacttttgtttggttattttttatagcatatctttgttctactttttattctgtacatgtattgttttcctaattttattttttttttatttatgttcttttgtagctaagtgggcttctttaaaattattttgaattctttgtcaggaagttcacagacctctattttttaaggaagggtcagttactggtgctttactttttttcctttggtggtattatgttttcctgatgtttatgattatgtggacataaattagtatgtgcacatatgaaaaagtaagcacctatttcagtctttacagacaggctttggaaagaaaagttccactagtcagtttatccaaagattcttggaagaccatcttgcagggttcatgggtagacttgctgctagagtcttggggcctggtgtagggtcagaagcttggcaggcttagcacctggttccacaggtgtaggcttagtgcctgggtccacagggttgagcccagagcctgagtccactctggagtctggagcttgaatctgctgcggtgggcttgaatcctgagtcactggggctcagcttgtggctgagatccactgcagtgcgcttgtttactgggtctgtgggagtggtcatattggagtttggatcctcaggggcaggcctggaagctatattcacaagtcctgaatttgtacggactatcctgaagctagagttactgggattatagcttggtacctaggcccataggggcaggcccagggcctgcttccatgggaacgggcctagagcctaagtccataggggctggcctagttctggatctagcctagagcctgagttcacaggggtagttctggagtctgggaatataggggccagcctggtgctaaggtctactggggtggacctgaaccctgatgtactatagccagaggcctgaagcctagattcattaatgctagtctgaggcctgagacaaccactggagctagcctggctctagggtaggcctgaaacctttggctgtggggtccagcctggagcctggggctgtagggtcctgcctggcattggagtgggcctgaaggctttacctgtacgtgctggtctggaacttggggctatggccgccaacctgatgccagggttcacaatctcaccagcatctgttattttttgactttttaataatagccattctgactgatgtgaatgttgcctcactgtggttttgatttgtatttctcttatgattagtgatattgaactttttttcatgtgctttttggccacgtgtatatcttttctcccattccataggttgtctctttgttctattcatagttttcttttgctgtgcagaagctctttagttgaaatagatcccatttgtcaattttggcttttcttgcaattgcttttggtgccttcatcatgaaaacctgttcctatgttcagaatggtattgccttggttgtcttccagggttcttatagttttgggttttacatataagtctttaatccatctcgagttgatttttgtatatagtgtaaagacaggatccattttcaatcttctacatgtggctagccagttatcccagcactatttattgaacagagggtcctttcccatggcttgtatttgtcaggttggtcgaagatcagatggttgtgggtgtgtggcctaatgtggtgcttttcttctcatgtttatcctccttgagttcattgaaattttgggatatgtggttttagttatcaaatttagaaaatgtttgatcatttttacaatttatttattattattatactttaagttttagggtacatgtgcacaatgtgcaagttagttacatatgtatacatgtgccatgctggtgcgctgcacccactaactcgtcatctagcattaggtatatctcccagtgctatccctcccccctccccccaccccacaacagtccccagagtgtgatgttccccttcctgtttccatgtgttctcattgttcaattcccacctatgagtgagaatatgaggtgtttggttttttgttcttgtgatagtttactgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctattgtgaatagtgacgcaataaacatacgtgtgcatgtgtctttatagcagcatgatttatagtcctttgagtatatactcagtaatgggttgcctgggtcaaatggtatttctagttctagatccctgaggaatcgccacactgacttccacaagggttgaactagtttacagtcccaccaacagtgtaaaagtgttcctatttctccacatcctctccagcacctgttgtttcccgactttttaatgattgccattctaagtggtgtgagatggtatctcattgtggttttgatttgcatttctctgatggccagtaatggtgagcattttttcatgtgttttttggctgcataaatgtcttcttttgagaagagtctgttcctgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttctcttgctgtgcagaagctctttagtttaattagatcccatttgtcaattttggatttattgccattgcttttggtgttttagacatggagtccttgcccatgcctacgtcctgaatggtaatgcctaggttttcttctagggtttttatggttttaggtctaacatttaaatctttaatccatcttgaattgatttttgtataaggtgtaaggaagggatccagtttcagctttctacatatggctagccagttttcccagaaccatttattaaatagggaatcctttccccattgctcatttttctcaggtttttcaaagatcagatagttgtagatatgcggcgttatttctgagggctctgttctgttccattgatctatatctctgttttggtaccagtaccatgctgttttggttactgtaggcttgtagtatagtttaaagtcaggtagtgtgattcctccagctttgttcttttggcttaggattgacttggcaatgcgggctcttttttggttccatatgaactttaaagtagttttttccaattctgtgaagacagtcattggtagcttgatggggatggcattgaatctgtaaattaccttgggcagtatggccattttcacgatattgattcttcctacccatgagcatggaatattcttccatttgtttgtatcctcttttatttccttgagcagttgtttgtagttctccttgaagagttccttcacatcccttgtaagttggattcctaggtattttattctctttgaagcaattgtgaatgggaattcactcatgatttggctctctgtttgtctgttgttggtgtataagaatgcttgtgatttttgtacattgattttgtatcctgagactttgctgaagttgcttatcagcttaaggagattttgggctgagacgatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttatgccagttttcaaagggaatgtttccagtttttgcccattcagtatgatattggctgtgggtttgtcatagatagctcttattattttgaaatacatcccatcaatacctaatttattgagtgtttttagcatgaagcattgttgaattttgtcacatgccttttctgcatctattgagatcatcatgtggtttttgtctttggttctgtttatatgctggattacatgtattgatttgcatatattgaaccagccttgtatcccagggatgaagcccacttgatcatggtagataagctttttgatgtgctgctggatttggtttgccagtattttattgaggatttttgcattgatgttcatcagggatattggtctaaaattctctttttttgttttgtctgtgccaggctttggtatcagaatgatgctggcctcataaaatgagttggggaggattccctctttttctattgattggaatagtttcagaaggaatggtaccagttcctccttgtacctctggtagaatttggctgtgaatccatctggtcctggactctttttggttggtaagctattgattattgccacaatttcagatgctgttattggtctattcagagattcaacttcttcctggtttagtcttgggagagtgtatgtgtcgaggaatttatccatttcttctagattttctagtatatttgtgtagaggtgtttgtaatattctctgatggtagtttgtatttctgtgggatcggtggtgatatcccctttatcattttttattgtgtctatttgattcttccctccttttttcttagtcttgctagcggtttatccattttgttgatcctttcaaaaaaccagctcctggattcattaatttttgaagggtttttatgtctctgtttccttcatttctgctctgattttagttgtttcttgcattctgctagcttttgaatgtgtttgctcttgcttttctagttcttttaattgtgatgttagggtgtcaattttggatctttcctgctttctcttgtgggcattcagtgctataaattgccctctacacactgctttgaacacgtcccagagattctggcatgtagtgtctttgttctcgttggtttcaaagaacatctttatttctgccttcatttcgttatgtacccagtagtcattcaggagcaggttgttcagtttccatgtagttgagcggtttttagtgagtttcttacccctgagttctagtttgattgcactgtggtctgagagatagtttgttataatttctattcttttacatttgctgaggagagctttacttccaagtatgtggtcaattttggaataggtgtggtgtggtgctgaaaaaaatgtatattctgttgatttggggtggagatttctgtagatgtctattaggtccacttggtgcagagctgagttcaattcctgggtatccttgttgactttctgtctcgttgatctgtctaatattgacagtggggtgttaaagtctcccattattaatgtgtgggagtctaagtctcattgtaggtcactcaggacttgctttatgaatcttggtgctcctgtattgggtgcatatatatttaggatagttagctcttcttgttgaattgatcccttgaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcaggtgagatgggtttcctgaatacagcacactgatgggtcttgactctttatccaatttgccagtctgtgtcttttaattggagcatttagtccatttacattgaaagttaatattgttatgtgtgaatttgatcctgtcattatgatgttagctggttattttgctcgttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatacgaaattctgggttgaaaattcttttctttaagaatgttgaatattggcccccactctcttctggcttgtagagtttctgccgagagatccactgttagtctgatgggcttccctttgagggtaacccggcctttctctctggctgcccttaacattttttccttcatttcaactttggtgaatctgacaattatgtgtcttggagttgctcttctcgaggagtatctttgtggcattctctgtatttcctgaatctgaacgttggcctgccttgctagattggggaagttctcctggataatatcctgcagagtgttttccaacttggttccattctccccgtcactttcaggtataccaatcagacgtagatttggtcttttcacatagtcccacatttcttggaggctttgttcatttctttttattcttttttctctaaacttcccttctcgcttcatttcattcatttcatcttccattgctgataccctttcttccagtttattgcatcggctcctgagtcttctgcattcttcacatagttcttgagccttggttttcagctccatcagctcctttaagcacttctctgtattggttattctagttatacattcttctaaatttttttcacagttttcaacttctttgcctttggtttgaatgtcctcccgtagctcggagtaatttgatcgtctgaagccttcttctctcagctcgtcaaagtcattctccgtccagctttgttccgttgctggtgaggaactgtgttcctttggaggaggagaggcgctctgctttttagagtttccagtttttctgctctgttttttccccatctttgtggttttatctacttttggtctttgatgatggtgatgtacagatgggtttttggtgtggatgtcctttctgtttgttagttttccttctaagagagaggaccctcagctgcaggtctgttggagtacccagccgtgtgaggtgtcagtctgccccttctggggggtgcctcccagttaggctgctcgggggtcaggggtcagggacccacataaggaggcagtctgcccgttctcagatctccagctgcttgctgggagaaccactgctctcttcaaagctgtcagacagggacatttaagtctgcagaggttactgctgtctttttgtttgtctgtgccctgcccccagaggtggagcctacagagtcaggcaggcctccttgagctgtggtgggctccacccagttcaagcttcccggctgctttgtttacctaagcaaacctgggcaatggtgggcgcccctcccccagcctccctgctgccttgcagtttgatctcagcctgctatgctagcaatcagcgagactccgtgggtgtaggaccctctgagccatgtgcgggatataatctcctggtgcactgtttttttgtgtgttttttttttgtatttattttattttatttttatttttatttttttattttattttttttattatactttaagttttagggtacatgtgcacattgtgcaggttagttacatatgtatacatgtgccatgctggtgcgctgcacccactaactcgtcatctagcattaggtatatctcccactgctatacctcccccctccccccaccccaccacagtccccagagtgtgatattccccttcctgtgtccatgtgatctcattgttcaattcccacctgtgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaacaacagtgtaagagtgttcctatttctccacatcctctccagcacctgttgtttcctgactttttaatgattgccattctaactggtgtgagatgatatctcatagtggttttgatttgcatttctctgatggccagtgatgatgtgcattttttcatgtattttttggctgcataaatgtcttcttttgagaagtgtctgttaatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctttgcagaagctctttagtttaattagatcccatttgtcaattttggcttttgttgccattgcttttggtgttttggacatgaagtccttgcccacgcctatgtcctgaatggtaatgcctaggttttcttgtagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggttactgtagccttgtagtatagtttgaagtcaggtagtgtgatgcctctggctttgttcttttggcttaagattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttaagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccccggccagaacttccaacactatgttgaataggagcagtgagagagggcatccctgtcttgtgccaattttcaaagggaatgcttccagtttttgcccattcagtatgatattggctgtgcgtttgtcatagatagcgctgttttttaagcccgtcagaaaagcgcagtattcgggtgggagtgacccgattttccaggtgctgtctgtcacccctttctttgactaggaaagggaactccctgaccccttgcacttcctgagtgaggcaatgcctcaccctgctttgactcgcacacggtgagagcacccactgaccttcacccactgtctggcactccctagtgagatgaacccggtacctcagatggaaatgcagaaatcacctgtcttctgtgtcgctcacgctgggagctgtagactggagctgttcctattcggccatcttggctcctcccctgaaaatgttcgatcattattcacacttttttctttctcttactctgtcttctctcctttagattttctagttatgtgacattttcttcttgctactttccactggtcactgaaggctctgattattttgtcttcattaaacttttgtgagataattttagatttgcatccagttgtaagaaataatatagagagagcctatgtatgatttacccaatcccctttaatgctaacatcctgcaaaattataatacaatataacaaacaggatgttgaaattggtgtaatcaagatacagaatatttcattcattgcaatggtctctcgtgttgccatttaatagccacagtcacttttctccatccctactccctccgtaaccccgaaagctactaatgtattccccatttatataatttttgtcatttcaagaatcttatataaatagaatcatgcaatatgtaacctacatggactggatttttttcatccagcataattccctgcagatttattaggtttttacatgtaacaatagttcatttttatggctgagtagtattccatgatatagatgtatcacagtttgtttaaacgtttttcatttggactgatatcagttgcagcagttatgaataaagctgcttttttctatgaaaagtttttaatacttttacatttaagttagtgatccatctttggttaatatttttggtaaagtatgagatgtattcttgctgatgcatttgttgaaaaggttatccttctttattgaattccttttgcacctttcccattaatcaagtgggaatatttctgtgaattctcttatgggctctccattttattccattgattgatgcatatatctcttcaccaatatgacatagacttgattagtcttgaaatcaagtaaatgatcttaccttactcatatttattataactgttttagctactgtactttttgccttttcatatattttttggaaaaacttggttatatacaaataatgttgcttggattttgataagaattgtattaatcctgtatatcaatttcaggaaaatactcatatttttattacactgagtcttccaagccacaaatacaatatatctctcaatttatctatctttaattttgtttatcagtattttatagattttagtatagaagatctataaatatcttgttagatttacatcttttctctttttgagctatggtaaatattattgccctttaattttactgtccatgtgtttgtcactaatatatagaatataactgattttttatgtttatcttttattctgctaacttgttgaactcgttttttagttttggagtttataaattccttaagatttcctgacaattatatgcaaattgaaaccatttcgttgcttttctgatctgttgttattttatttacttttcttgcctttatacactggctagaacttccaaccctacattgaatagagtcatgagagtaaacattcttgccttgctgtcagtcatagagggaaagaatctggtcttttaccattgaatatacagatggtccttcatatctgtggcattttatctgtggatttaatcaacaatggaacaaaaatttttaaagaaacttaatcgttgtgtctgtgctgaacatgtatacagaactttttcttgtcattattccctaagaatacagtataacaattatttacatagcatttacactgtactaggtattatcagtaatccagggatgatttaaagtatatgaaaaaatgtgcagaggctatatgcaaacactacatcattttatataaaggacttgggcatccatggatttttgtattcatgaggggtcctgggaccaatctcccatggatgttgaggaacaactgtaatgttagctttaggtttcttgaatatactgtttgtcaagttgaagaagttttcaatactctcattttttctgagattttaaaaaaagtatgaatgggtgttgaattatgccaaatggttttttctgcattgattgattatcatacgaattgtcttctttattctatgattatggtgaattagattgattgattttttaatattgacctgttttgcatggtacaataaattccatttgatcatgttgcatattttttgtacaaatatatatatatagtatatacatatatagtacatatatagtatatatatgtataaaagtttcattcgtattttgttaaggatttttgcatctttattcatgagtgacattggtgtattttgatgatacacaaatcatcataagaatttctttcttctttctttcttctctctctgtctgtccatctgtctgtctgtctgtcttttttcttttctttctttctctcttaatatctttgcctgatttcggtatcaggaaaatactagctacactgttttctggaagaaattgtagaattattgttatttgttctttaaacatttggtagaattattcggtgaaaccatctgggtctagatatttttcttttgagactatttaaatgatgaattatttgtttcatagttacagggctatacaaattatctatttcttatgagtgagttgtggtagcttgtgttttttgaggaattagcccactttgtctaagttgccaaatttatgtgtataattatttgtagtagttccttattatagttttattatcatcggtgtccgtagtaatatccttgttttattcctgatatgggtaatttgtgtcttctctttttttttcattgttaatcttttgttgtcaattttattgacaacattgcaataatgttctgtattgcttttctgttttcaattttattgatttcttgtattatctttattattttctttgttttgctttctttgggttgattttgctcttcttattttaaattcttaaagtagaagttaaaattattgatttaagacttttcctctttttcaatgcaaacatttaatgctgtacattttcctctcatcactgttttagctgtgagttcaaatttttgatattgtatttttatttttattcagctaagtgtatttattttcccttgacacttcctctttgacttatgaattacatagaagtctcctgcttagttatcatgtgtttggagcttttcctattatctctctgttattgatttgtcatttgattccattgtggtttgattttaattccattacattttttaggtttgttttatggttcaagatgtagtctatcttggtatatattctgtgagcatttgacaagaatgtgtattctgctatcactgggtagagtagttaatgtcaagtagatcctacggtcttacggtattgagttctttgttgatgctagttttgtgtctagttctatttttaattggtacaagagtgctgttgaagtccccaactataattgtgcattagtctatttctcctccatttctaacagcttttgcctcacatatttcactattttattttttggtgcacatacatttagggttgttatctctcattggttgattgactcctttattattataaaatgtcccttcctatttctggtatcttttttttttgctctaagatctaatttatctgatatagccacagatatagctgtgtccccatcaaaatctctcatcttgaattcccacatgttgtaggagggagctggtgggagataatttaatcatgggggaaagtctttcccatgctgttctcataatagtgaataagtctcacaagatctgatagttttataagggggagtttccctgcacaagctctctctttgcctgctgccatacatgtaacacgtgacttgctcctccttgccttctgccatgattgtgaggcttccccagccacatggaactgtaagtccattaaactctttttcctgtataaattgttcagtttcaggtatgtctttatcagcagcctgaaaatggactaatacagtaaattggtatgagtagtgggatgctgctaaaaagatacccaaaaatgtggaagccactttaaaactgggtaacgggcagagtttggaacagtttcgagggctcagaagaagacaggaaaatgtgggacagtttggaacttcctagagacttgtcgaatggctttgaccaaaatgctcataacgatatggacaatgaaatccaggctgaagtggtctcagatggagatgaggaacttgttgggaaccagagcaaaggtgactcttgttacgttttatcaaagagactggtggcattttgcccctgccctagagatttatggaactttgaacttgagaaagatgatttagggcatctggtggaagaaaattctaagcagcaaagcattcaagaggtgacttgggtgcagttaaaggcattcagttttataagggaagcagagcataaaagtttgaaaaatgtgcagcctgacaatgtgatagaaaagaaaatcccattttctgaaaagaaatccaagccggctgcagaaatttgcataagtaatgaggagccaaatgttaatctccaagacaatggggaaaatgtcttcaggccatgtcagaggtcttcatggcagcctctcctgttacaggcctggaagcctaggaggaaaaagtggtttcatggggtgggcccagggtcctcatgctgtgtgcagcctagggactttgtgccctgcatcccagctgctctagtgatggctgaaaggggccaaggtagagcctgtttaacctgttttgatttggagaagcacagaaaatgaggcacacagagattcacataaagatgccatgtatttgaggagcaatctgcctgtgtggcaatagagaaggagagagcttttagactatgaagcctggaagtttacaatggccccttaccctgaccagaacttcctgaaaaaaagttaacaaaggaaatagtaaataaagtaaatatatactagcaaataaaggctgctattaagtaaaggctaatattgaagaatctgaaaagcatcagcagaaatttattgtaagagaagagtatagaagtgggaaacaatatttaccatcaaataaaaagtaattgccaataggaaaatgttgcacagaacacattaaagaaaaccctttgaaaaattcaaactaaagagactttttataaagatcatatataaaaataaacaacaaaaagtgataattttgaaaaagagcaattaagggaaattagctctttcagatattaaaatattttataaagcctaatatttaaatttatgtgatattaggatataaatagtgagaaagaataaaggaataaaatagaaagtataaaaattaatatgaatatatatatatactttaacatatgataaagatgacatctcagttttcttgggaacttggatagccacttggaaaaacttaagttgaatctctactttatatcctaacaagatacatctaaaatggattatattttaatgttaaaaaataaataaatcttaaatgtactagaagaaaaattgaatacctcctataaaagctaaaagaaaagacagagcatttctcaacagcaaaatgtaccataagataatgtcaacagaacaagttaggaatacatttgcaatacaattcatatcaaaaagggctaatccctttaatacaaaaaatcagagaaaaagataatgtaatcaatcaaacaagatgcaaaagacaccaagaggcatacagtggaaataaaaataactattagatgtataagttctatgtcactctaaatatatgacttataagttggagctaccatgaaatatctttttatttattagatgtttaaaaccataaaattttaataacagaatctgtcaaaatgtgggaacacactcttactttgctaatggaaaggtcaatatgtacaattacaagcaagagaaattcaaactttcaaacatctaattacaaacatgtatttcctctgatgtttgacctagcaatttaatttatatatatttccatgtatgtaaaattacatctagacatatttattctttcaaccactgtttgtaatagcaaaagactgggaacaacccaaatatccattaaaaggtgaaggtttaaataaatgatgatatattcatacaacagaaggtaatacaaatctaaaaacagactaaaataaagtcttctttatgctctaaagtgaaaggatctccatgatatattatgtaaggaagcaaggagaaggatttaacagtttttaaatctctgctcttaatgctgcatataaggagcttggaagtcaccactccatccagttttctaacaagtaaaaaaacagaacagactgaaaaataacaaattttctaggattcatcagagaggtgaggatatagaacaaactgcttcccacaatattggagagataataagattaatacagggagtcatgggtttaccacagcagagacttacaagcaaaactgctgcaggaaccagtgccaggtataaaaacctgaactataattgataaattgctagagactcagagaggacaaatctgagacttgtatatcccaatggaatcctgccaagaagaggtggggtatgtgagtttaacctgcaagagtatgaccaggttctcatagtaaatactggaggaagacttcccttgtgtttcaagtacagggagaggaaatacaccagagtacactgctctttgacaaggcctgccctcaggagaagctattcaaacagagccttgtctgctgaggttttgtagcctaactgacatgtgggaagggaaatacccaaatctagccatcctatctcatggaaaaggaaggggggctgagaaattgagactattgggaggttcatagtccagagacacagtccagaggctcactgaaacactgagatctaatcataagactacagaatggtttccttccccccatcccttaacaagatattactaaaggcctattttcagcagttccatttacatggtaaatcatttctgactatgaagaaaaaattactaggaaaaaaaaaaaagaattagaagaaatagagtaagcatcaggaccaggtaaggcagggatattgaaatgatcaaacctgaaattttaaacaacaatgaaaaatacgctaagggctctaacagataaagtagacagcatgcaagaacagatgggcaaatgtaagcatagagatggaaatcctaggaaagaaacaaaaagaaatgctacagatcaaaaatactgttgagaggtgacagtgtgctggcagtcttcacagccctcgctcgctctcggggcctcctctgcctgggctcccactttggcggcacttgaggagcccttcagcccaccactgcaccatgggagcccctttctgggctggccaaggccagagctggctccctcagcttgtgggcaggtgtggagggagaggcgcgagcgggaaccggggctgcgtgggtgcttaagggccagcgtgagttccgggtgggtgtgggctcggcggacaccgtgctcggagtggcggccagccccaccagccccgggcagtgagggatttagcacctgggccagcagctgctgtgctcaatttctcgctgggccttagctgccttcccgtggggcagggctctggacctgcagccaccatgcctgagcctccccccgcaccccaccccccaccctccctgggctcctgtgctgcccgagcctcccaaggagcgcagctgcctgctccacagtgcccagtcctatcgacacccaagggttgaggagtgcgggcgcacagtgcgggactggcaggcagctccacctgcagccctggtgctggatccactgggtgaagccagctgggctcctgagtctggtggagacgtggagaacctttatgtctagctaagggattgtaaatacaccaatcggcactctgtatctagctcaaggtttgtaaacaccaatcagcaccctgtgtctagctcagggtttgtgaatgcaccaatcgacactctgtatctagctactctgttggggccttggagaacctttatgtctagctcagggattgtaaatacaccaattggcactctgtatctagcttaaggttagtaaacacaccaatcaccaccctgtgtctagctcagggtttgtgaatgcaccaatcgacactgtatctagctactctggtggggacttggagaacctttgtgtccacactccgtatctagctaatctggtggggacgtggagaacttttgtgtctagctcagggattgtaaacgcaccaatcagtgccctgtcaaaacagaccactaggctctaccaatcagcaggatgtgggtggggccagataagagaataaaagcaggctgcccaagccagcagtggcaacccgcccgggtccccttccacagtttggaagctttgttctttcgctctttgcagtaaatcttgctgctgctaactctttgggtccacactgcctttatgagccgtaacaccgcgaaggtctgcagtttcactcctgagccagtgagaccacaaaccgaccagaaggaagaaactccgaacacatccgaacgtcaggaggaacaaactccagatgcaccaccttaagagctgtaacactcaccccgagggtccgtggcttcattcttgaagtcagtgagaccaagaacccaccaattccagacacactgtgacagaagtgaagaattcctttgatgagcttattagtagactggacacagctgaggaaagaatctctgagcctgaggctataacaataaaaaccttcaaaacaacaagtaatgaagatgatacaatagctaaaaagaaattatttaggcagtgagggtaagtgtattagtcagagttctctagagggactgactaataggaaatatatatatgtatatatatatatgtatatatatgtgtatatatatgtgtgtatatatatgtgtgtgtatatatatgtgtatatatatatgtgtgtgtatatatatatgggagtttattaagtgatattaactcacaccatcaccaggtaccacaataggccatctgcaagttgaggagcaaggaagccagtctgagtcccaaagctgcagaacttggagtccgatgtttgagggcagaagcatgcagcacaggagaaagatgtaggctgggaggctaaaccagtctaggcttttcacatttttctacctgctttacattctggctgcgctggcagcagattacatggtgcccacccagattaagggtgggtctgcctttcctagcccactgactcaaatgttaatctctttggcaacaccaacaccctcacagacatacccagaatcaatactttgcatgcttcaatccaatcaagttgacactcagtattaaccatcacagtaagaaagtcctctgtaaggcttcccttttaacaaaaagcagcctcaaatcatttttgtttctagcaaaatgcagcctgaaaaatcaaactgcagatgtagaaaagcaagctagaagctttcacgggtaaatgccagcagctttgacaatagaaaaaggctacctggaggccaggcatgttcaacatgggactccatcttccctttcctttgtcaactgtgtgaactgtaaggaacagatgtaatggcacaggccaggtagagaactcatttgcatgataaaaagattagggtggggtagccagcttcttcatgtgctatgtaaatgacacacctggtccaaccaaccaatcttttgggccccatgtaaatcaggcaccgccttctcaagcttgtctattaaaacctgtgcatttcatcacaaaactggaggacccgcttgggagcccctctctctctgcaggagagagagctattctctttcttttgcctattaaacttccactgttaaactcacttcttgtcctagatttctctggcatgagacaacgaaccttaggtatttaccccagacaatgatgctgcttcaagaacaaccaaaaaatagaaaaaaaaaaaacaaaaaaaaacagaacagaatattcagggagtgtgtgacaactataaaaggtgtaacataaacagaaacagaacactagaaggagaaaaaaagtgaaataaacaggagaaatatttaaaacaataatgctttagaatttttcccaaattaatgtcagacaccaaatcacagatccagaaggctaagggaaaatgaagcaggataagtgctaaaatcaaatattaaaaaaaattctgaaagaagtaagaggaaaaaagcaccttatttttagaggaacaaagataagaattatatccaacttctcctctgaaaccaggcaagcaagaggagagtagggtaaaatttttaatgtcttgagtgggaaaaaaaaataatctcgccaacctagaattctgtactctgtgaaattacactacaaaagtgaaggagaaatacagattttctcagataaacaaaaattacagtggtttattgctactagacctgctttgcaagaaaaggatagggaaggaaaataatatagctcaaaaacttggatcatgataaagaaagaaataacactggaaaaaataactaacagtaaaataaaaacatttttcttcttcttaatctaaaagataatagtttgttcgaaataatagcaatagtgtatttgcttatgtattctaatatatatatagatttttatatgcttatgtgtaattggaatgaataatagcaatgatacaaagaatggaaaagaagtatcaagattattttgttattatagggtactcatactacctgtgaagcagaatagtgttatttgaaagtggacttggatttgatgtatattgcaaactagggcaaccactaaaaagtgtaaaaagaaagaagtataactgatgtgctcagaaagaagagaaaatggaatcgtaaaatgctcaatgaaaaccacaaaaggcaaagagcagaaaacaaacataggaacaaagaacaaacgcagcaaaaggaaacagcaacaaatatggcaaatattaattcaagtatacaaataatcactttgaatatccatagtctaacacaacttaatacatttacactgttggatagtaaaataacacatcttattagaacatgtgggatatagcaaaagcagtgctcagggagatatttacagcattgaatgcatatattagaaaaaaggaaagatctaaactcgaacatctaagttcccactttagaaaacttgaaaaagaagagcaaattaaatccaaagtaagcagaaaaatagaaataaaaaagttagaggagtcattaatgaaattcaagacataaaatcaatagaagaaaaaaatttaaccaaaagctggttcttgaaaagatcaataaaatcactaagctctagtcaagataactaaaaacaaagagagaagacatcaattactattatcaaaaaggaataggggatatcactatatattgcttgaatattaaaaggataactaaagaatactatgaacagaccaagcgcggtggctcacgcctgtaatcccagcactttgggaggccgaggagggtggctcacaaggtcaggagatcaagaccatcctggctaacaccgtgaaaccccatctctactaaaaacacacacacacacacacacacacacacacacacacaaattagctgggtgtggtggcgggcccctgtagtcccagctactcaggaggctgaggcagaagaacggcgtgaacccaggaggtggagcttgcagtgacccgagactgggccactgcactccagcctggatgacagagtgagactccatctcaaaaaaaaaaaaaaagaagagtactatgagcaactttatatgcacaaatttgctaacttagatgaaatgaaccaattccttgaaagacatagtttgccaaaactcacacaagaagaaatagataatctgaatagtcccaggtctagcaaaacattgaatcaattaataaccttccaaaacagaaagcagtaggccagatgggttcactagtgagttctaccaaacatttaaagaagaaattatacaaattatctttaatatttttcagaagatattagcagaaggaatacagcctaattcttccaataagaccatcattaccagataagattattacaagaaaagaaaactaaagaacagaccaatatctttcataaacataaatgcaaaaatcctcaaaatacattagcaaatagaatccaacaatgtataaaaaattacacaccacaatcaagtgggatttattgcatgcaggcaagactggttcaacatctgaaaataaattatgcaatccatcacattgacaggctaaaaaagaaaaattgcatgatcatatcaatagactgggggaaaagcatttgacaaaaccaatataataaaaattctcagtaaaatagaaataaagggaaactttgtcaacttgataaaaacaatctacaaaaatcctacagctaacatcatacttaatgataagaaactgtaaactttttcactaatatcaaaaacaaaccaaggatcctctctcaccacttctttgcaatattgtgctggaattcctagctaatgcaataaaacatgaaaagcagataaaaagtctacaaattggaaagtaagaaataaaattgtcttcattcacagatgacatgatcatcaatgttgaaaatgcaaaataagagtaaaaaactctcctggaactaataagtgattataccaagattgcagaatatgaagaataagcttagtaaattgttttcctatatatagcaatgaacaagtgaaattttaatttaaccatataataccaaatctacatgcagaaaactacaaaactgatgaacatcaaagaactaagtaattaaatattttatgttcatggatagaaaaactcaagattgtcaagatgttagttcttcccaatttgatgaagttccaatgcaatctcaataaaaattccaggaaattatttcatggatattgaaaaactaattctaaaatgtatatagagagggaaaagaccctaaatacccaatgtaatattgaaggagaaaaacaaaattggaggacgaagacaagacccaacttaaagacttacaataaagctgcagtattctagataacatggtattggtaaaagaatagatgaatagatcagtgaaacagagcagggagtccagacgtagacccacacaaagacatcaactgacctttgacaaatgagcaaaggcaatacaatgaaaaaaagatagtcttttcaacaaataatgctgaaacaactagacattcacatgcaaataataataaaagacagataaaataaaagatgtagaccttacactcttcacaaaaattaactcaaaatagatcatggatctaaatgtaaaatgcaaaactataaaactccttgaagaaaacataggagaaaatctaaattgccttggctttggcaatcactttttagatacaacaacaaaacatcttccatgagagaaataattgataagctagactgtatgaaaattgaaattttctgctctacaaaaggcaatgtcaagagaatgagaagataagctaatactaaaataaaatatttgcaaaagatgtatctgattaaaaaacttatctaaaatatacaaaggacacttgaaagtcatcaataagcaaataaacaacccaattaaaaatggtttaaatatcttaagaagcacctcaccaaagaagatatacagatgaaaaatgaacatataaaaagatgcttcacatcatatctttagggaaacacaaattaaaacaacaatgaaataccactacgcacttattagaatggccaaatttcaaaacagtgattatatcaatagctgatgaggatgtggagctactggaactcttattcattgctggtgggaatgcaaaataatataggcactttgaaaaacaatttggtggtttcttacaaaactaagcatattcttaccacatgatccagcaataatcatccagtaataatgctcctttatatccaatcaaaggagctgaaaacttacacccacagaagaatctgcacatagatgtttactgctgctttacttataattaccaaaacttggaagcaatcgagatgtccttcaataggtgattatatcaatgaaccgtggtacatccaaacaatggaatattatacagccctaaaaagaaacgagctgcaagctataaaaaacatggaggaatcttaaatgcatattactaagtgacagaagccaatctgaaaaggctacatatcacatgattccaactatattatattatggaaaaggcaaaactgtggagatagtaaaaagatcagtgattggaacagagaggcagaacagaggattttcagaatagtgaaaatactctgtatgatattatgatggtggatacattgcattatatatttatcccaacccaaagtatgttcaacaccaagagtgaaccttgatgtaaactaaggactttgggtgaccataatgcatcaatgtaggtttatcaattgtaacaaacgtaccatactgttgggtaatgttgataataaggaagattatgtatgtgtgtatgtatgtatgtgtgacagcagggggtatatgggaaatctctgtaccttcctcgcaattttgctacaaaactaaaagtgctctaaaaaaataacacctaagaaaagtaacttgcacattttaaaataagcaatgagtcaaagaagaaatcatgagaaaaattagacaacactttcagaagagtctaaataagacccaattcaccaaaacttatgaaatgtagctatacagtgataaagagaaattatagctgccaatgcctgtagtaaaaaagaaaaaggattctacatcaatcaattcacttcccaccctgaaacactggagaaacaagatcaaactaaacctagaactagtagaaggatagcaataataaagattagtatagatggataataataaagtaaaaaacagaaaaacaacagagaaaatcaatgatagcaaaattacattgtttgaaaagatcagtaaaatgcaaaacctcaagttagatgtgtgtttaaaaactgggaagattcaaattactgaaatcaaaaatgaaaggacctctctactgaccatacagaacaaaaaagaggaaaaaggaatcctttgagcaattgtaggttaacaaattagataacagatgaacaaattactagaatgacatgaattactggaactaccttctcaagaaatagaaaatctgagaaattagtttctcagattagacatatcataagtagagattgggttaattattttaaaacttctcacaaaggaaaaccccggcccaaattgttttagtgaattataccaaatatttaaaaattaatataaattattcacaaatttctccaaaatatagaagaagagagaccacttcctacctcattccattaggccaaagttgccatgatacaaaataatacaaagatatcacaagaaaaaaagctacagactaatattttttataagtatagatgtaaaaatcttctacaaaatactaggaaactaaatctaacaacatatgcaaaggattaattatacactatggtcaggtggattttatctcaggaaaacacgttcattcaacatctgaaaacaatgtaatacaccatgtcaatagaataaaggacaaaaaccatatgatcatctcaatagatacagaaaaaagcacttgacaaaatccaacaaagtttcgtgataagatcactgaaaaaactagaaatataaaagaacttcctcacctggtaagggaatctattaaaaacccacagctcacatcacacttaattgtgaaataatcaaagctttccccctaaaatcaagaataagacaggatgtctgttcacatcacttctattcaacatagtactggaggttccagacagagcaatgagataagaaaataaaaagcatgtggctgggcagggtggctcatggctgtaatcccagcaatctgggagaccaaagtgcgtggctcacttgagaccaggagttcgagaccagtctgggcaacatgaagaaatctcatctctacaaaaaatacaaaaattagctgggcatggtgacacatgtctgtagtcctagcttctcaggaggctgaggtgggaggattacttgagccctgaagatagaggctgtggtgagccatgatcacaccactgaatttcagcctgggcaacagagtgagaccctgtgtcaaaataaacaaataaataaataaactaacaaatagcaggcatcattattgaaagaaacataaaatatctgtttgcagatgacatgattttgtgtatagaaaattcttaaaaatatacttttaaaaactattagaactaataaaaattcaacaaatttgcatgatacaagatgaacacaaaaattatattttaatatactagcatagagcatgcagaagtgaaattaagaaacaattccatttaccacagcatcaaaaagaaaaaaatgcataagaacaaatttaataagtgcaaaagtgatatactgaaaactaggaaacatttctgaagtaagaatctaaacaaatggaacgatatctcatgttcatagatcagacatcctattgtttaaatggcaatactccccaaattaatctgcagattcaactcaatccctctctatcaaaaaaagcaaggagtagaacaatgtatattgttctgtattacttatatttccataaagaatgtctagaaacattcacaagaaactaatgaaagcatttatgtatcataatagttgggttgaaactggataaatgtggggcaggttgactatatatattgtttttctttttacaccctgcattattttttaaaagtatgggagaggagcaggattggaaattatcttgccccactctagcagtctgtaagatagacaagcctggattcatagaatcagactagaatgactgacaaataagcagtgtgtggaggtaatcctcataggatgtgtggccgcccattactttgaacttccagagaatattactaacatccattgaaacaggaacaagtaaaggggagaaaggctagcttacttaatccaatgggattttaacttctttatcactatccccacagcagctgtagcgagggccctcacacatctctccagtcttccttttcctcacactgtcacctcttatccaaagtcagaggaaacctagagaaggtagtagattttatctatgaatgatcctgctgtgcaaaggagaaaagatagggaaagactgggaaaaagagcagaggagtcagaaggagttcctgctgactctttacctaacttgggtaccacagggcaggagataaactttggagaagagtgcaattaagcaaacgccacttcagctttgatctacatttaatttgttcacatttgagggttcagatccaaaatgaaaaagggttttatggctgaatattatttcattatatatgtaaaccacatttcctttgtctttttatccactgatagacacttagtttgattccataccttggctgttgtgaatagtgctgtaataaaagtgggaatactggtacctcttcagcatactgatttcctttttatgagtatgtatacccagcagtgggattgctggatcatatggcagttccattttcagtttattgaggaacttctacactgttttctatagttactgtactactttagattcctcccaacagtgtactggcattcccctatctccacatcctcactagtatttgttactttttgtctttttgataacagccattctaactggggtaggtaatatctcctagtgattttcatttgtatttccctcacaatcagtgatattgaatagtttttcatatacttcttggccatttgtatatcttcttttgagaaatgtccattcagatcttttgcccatttttaattgcattgattttttgtttttttttgctattgatttgttagttccttacacatgctggttattaatctcttgtcagaccaatagattgtaagtattttctcacattctgtaggttgtcttttcactttattgattgttttctttgctgtgcaaaagctttttagcttattgtaattccatttgtctattgttgtgttgtctgtgcttttgagatcttaccccccaaaatctttgctcagaccaaagtcctgtagcattttcctagtgttttagtagtttcatagtttcaagtcttgtaatgaagtctttaacccattgttagttgatttttgcatgtggtggaagataaagatctagtttcatttttctgcatatgaatatccagtttatccagcaccatttattaaagagactgtcctttcccccatgcatgttcttgatatctttgtcaaaaaccaactgagtgtaagtgtatggatttacttctggattctctattctgttgcattcgtctaggtgtctgttttatgccaatatcatgctgtttgggttattatagctgtgtagtataatttgaaatcagagcttgtgatgcttctagctttcttctttttgctcaggatgattttagctattcagggacatttgtggttctatacatattttatattttttttatttctgtgaagaatgtcattggaatcaagcttgagcttgtatacagattttaacaatattaagtctctcaactcatgagcataaatttccaccttatcatttgcagcaggatgtgtagaactggaggtcattatgttaagtgaaataagccaggctcacaacaacagatatcacatgttctcattcttatgtgggagctataaaagggggtcttatggaggtagagggtagactgggaagggaagagggatggggagatgaagagaagttggttacggagtacaaagacatggttggatagaaggaatacgttctagtgtaaaagagtacagtaggcaaattatagttagcaataatttattgcatttttaaaaatagctagaagaaaagaactttaatattcccaaaacaaataaaatataaatgtttgaggtgagggatatcccaattaccctgatttggttattattcattgtatacagttttcaaaatatcacatgtacccccaaaatatgtaaaactgttatatacaaataaataacaaaactaaaaataacagctgtgcaaacatttttaaaaggcttgctttaaatgggtttcacatgaaagtaggaaaggactctctggagtctttaccatctttatgtgagaaacacattggtcccagtggtctctttacctttcttagtccatcctttcactctgtacatctttctgaactcaatgaattatacactattgctgcttaattgctttcagaaatggacccctgcacaggtgggaatggatgtgttcacatatgtcagagtgagaatggcacggccaggtgtgcctgtcatgcagggtaccagctgcctgaagataaaaacatttgtgaaggtaggagactgaaactgaaggattaattgtgtaattgtttgaaattttgtggtaattcagttttgaatagtcagaacagctaggagaaaaggtgttttcgtttattcttaaaaaggaacatttaaattcttatttgatcatttgaaagctatttttataccataaaacttcagtgaaattcttagtaacattttaaaaaatgacataggatagttccagacttaatacgttttgtttctcattctgaagtgaattccagaattaatatttcaaaatcttctatagccacacaggaagttttttattataggctacagaaggtggggataacctttgaaaagcaagtatatgtaaatgagtgttttcagaagtcaggaataattaaaacaaaaaagaaagaactctataaatacaaaatcacacatttatctttcctagaactagcaaaacagacatactttaattcaaagatgaaagtgacaaattcttccctcacaagaactgatacattaagtaatttctctggggcagtcttgtcaaaagtctcattttaataacttttgagaaatcactttttttatcatgatattttcatgaaatgagaaaccatttttatcatgatattttcatgaaatgagaaactatttatttggagtaactacaaaagtaattatgacttatgggactgataaaaattacgaaaaataattagtaatggaaatttgtgttttcatttttttctttaggttgaaattaagatgatattttctgtggattttttaaacacacttttctaacagagaacatttctgctttggtcctctgtttccacagcacctatctagctcagcacctggcacagaataggatcatcttaaataaatatttgaggaaaactgacaaatgtttgcagacatagatatagttatgtatatttatctgtctactgactttcacactcctattttaacatctgatacattatttatagaaaatctatcctcagaattactgcctgcctattctattacaaatacattagaagaatgagtatttctcttaagcaccctggtggggatgatatgtagtatggaggaagaaccagtttaaaaaaatgtgagacctatccccttaaagggaggaaggagagatcgcctgagccacacaactgaagttacacacactgaatagaattgactactgatatcaggagagagagggtatcagtgtctaagtggcattcccttgtgacaatcacatgtataacagaaaccatggattgctaaatatgaaggccccttatctgccttgcccgtggccacacatactaatgtaaatcaaagagatagtcctaaagacaaattacaatgacttcttccctgcattataaggaatagattaggcccatttttgtttcattttctctttttttcttattaatagatactattaggttctaatagaagtgtttgagagcataagaccaacactagtggtaatgtcataagcagtcagcttattcacaaatactcctttatataaagaatatggaacctatgtggtacttactgttacagtggatgttgggggtgggggtcaagtgggagcaggtgcattggtccattattgtagtttgtcaaaaagtcatcattatagctcctaagacatagctgttgtgtctgtcttcctgcagatataaatgagtgtgctgaaggtctttcttactgtggccactgctgtgtaaactctatgggatctttcacttgtgcctgccaaactggctttgagctgggagctgatagaaaacaatgttacagtaattggcaacagtcacagcccaggtaatgtgtggcattttacaggtattaaacatgagtaatacataagagaattacattgtgtgtcttgctaaagcaggagctcctgagaaggatgtggatggaggcttaaaaatccaacccctttattttataggtgagaaaacagaggcccagagtcaatggagaatggtttgcaaaataatctgtagtgtcattagcaaggattaagcctcaggttttctgacttggggctttgttgggttcatagatctttgtgaaaattctgccttcctttatcagttctgccatgcaatatttattgaacactaataactccattgtaaaactcaagagaaaggaaagagcaggagtgaaggaaccaccgtacaagaagcagctctaagctgcaataccatgcctcatgcattggatgttctaatgagaatcttccacattggccctccccctccctccctcatttcctttcattatgcctattgagcagctgcttcctgctttgtcttttcttccactgattcatttccctatcccttctcttcaaaacattcatgatccatatcatataaccttagcatcttcctccctaggctcagttatacaactaaatatatccctttttaggaacatattaaaatgttaatatgctgagcgattagctatagttgctattacaactatgttctcctcacacgtcatccccactggtccactacttaatctgtagatgagcacactttctactttactaagctttaatctatctgatacaaatttcctcaagttcaatgttttctacctcaacatttgccatcctcatccatctctacttctgtccttttctaaatggcagatttttttttcttatttttatggctgatttctccatctctgtctcagtacatcaagagacagaggtcttggtacatcaacaattcatttttcttcttcatcttcttcttcatcttcagactctatctttctctcagtgacttcttccttctttttccagttcacgactatactttaccaggtaaattttactatgttgaaaacataaccatgctaactggttttgctttaaattcaggatcataaatcttaaatgattaagcagcattggtggacaaacatactgtcagaatatgtctacttttaccctcatcaaaataagtgtttaacatctcttccaaaactttatatcaccctccttttgacctttgtcctcatctcatctcttaggtcatcaaataataaatgcaaactgtcatccaaggtaacaattaaaccaaagtctcccatagattcacatggaaaggcttcagtcctattaatatgaagcaggtagccctattactatcaaaggtcatcttctccatggagctttgggttccattctctcttcacatctgaagatctttgcttttgcaattatttccctcttttctgaattatcagttctttcttctgcatcattttcatcagcataacaacatggccaagtatcttctgtctttaaagtactttcacatgagtccatatttcataaaagctaatgtctgactctatagccaatgtctcctctttctcatcttgcattctctcatcagcccatactaatcaagttttcatctctactctgccacttgtcacccatgacctctatgctaccagattggatggtagcttcttcaattttatcctaattgacctctcagtagttttcaacacttctgactaccctcaagtcaggcaaagttcctgcctttatggaacttaaattcctacagaggagatagaaaacaggaaattaatcaaagaaatgtatactattatcttatatagtgttaatatgcaatgagaagatccaagaaaaaggagcagtaataactaagaccctaaggtagggctgagcttgatgtttcaggaaacagaaaaccagtgtgggctggaaaagaatgaacaaggtgtagagacagtcaatgagagcagtaggcagggaaagggaacaatcagattatactagacttggccatcgcaagcggtttgaattttattccaaatgtgacaagaaggcattgggtagttttgaacaaacaaaagagttcaagaagagcaaaagagttcttctcaaaacactcttcacttctgtgttactacatttttctagtatttctttccatctctggcccttctctcaatgtaaaatttatccaactgctctccttttaactacatatgaatataccaaactattccgcatcactacctgcatgactggtaggcatttcccacttggtagaaccaaaacagaaatgctgattttgagtccgagtcccaaagagccttttctcagttcttcacatattaatcaatcatccatttagtgacaaagtcaagaactcagtgacagaaaattaataagtgactgaactaggatttgacctagagtcttcctgcctcagatataatatcctttcagcttcatcatgtgtttatatacgttatgtctctttattagttttaatgaaggaacaaataaagatggtgatatataaaataaatatttaagctttcttacctgagctctttcatgaagagatattattagagtaactaaattcctcattcttccttccgacataaaattctatgtgtctttaattctacgctccttaaggtctgttggtatatttttattgcttaaagactacatttttgctacagtgatatttgccttttaaagagcaaactaaataagatgggagagaaatttgactactaattaagatacaacttcctctgaagtcaggcttttttttttaatgccctaaggagtcctttcaggccgagaaaagtgtggaaggatttttctttgccttaagtattttggctttaatgtgaccagaggtttaggggatgagtatattttacaagtgtatgaaattaaacctcttgtaatctgactggtgcttcctcagttatcaggaaagagggggtcattattgataagttaggaggtacatacaagttttctgtagaatttacttgggaaagaaatttgctctcaagttgaatacatttggtagaagtttatttttacatttattttccttctgtgaatatttggctaagctctttctgcagtcctcaccagacctatatttactaactgaaatacaaacctttcctagtgaaaactggtcttttgacttgtttcaaaacctatagatggaataagtccttttagaccatgatgtcatatatatatatatatatatatatatatatatatatatatatatatatttttttttttttttttttttgagacggagtctcccactgttgcccaggctggagtgtggtggtacaatctctgctcactgcaagctccgcctcccgggttcacgccattctcctgcctcagcctccagagtagctgggactacaggcacccaccaccacgcccggctaattatttgtatttttagaagagacggggttttactgtgttagccaggatggtctcgatctcctgaccttgtgatccacccgccttggcctcccaaagtgctgggattacagacgtgagccactgcgcccagccgagtatgatgatatttaacaatgaattatgtgcccatcatctaaagtacgttttgaaatgatgcttttttcttttttagagaacagtgttttatatttatgtagttttttctcaacaggtctcaaaacactttgcagtataaccattgaatcttcatagtgtactatgaattagctatcattgtcttataattagaaattggaaaatttgacatacagaacacttccttcaaattaccaagcaatatgtaatatagtttaactatttcacacatatttaatgtacatcttatctagcaagcaaacaatatatttgctacttataaaaatgttttaagtatgatttctaaagtactataataaaaacattttttatcatctgaatcaaagaatcaaaatctcagcttgcatctggtaggtagttatggatctgagtttgcactttttttagttccatatatctttaaagaagtgaccatggtatcatttatattcaaatccaattaccaccagcagtctaaagctgtattgatgcaatatcactggaaaagagcatgaataagagaagcctatgtaaaaattgtcaaatggatactttcacctctcttcccccctgaaaaaatcaattaatattagaaatttattatagttttcagtattttaaatataacctaatccagggatcaaaactctaacaccaacacaagacaggcaataaatataaatgtgtaagacaggctaagcataaaagataggaaattgtaaggactgttttgaactggagagggagttttgggcctagagaggacagctattgcttgattgcttgcctccagctaactgtcacctagagggagtgtgatgccagtgtactagacccactgatttattcaacaagtgcttactgaatacctaccatgtgctaggtgctgttcctaacactatagatacaatgataaacaagtcaggaaaagttcctgcctttatggaacttaaattcctatagaggagatagaaaacaggaaattaatcaaagaaatgtatactatcaccttatatagtgttaatatacaatgagaagatccaagaaaaaggagcagtaataactaagaccctaaggtagggctgagcttgatgttttaggaaacagaaaaccagtgtaggctggaaaagagtgaacaaggtgtagagacagtcaatgagagcagtaggcagggaaagggaagaatcagacttggccgtcgcaaggggtttggattttattccaaatgtgacgagaaggcattgggtagttttgaacaaacagtaatatcatatgattttcactgtttaaggactactgtggctactccctagggaatggacagtagggagtgtctgtaaaagcaagattagagtcattcaggtgagctgtggtggtggctttaattaagctagtagcagtagatttgagatttattttgtagacacagctgagatgaattcctaatgtggatgtgaggaaaagaaaaatcaagaataattcttggtttggggctttaggaaacaggtgaatccgaatgtcttttaccaaaatgtggagtccaatagaagaacaggtttggaggtgagatatagggtatgtttaaatcataacttctatttctgctgtgtgaagtttaaggagccaagtagaaataacatgtaggtagtttctatctatttcctaactaaatagaaaattctagaagtttatggtggtcagagcttgagtgagcagcttgtcaagatgtaaatgtcagtatttaagccatgagcaagaatggggtcacttacaaagggagggtgtctggaggagtaagcaggaggaaactgagactgtagactccaacattaagtaactaaaatgtgacacagagacaggaaagactgaagaagaatgtccagtaaggtttaaggacaacttggataatgtgattttctgaagaataaaataaaaaaaagttgggagaagtaaatggtcaatggtatcaagtgctgctaaggattaggcaatgtggcagtaaatggagaacaatgtggaatctagggagggttatcttgcctcttaatttattttttacttagacagtaaaattaacatgttcagtatataatcatatcaattttaattgtaaatatatagatttctgtaaccaccattggaatcatgattaagaatagttttgtcaaccccagaaaactccctggtgctacccttggcttgtcacttattccccgtctctaacctttgacatctacttgatgtgttctccctcactggaattttcttttcttgggaatgtcatataaatggaattaaactgtgtgtatccttttattcaacataatgccattaagattcagccaagttgttgctcatatgaagagttctattctttgatgagtatggatatactatagttggtttattattcaccctttgaaggacatttaagttgtttccaggttttggcaattatgaagagagctgctataaacatttgtatacaggtttttatatgaacatagttttaaaaaagatttttctcttcagtaaaaacctagggctggaatcacaaggtcatatgataggtgtatatttaagtttataagaaactcccaagctatcttttggaatggatgcaacatgggttattggctttaaaaaaaaaataggagacctttaatttgtgatgaaatggtggaaatcctaatattttcttaacttttgtaacaccttgataatcaaatcccatataactgcaggccactagtttccaaaccttagtgcaactcaatccctctgttaacagtgggaaaaatactgaggatcagagatttaaaataattgaagattacacagctgtaaagtgtcagatcttccaactttaaatgttgtgcctttttctattatgtcacactaacttttcttaggaaaaatattacaccacatttcagtgaaatagattacatgcttgtcaaattattttctctttttctttccttttttttttttttttttttttttgataggggcttgttctgtcacccaggctagagtgcaatggcaagatcacagcttactgtagccttgatctccccagctccagcaaccctcccacctctcagcttgctgagtagctgggactacaagaacgtgccaccacgcccaactaattttttatatttttttctagagacagggtttcactatattacccaagcttgtctcaaactcctgggctctagtgatctgcacaccttggcctcccaaagtgctgggattagaggtgtgagccaccaggcctagctattttctctttacaaatgatattatataggaaaacatctctgaattagaaagctttgattcttaccagccctgctaccttaggcaagtcttttatcttttctgaacctcagttttctgatcctaagcaaaaatcatgttacttttatgacttataatatttagattaataagcacatatgataccttgcataatatagactggcttttacaaccaacagtgccgtaaatgttattgaagtgatttcatgtcaattgaccttacttttctctctaagcaatgatggagattaatttgatagactctaagataccacatatggttcataaataggtaaaaatgtctctttataagaatggcaatagcaagcatatgtcagaaaaaaacttcaattctgtatcagaaagatctgtgtgtccctgtcaccacaaccagagacatcatttgaaataggtttctctgaagagtatatgttaatgtatcaagaaaaatatcagttcccttcactaatctttcctttagctttctaattttgcttagtcctaaactagctgtttctaaacccaaaggggttcttatttttaacaataaattgattagcataatccttcttttgtttattcaatcattggaaacctattttgaacatctgttatgagctggggagtgcaagatgatgatggcgcagtgggctgggcacaatgacagggatgtgccctgggtgcttgggagcatctgaggctgctctgtgccctggactggctgctggggagtaggccggatgatttctggaactgtagtggatgtctaggcagtttatatggtgacatatgctttcaaggagtgttacaatcccaaagactcttgtcttgtttttttttttttttttcctccagctttttttcttctaaatgattcataagttaagacttagaggaaatgaatcaatgtagacactctcagtaagagggggtgtgttcaaacaacataaataaagacccatagaccttctgtggtaaaaatggcattcagagtatctaaagtccatattttaacatggattctaaacatttttataattcttattttgtcacttagaaaatgagagactataatgcctgtgtgctcaggacaattggcattcatctgctgaggctcaggcccaccaatatgcctgaaattagtagcatgtaccagccaaattgattttcacagtaataatttgtttatgtaataagtgattctcgtataaatcaaagctcattagtgcatcaacatgaccctagttacatatgatcaactaaatcattgggtttatgtttacacctttgctccaaggttattttttaacagtattttcatgtgcttatagaccgtaaaaaggacgcataataacatactattagctcaagaacaggaatgtcagctagcaaacaacctatttgatttctgattattgatttaatatatatgtatatatattacatctattatatcctgaaaatactgagaattcccaaaacatgtttcctttaaggtaagtgtttaataaccagtggtgtattcatcattacctttctgtatcactcaacattatttatatgtttattagtatataatgtggtatataggcatttacaatgcttaataaccctcagacttttacttttatgtgtatagagtgttgatggatttctaataaagtttgtcatcctctcaacagagagaatgtgtccgttactgacatatattcaggtttgtctgttatgctaataatcctcttttgctcattttggaaagggattgaattggaaattgtcaatagctgtgaaaagaacaatagtgtttgttcccatcaccgtgaacatgaaattggtgctccccgttgttcctgtaaccatggacaccagcttgattctgatgagaaaacatgcataggtaatgtttggtaaatgccatttcattcaaaagttgctctggattcatttagccctttaatctgtagtacttacggctgtactgtgagccacatctctcaaactgtaaagacaaataaattgaagagtgtctctggctactgaataaatgtaaaagaagggttacctgtcagaagacaacattacatttagatatttaccttgaagttaaaggagatttaaaacactttaatgaaatatatgcccttaatagatttatttcaggaaaatattccatgatctatccaactatgtgatgtaatgtgtaattccaacaacaaatgctgtcacatacctcagttctctacctcaagcagaaacgaaattatttgcactggttttcaacttgataatgtttgggatgtatgttcaactttgatatgacaagtagctatattctaaaagacaacttaaaaaaattcattctttggaattcccagctcaaatccatttttaattgctaattttctcaacatattattggagtttatatcatttgagacaatgaagaaactaaaattccaccctagttttgcttcataatgaaacattcctgagaaaaaggagtatctactataaataggaatagcaagtatcaaactacattactatgtgccctggttctgagaacacttccaagtccctaaggcagtgatttgtcatcattcaagaattatgacaccttatttgcttgttttcttttgttatgcttaatatttcctccgttaaaaattacaatacaaaatcttttgaccatttcatactactcaatatggttagatagagacaatttgaagtatgaaaaactcaatggtttaaatatttaggacattttactttggcagtatgatgacacagaatgaaactcaagaaattttgcagtattctggttttataaattcaaaacaatgccattgtatttatttatgcaacattgctttcaatattgttctcagaatctacagtgggtaacatattgaagccagttgctttcctcacctcttattatttaatgaaaaatatgcttacttttatttcctaccttgataagatttgtaaccatagaaaaaattaagggctttcttccttgattgcttcttttttccctccctcttttccttccttctatctctctgtttgttcctcttttgagtattgataagagaaactggaattttgccaaactgtttctttgcgacttaaatttggtgttttctttattttttgaaaaataccattcagtaaagttcttatttacagctagaaaaaaatagcatctgccagggtcaaaatgtagaaaagtgcatatttatgaaatttcagccgtcagtatgacaatgttatattgtttatggttcaagttaatttcatttttccgacaagaaaaagaaaatgcaagccaagcactgagtctcatgcctgtaatcctggcacttttgggggctgaagtgggaggattgcttgagtccaggagtttgggaccagcctgagcaacttcaagagactccatctctataaaatatttaaaaaataaccaggcatggtggtgcactcccagctacttgggagactgaagtgagaggatcgctctagcccaggatattgaggctgcagtgagctatgattgtaccactgcactccagcctggatgacagggcaagaccctgtctcaaaaataagtaaataaataattcaatttcatttcatctaaaacattattttttaggctttttaaaagtttttcagatttttaaaaagtcttctcagataccaccaaagacttcgagcatatcggtctcaagatgccctgttctcaaatagcaaggagcaacattgcattacacaattggaaaacaagtccctcagtctatcatttagtgatccattttggattctttttctattaacattcctctggggctatttctagtttgtcccatgtataccatcctcatttggaactcatctgaaaccccgttcttcctacatcacaagcctttcttaaaatgtcttgccacttcaactgttaaatcacctgttttctaaatttcttttcaaattttattttgttagatctttgcttgctactgtaaataggaatagcaagtattaaactacgttactatgtgtcctgattctgaaaatacttccaagttcctaaagcagtgatttgtcatcattcaggaattatgataccttatttgcttgtttttgttatgcttaatatttcctcaatattctttaatatttccttttcttttgttatgcttaattttcccttttaattgtcctcatctctgatgatcatatttttcctaaattggccaatatgccaaatattttaccattgtacccaaattaatccatacataaaaatttagccttaatcaaaagtagaggaccaattgcagccaggcaaaacactgaaacatttcagctctgatttcagaaaagcatcaaaagtgaaaaacttgatcttctgtatctcttccccatacatagtcactgaataaggttaaataataaatattttctaataactggccaattgttaaatttagtgacttcattgctagtcagacacttgcattttatatacctgtctttcaaattgtgttaacacatctctaggttttagccctaataagtttttgcctttggataggtttaattaactatgtgctaactggctgacttatttttacattttttgtacattcgcatatatattttttcaaagttgatactaatatatgataaaaagaaaatcctttgatttccttcatgcatgactgttttttatgaagcagctgtgacattaatctgttctcagacaaataagtaaaatatgtatatgtacattccaagtgaataattgcctttacactagtgaataattggtctttagaaatgagtagttttttttgttttttgagacagggtctcgccctgtcacccaggctggagtgcaggtggtacaatcacggctcactgcaacctcgaacttctcagctcaagcaatcctcccacctcagtctcccaaagtgctgggattataggcgtgagctattatgcccagccttgaaaatgaatttttttaaaagttttttattctctacatcatactatttaatcagtaggattaataaaaggaaggtttaatactagaaaggaaaaaatatcatttagaattttgtgagtagttctgcttttgacattttgtgggaaaaagaatgttttatgtctaaatgaccttcatttagatattttatggtgacccttcaccttgattgattgtattttctttcctttctttcttttgtcttcattttcttgagttgataccctttccagggttaattgagacattgaccctttttatctgtggctgcttacgtagttatggcatagtaggattttgtaaactcagcactgacaggccatccaccttaacagctcaacaacagaggggcttgaattgaaccaaggcctagagccaaaaaaaaccctgaccaaataattcccaggtgttcggcctaaggaaagcagggcaaagtgtccgttgctacttccttggccaattatgttagaaatgatcgcctcaaaactcaggtgaaataggttatcctttggctgaaaacttacaatttgacatcttctggtgcgtttctattttccccagggcagttatatcttaataagaagcactcaggattgtagaattctgaaataacagtgctaaagaaggcttacagatccttacttagaaaactgctcacctaacaggacatttcagggtaatgatgtcacagatggaataaaaaaccccagacctcactcatcccagtcacagtataatctaaatattcaaacaaatgctctgaaatggtctataatttaaaacataatacttaaaataagtcttctgccctctctcagaactgtagttgccacttgtcttcccagtcaggcagttgggaacacttgcttgcgaacactctttgatctgaagttctggaagaacaaacatgttatggagtctaagactgtctcctctttgcagctgtcaaatgttcaccaaatggaattttttggctcttttttcttaggctgtttttttgttcttcaacttctctgtttattcagtccaattactgtttaaactagaaaaatagcagagatcacttttcctatgcctataaatgcatttggagattatttacattcttttaaaataaataacaggcatagaagaagcatgaagaaacataaaccaaaagtaggtctccttatttttgtgttaaggtttcttcgctgtttgtattacatggcctgagaaatagaaaatgattagtaaaacagttttaatttagaagtgtagcttatcagtgcttctatagggtcgttaaattcctatctctgcaataacagcagtgttctttcccccttcagatcttgacgaatgtgagaatggagaagcctgctgtgcccagctctgcatcaactatttaggaggctacaaatgcagatgtcaggaaggctttcagatcacttccaatggttgtgaatgtgatggtaaattcctgagatttaacaagtaataattgatgtgacagggcaataaaggaagagaaatgtctgaggcagagggctagggtgggcaagggaaggctttcacactaaagagacttgactttctatgtggttctaccatttactatcgtataataaacttggacgactttaactgcaatgaaccttagctgctcatcagtaaagtgatgacaataataggattagtggggaaattaaggaaagtaataaatgtaaagtgcctagtgcaatggctgacatagaaaaataactaaaagtagctattattgttatcatatttattggtccataatcactttcacacaatttaatgtatattaaaggcaaatgagagattctgaaaggcacactgtcaaaggaaccacccatggcaaacttgactggaatgagaaagctggttactggaagacattttgaatgagttttttttgtttgtttgtttgtttttttttttagttagagagcaaaaggaccatcagttcacaagccacagtctaaatctgtaccagaatcccatacatatctgatattaatatagctaatgcaagttttaaaatgagtcatttacaatttcttaacttacatgttaaaattagttcacttacctttcaggtgattttttgcttgtatatatttttttttgatataagagtttgaatttagtgagtagagcttgttgactttgtttatacagttaggaatagctcatataaccattgctgtaatttaaaagtttaccttaaatatttaatctttaaattttcatttagtattattattaccattattttgaaccaaatttttcttaacatcaaagattagaagattgatatctattctaataacaatcaacttatataagactgtaatgcctcagagaaattagtttttctttgcttaaagaaacacatttcagaattctgtcaaagatgatagatagccaagctcccccaaccttgcaatgaagataacagcaatgaacacacaactatgatatctatatatactaaacacggtagcgtatattgccatttaccacattacatccaattaacagagccaaaaacatttttaaaatttcatgtaccatctgctcttaagcagaatgagccaagagatgattgtatggcatgaacatacatacttgcatacacgcatgcaaatggaaaaggcatcaacaatctgaggtaaagcttagaagctcatacatgaacttatagtattgtgaacatattgaccaaagtctggactcagacttggtcataaactagtaagttgcatgcaatcaaggcctaaaattctttcttctctaaaattgtccacaaagcttgtactgacttgtacctagaataagttttctatcatatatattgaataattcgagagtgaatgaacattctacaaaagggtacacagcctgagaccactgaattaattaattatttaattatttatttatttatttttgagaaggagtctcgctctgtcgccctggctggagtgcagtggcgggatctcggctcactgcaagctccgcctcctgggttcacgccattctcctgcctcagcctcccaagtagctgggactacaggcacctgctaccacgcccggctaattttttgtattttttagtagagacggggtttcaccgtgttagccaggatggtctcgatctcctgacctcgtgatctgcccgcctcggcctcccaaagtgctgggattacaggcgtgagccaccacacccggcctgaatttattttaagtttttcatctaaacctcacaaacaaggtctcagaaataccttgtctgtgtagatgaagtagagtaaacttgaaaatgagtgaaataaaaataattggccaagtgtacttgagaaagaatgtgggggctatgcttgctttctatgtggcagtacattgttattgtttaataaaggtcacaagaggaacaccaatatgtctattatttcataagatctatcttatctctcaatgcctaaaagcagatattgtttaaattttcttagatgtggatgagtgtctggatgtcagtatagtctgtgaccaactacattaattctgtgggaacatacgaatgtagttgtgaagaaggctacagaattggaaatgacagaaaaacttacccctgtaagtcactgaagaattttattgtattaatatattttctaaactacttccagcctcatcttgttcttcaggagcaatggaggccacatatttcttaactcaacctgccttcccctttctgtcttcacagactaagatctttccttattttcttttgttctctctgctacagttttaactttgtgctggcagcttctcaccttcatttacaatagacttttgaaatggccatctcaaagcattttacctttctgttaccccctgccttggctgtctagttcaaactctctcatttctctatcaacctttgcacagtacttccttcttttaaccaagttgaaacctcgcattttcttctatggccttagctttagatgatgatgagctagaggaagaagaagaggaatgagaagttgtgaggtttccaggtcttctattcaagagcccacctcaacagcttcattatgttgctacttttctgcctcccacctacaaagatgaagaagatgaggaggaagaggaaaaagatattcatagagaactgactgctttgcacaattttggtgtgtaaaagaatttaccttactatacttacttctatttttagataatttactacatttttgtagacaattttactatcaatatttaatgccatcatatgttttaacatgaagtttgcaagaaaagtagggccaaagtcacttcttcagagcttcctatgaaatccatcatcttttgtcttttttatttccttttgtacaataaaggagtgctgtgtaggtacttgtagaagtgggagtgcagtgtggaggggtgttcttgaagttaatacagggaaatggagcagaaaaatatctttaaattagcataatggggagaaagattgaaatcttataattctattaaaatttcactagaaatcaccttagatagttaaaatttaccttaaatagccctaaaatgtagttcctttctaggttttaaaatgcagagaactaattggttaatatgcttaaatggaccagaaaatcttcaaaatgtgagcagtttttcttatatatctaaacaacagaactcaagcgtcgacttctgatcaaagtaaatctctatcaaaagtaactgtttgcagccagtccactgcttcttttttttcctttgtaaaacagagctgttctttttattctccctctatttattgtattttaacaatatcaaagcttgatgattgctttagaatgtattcagaaaaatagaaatatttttacgcagtggtcaaatcataatatcatcaataagtgtctctatataaaaatagaagtactttaatgtttcttaattaaactcctgatgctttggctaatcaaagtcagaagagaaatagttgggggcggcaacaacaacagtcagaacttgagttgccaagatctgcaaagaagagaagaccagacaaggaggatggtctcagatgcttttctcctcaagccatttgccaattaatgggttgtgccaggaatctgaaagatagctgctaggagcttgaagagtgaagcacatttatcagcagtttcatgatgttggggaggcagaacatggagctcaggcctgccaaaggagagaagccttggtaaatatgccaagttttcaattagggcatcttaaagtccctaccctagaaacagggacaaaagttaaaatggaatgagccttaaacaactgaatacacatctctccacctttattctatatgataatttccctcaaaaacagaatggataaataaatacattgtggtacattaatacaatggaatactgtataaccataaaaaataaactctcgcatacacaatgtgtatgatctcacatacattatattgaatgaaagaagcttgacaccaaagagtacatacttttcaattctacctataaaaagttcaaaaaagggaaaataatctgtggtgatagagatcaccacgatgcttaatttatgaaattaatgattgaaaattattaagtcacttttgagattttggattgctagtaatattatgtaccttgatctgggtggcatttacatgagttatttacaatgtgaaaagaagtttgaagtatacagtttagatttgtgtacacttctctgtgtattaaattttaataaaaagatttactcagaaaacaaaaatacacataaaaaattctgaaagaaaaagcatcaaaatttcaggaacattgaattttttttggtctcaaatcaatgataatttcttttttaaaaaagaaattcctaaagattctaagtattcttagggacaatattctaatgtaataattggaaaaagtaaaataagctttattttaaaagctatatcttgctgttgtcctttttaaagattctttaggaactatgctcaaagatctttttttttttttttttttaggaaattaagggttttattttgatttttggttacgtagtcaattatggacgaactaagatggtatcacattacagtctgtttagatcacatctttggacacaattgcagcttgagctgcaaggactgcatgaatggaggaaagtgccaggaaggaaagagtgaatgctcctgcccagcaggttgccgtgtcattctttgtaatgaaagtaagtgacaccctgagaattgggtaagtgctccaaactactcctttacatatgttctccccaaaatgttttaataaagtaagcaattgataagtatgagaagacaatttatttgttgggcataaataatgcttatgaagtgctttaagttttaaactgaatatgtgatttaaaaaggagattttatgttccctaggaaactcaacatgctgtctcttgtttatccatggaatgtaaaagttaataaaggatcctaatattctaggcctataaaaatccctccatttaaataaatcattaggccctgacaagctattcccaatgaagaaaaaaggaaaggatttgtgctacaaagtgcaatttaaatggacttgcttgactgtttgctacttggttttgtgtacttttttgttctttttctttttaaaaacatgtaaacacagccaatgacactggtttaatttttttattcaagtctctcatgagtaagttcaaagatttaaaaatgatactgcccaaaattcctttcctctatattttaaatgaaggtatgctttcaggagttcaaacttccaagtgataaaatgtattgactatctttgtttcttctttctctttttaaattcattttatgagttctatttatataagtgttttgtcttagtttttgtgattggcttggaagatgatatgaacagattttcttttgaactctctacatatgggaggaacacagctgttgttactcttatatgatatagatgcaaaacttcagtcataacatagtgaaatggtttaaccaagattactagttagggttttgaggatcttcctcatgcatccctctgatcatgtttctctgctgctgaaaagctttgtgcctttcccttcacataaagtgtatacatcttacccagtcactagtggccatcagactctcataaatccttttggctttttgtcctagtcttaacgcttcacctaacctattatttcccgcatactaaaccactcactacttaatgtgctgcatttttcatctttgtgccttttgctaaactgtcatccttgaaggcctatttctgcctattgcatgaagctttatttgatggcctcagtctaacacagctatttatgtttttggtggattaaaaaaaaattctctctctctacattggattattttctatcttctttactagactgagagcttgctggccaggtcctattcatgcttattcattgtgaatttctccacactggaggtatccagtgcatgaatgaacacatgaataaaacttggtgttgaaactcccagctatattgacctgcaacttggcacactcaaatacataaaattgggatcaaataaatattattgcatgaccactagtaagtcaatatttaccttatattgtaagttttattgataaatatgcatctcccaatacttatccctaacatagtaaaaaaactaaaaaatctatctcaaacaaataagaataaaataaataaaaatttaaaaataaaaaataaaaatataaaaaatattttacacactagtaaatttaaaaactaaaaaataaaataatgaaaaaatctgtctctaacacgtaagaataaaatatctctgacataaaattaataccaaaatattgaaaatgagcttgctgataaaatagaaatgagatggcatcttctttggctttagaaaaccttggggatctctcaaatatttatatgttgcaataaaggggagtctacccctgaaagcagaacttctatcttctttgtactttctctatatccttctcttatttcttttacaacaatgaaaacagaacaatctatttaggagaaacaaaaaacaattgttcatatttttttaacaaaaagaaggagtgggaatattttctttaaaatccctattggccaggggtgctggctcatgcctgtaatctcaacactctgagaggctgaggcaggaagatcgcttgaggccaggagtttgagaccagcctgggcaacatagcaagtcctagtctctacaaaaataataataataagaagaagaataagaataaatccctttaaactacaataagcagagaccagttattcattggctatatttttaagattgccagcttttcaaatgcagcaaaataaatgaaaaaagaactttcaacagggatctagaagtcagttttcccgttgagtagatcttctagcccaatacatttattagtctataatgaaaatatctactttgatttcttagaggtttcttcaaataaatatattgaaacaattttaaaatgaccacatattatttaattttaaaagcacacttttagaaccccatttcttatgaaaggtttcatatcgagatcatttgttattgtgagactgtatctggtggaaaggaaagataggagtatttttcatatgtcaaatgagtagactaaaacatgggaggagagatttatgactttttttttacatcatccagctatggtttgggacgtgtttgttttacatttttcttccccagaatctctacactgtttgatctaatgaagtatttggcaaatctatagactatatgataatcacagtttactttgtgagggagtgtcaaattatagtgtcggtttgtctatattgatgactcgccataatccagacgctgtgcaagccatttaaacttccttagcttcattttacaggttaagtgtttaaaaattgccccttctgtagttgctgttaaaatgcaaacattaacaaaatgtaaattaataatataggccacaacaaatgcttgttgccagtctctcattttttgtttatcctttccttttttccctttcatagtaacctatggcttgaaagcaaagaaaagggtgaataagaagccaagttccatattagcatctggaatgggagcaggggatgaatggagcagattttataaatgtaattttataacatttagcctattatgataaaatgtcaattacagttattactgaaattatctcaacagctacatttgcttacattacaatataaagtcaccgacatttttcccaatttattgttttatagagcactaaacacaaaaataccaacaacctaatgaaaactgttgtttgcctgactttgtcttatctttggcaatgcaaactaccttgggacccccatgagaaccttagctgcattcattcctggttaaaaatacatgacattttaaaagcatttttccctcagttttcaaaatagaagatgcagtttgtttctcgttagggttggaattgtacagcaaagttgtctgggtagcttttaaagtgtgagggttagagtttaagaaatgagataaattttgcatttgaaacttgttagcaatttcttcagtcatcattattttaactagctgtatcagtaatcccctcgggagtgattatgctatacaaactaggaacatgccagaaaattttcctgggtctgtaagccactgagtttttaattacttggtatctatcctgatagaaagagaagctattttttccctccatttgtatcagaacacgtatgttccattgcttgttcatcttctctagtttcttcatagcttattccccagagaccagtgagaaagaatgtggcagcatcggtaattgtcagaatggaggcatctgtgatcttctgactgggcactgccagagccccccaggggttcatgggaaaacttgtgaagatagaaggaatgtctggtgcc

SEQ ID NO: 1284 - DNA, 2374 bp, Homo sapiens
aacctgaatatccttggatctgtaagactttttctgatccatatcacagcctttttctctcctcaccgttgccagtgggatttctcgtgggcttttggagaggtagaaggcatacttgtgaatgtcaaaagagctgtattcctgtatcctgtttcaaccctgaggagaggcactgtgctagtgaggaaagaacacccaatcctagtcaaaggactgagttcaattcagcctcacaagaggctctaagtatgatcttagacaaggaaacttcaggccccagttttcccatctagaaaatgagagtggttagaactatatcacactgaggattatgtgaatttatatatacgtatataaagccgtgcacccaaatgctgtttacagcattctgtgatgaattccctatttcagttggtaccatttattcacagacaatcacaggtattcagagattgtaagaattatggtagcaattgcttactatagtttgtttattccataagagtggctttcatttttttttaaaaaagagacctctcccttggattttcgttataatatgtttcacttgccacattttctgaatttttccatgtcttgaagcctttgtgatggtgtttcataatcaacctgcaggttgtcagaatcagtggagcatgccatttactgcttgtcttagatacactcaatgattctttctttcctgagtgcttcaagttttggctttaaagatcctcctttgttttaatagattttccattagtgtctgcttatgtaattttatctccatttctaattgtgaaatttgttgcatagatgtaaattttctttcagtattattcagagagaagataatggttgatacccaaaagaggaagctaaaaatgccttttaaaattcttactatattttggtgatttttaccaatgacattattgtatagttgtggtcattataccgttcattaaaaatatttatttgaaattactgcatgaatgccaatctctgaataacatctttgcaaatatagcatgttattttgtcagtccaaatgtgtgctaaatactaattcatgttgttaaatgtggatataaaaatagttaattctcttgctaaggatactcatttatcaaagtaaagtaacattttaatatttttcaagacaactatttttaaatatttattagagaaactgttctaggagaaaaattaagataaggtattatgtattttactctgttatggacacatacatatttggatatcagatagtttcatatcaaattacatatctttgtactcaataaatattagaaaaactgtttactcatctgtaaaatataaataatagcatcttctcattgagttactttgaaaataaataaaaataatacctatgtacaggacttaacctagtgtctaccataatgtaagcacataatgaatacttgatactgtgattgagtacatgctatgactataacccagaataagacaataggaacataaaaatagaaatgatcatcattttagataggggaaaacagaagggaaatacagagaaatgacatcattgtgtttgagaccatatggtatcagaattggaatagaaggaaactggagttgggggagggaactggaagagtgttgggggtttgggaatgaagaggtgatactaagttgtgtttgggaatatattggatttaaagtgatagaaagtaattgtagtgaagatggactgtagtcatctcatgaattggaccagaactttaacattgttcatttagttttccaagagatatttactgtgggccgatactatgtgctagatactgtgcattggtacagtaaccaaggtacagtaaaccaaggatggaaatacataaatttgtgagtcggttttctgagtgaaagttagaaataaggaacaatgtactaggcatgaagtgttggttagtgattacaaataggagaggagaaaagaaaagtccccaatgacacaagactagaggctgaagacatatcaagagagtgctgcacgaggggagaagacaactttaagacattgtgatttccagaagaatcacttttatataaattgaatgctttctagagcttaagatcattcttatatgtttcagtaacagaaaatgaagataaagatagattattcttggctttttacctatttacacatgaaaatgattacatacatctacttattctagtgtgatattattttcattaaaataaaggtattgaaggaattgttcaatgaacaaagaaaactgtacttttgactaaattgtaattaagtatgcttgaacatttttaaatgcttagttctgtaattttctgcacaacatgtagtaaa

SEQ ID NO: 1285 - DNA, 2514 bp, Homo sapiens
gccagccactatattttcatggaaagaaaacatattgagactcccacaaagtaaacttctttggatgccatgagtgtaaaatcttgatttgagcttcatttcatagccatggtggcaaatcaaattgttaaatatatttgtgagtctataattatggagaaagtcattgtctcataatatattccaaaaatgtttaaatatttgtttgtcctcttcttttttcagtgtctcatagtctttctcttttaccatgcccatttatttcttgacatcaccattcatgaaccttcccaacatggttttaagttcaagcttcttgttttttctgctttggtaggatcttgctataccattctcttgcccttcgaagcacaataaagccaataatagagacatcttcttgtatcagcattttggaatcaatattttcataggtcttttacagttaaatcagctcttggataaagtggaactttaagaaagtctggactttaaaatgactatattctggtaatcacaaagtcataaaacagagcatttcagtgacgatgggtcatgttttttcagtcttaatttagaatttttttcaactgactttgagttgctgttacaattcaacctgcctctggtgttttatatgccttaaaatttgtggctactgtataataaccaggaaagcgtagctacagggttccaattactttggcaaaggagccttattacattgtctccaactaagcacataattaatgtctctatttcaaggctatttcagcaaattcaaaacccagaatctatccatacatatttagggatgcatgggaacacttgtgatgtcttcattgcagcagacagtaataccagaggaatttttggaagaatatggaatactttatcatgggttgcaaatattttaaagatgtggtttgaaattaaacatgttgttctaaaaagtctccatgggaatagaatgtaatagaattacccacctcctgggagagtttttttatgggtgagacattttcagattgttacaacgtctgagcaggcattatatggcaagagagcacataggagatacatatctgtctacagtgcgtagggcatttgcaccttgagtatcctgctggacagttatgtaggtaaaaagcctgtttgtaatcatctgaacttaagcttatctccattttgcaaataaacacaaagtatttttgcacaatcttaatactcactgaattttgcagaaatgcagctaccatatacatgaagagaatattgtggttagttttgttcggaactttaccaagaattggtcaccatttcaaaaaaaaatcacaccattgatggcagcacagcttgtggcatttgagttgccaataaaacatgcccatattattatacatttgcagcagttgcagttgcgaggattctgcatttaggtgccaccatccaacaatttaattatattttgtaatcaagcagatcatgcccaaacatttacctatagaaatacatttttgtcatgaattcctcttcttatttttccccttatattatgggggagttggcattttgtatttaggcaaattattttattcattaatttcttttcagaatactagagggacatttaattatattatcaaaggagagttaggtgagataagatcaagaacaattctgaaatatatcactcctccaagaaaaagggggatgtggtgcctgcgcacacatgtgcccttcaatgcgaagaaagaagcaggaaacggagatgggagaattggccttgatttcagctcttattgagtgtcaggccctgtgcccagcctttcaaatgcatgatctcattttttgtgcatagtgctgagaaatgccatgtgtgctttgaatcctgtagccccagagtgccacactgggagctgactgcttgacattcggagatcagagaatgagaggaaatgagtatatgaatattcttgacattgctggagtgttagaattatttaaaagttctgttaaataagtgacagtctcagagcctgatgtatggtagttaatgaaattttcacaaagaagtattatcataaaattcgaagaaaatcatagtagctgcgcacacaaattcacatgcatatgaatgtcagtgcacgttggtgcattcatgcttcctatttatagctttcgggacacatccgaaagtgataaatgaacattgaaatgctacacatatgtttatatccacttttagctatggggttgtctcaaaatgtggtatctccactgagccaaatcccaggcatttagaaagtacgaaaaatttaaaactttaaagtgaaccaaagaggagagagaaaaaaaaaaaaatcctaaaactgagagatatggcaatcataaacctggcaccaaattactttttaaagtacagtatgaaaaatgaaatgtgtcagaattggttactaatacttctttgttggctaattgtcatttttcaagtgttggctaattgtcattttt

SEQ ID NO: 1286 - DNA, 12559 bp, Homo sapiens
ccaacaattttttttaataacagtaaaaacaagaaattcgaagccctggagagggcctataagaaaagcaagaagtcaggcacagtggctcacacctgtaaccccagcactttgtgagggcaatgcaggaagatcacatgaaatcagtagttagaccagcctgggcaacaaagtgagactgtcactacaaaaatttttgtctaaattaacctggcatagtggcatgtgctggtagtcctagatacttgggaggctgaagcaggaggattgcgtgagcccagatgttcaaggctgcagtgagctatgatctggccactgtacaccagtgtgggcgacagcgcaatatgttgtgacacatgcaccaaaaaaaagagaagcaagaaagaacgtaggaagaaatcaatcttgttcacccagaaattctccaaagaactcagattttttactctgtgtttttaaatattgagaaaatggaaggcatgtaactaacagcatatttttaacagtttaaaaaaccacagtcatcaagagtaatttcagatgagctgaaaaccagataaaccacaacattcccctgtccccaaaaaggacttttttaaattacaggaatagaaaagaaataatcctacttgttggtggtcagtattgttacagtaacaccaagagatcagagctatgaaaatcctaacctcttcctaattttccatcaaaaagcctgattttccaccacagaatgcaaatgaaaaccacaatgatatttcatctcacactagtcagaatggctagtattgaaaagtcaaaaacaacagatgctggtgaggctgtggagaaaacggacaacttatatcctgttagtgggaaggtaaattagttcaactactttggaaagcagtttagagatttcttaaagaacttaaagcagaaaactaccatttgacccagcaataccattactggctatatacccaaaggaaaatagatcattacaccaaaaagacatatgtactcctgtgttcattgctgcactattcacaacagcaaaaatatggagtcaactagctgcccatcaatggtggatcggataaagaaaatgtggaggctaggtatggtggctcatgcctgtaatcccagcactttgggaggccaaggcaggtgaatcatgaggtcaggagttcgagaccagcctggccaacatggtgaaagcccgtctctactaaaaatacaaaaaattagccgggccttgtggtgggcacctgtaatcctagctactcgggaggctgagacaggagaatcgcttgaacccagcaggcagaagttgcagtgagccgagatcgcaccattgcactccagcctgggtgacagtgtgagactccatctcaaaagaaagaaagaaaatgtggaacatatacaccacggaatactacacagtcataaaaaagaatgaaattggggtcacagtggagcaggctctcatgtggaggtggggaagtttggtccatcagaatgatcaccaagaaacacaaagcagacctgggccctgggctcccagagaagaaaaagaagaagaaagtggtcaaagaaccagagactcaatactcaattttaaacaatgatgattactttgccaatgtttctcctataagagccacatccccctctaagagtgtggtccatgggaaggcacctgagatgcctctagtgaagaaaacaagtaaaagaagggtgtcagcaccctttgtgaggagcacgtagaacctgacaccacgctgcgtgccagacggtcagagaagtcacccaatcccaggaagcaggtgcttggccatttggagttcctctgtggggagaagaaaaagaagaagtcacctccagccatgtcccatgcctctggggtgaaaacctccccagaccccagacagggtgaagaggaaaccagagttggcaagaagctcaaataacacaagaaggaaacaaagggggcccaggaccccacagccctctcagtccagaacccttggttctgcgaggctggggatgctgcggacacttgctcagtggggaagaagggtgaggaacaggcagccttggggcagataacggaagcagaagagccccagggagcacagtgggaaggtgaagaagaagaaaacaaaaatccaccaggagggagatgccctcccaggccactccaagcccttcaggtccatggagagcagccctaggaaaggaagtaaaacgaagccaaagttgaggctccggaatacatccatccccaaaggagatggccctaaggcccccgagaagaaaaagatgaagtccaagaaggtagagcagccaatcattgaggagccggctctgaaaaggaagaaaaagaacaagaggaaagagagtggggcagcaagagacccttggaaggaggaaacagagacggacttagaggtggtgttggaaaagaaaggcaacatggacgaggcgcacatagaccaggtgaggcgaaaggccttgcaaggagagatcgatcgagagtcaggcaaaacggaagcttgtgaaaccaggaagtggacgggaacctagtttggccagtgggatactgctggttttgacaacgaggaacagaaactgaagtttctcaaacttactggtggcttcaaaaacctgtccccttcgttcagccgccaccccctccaagccccgcagcacgattgcaaggtccaacatagccctcagcaagaaggcggccgacagcctgcagcagaacctgcagcagaacctgcagcaggactgtgaccgggccatgagctggaagtacagccgcggagcccgtctctgcttctccaccgcccccaacaagatcttttatattcataggaacgcttccaagttagccaagctggaagattaaactctagagttttgtcccctcaaaactgccacaattgctttgattatcccatttatgctggagattacaagttttttttggtgaaaaatcagatcttggtgatgaccttgagcagtaggatataaataactcccataaacttagcgttccaataatggaacactaggcataagtgggttattcagttgtgctgatgaaagccatctgacagttggctcacattgaacacctgtggagactaaggacaaggacaaggacaactatcttgatgggcttggatgaactggggagaggcagctcatgtttggggagccaggagaacaagtgagtggctaaaacctcctgttttctgtgttaaacattccgtccctgtttgagacatcaatgtgtacagatgacctttgttgagtgtttagcaggtgctaggcacatactagtgttttccttaatgtatttaatcttcataattatgaaatgggtgctattattatccgcatcttatagatgaggcaaaggaagttcagggataaagtaataaaatgccctgggatcacccaaccactaaaaacaaacaaacaaaagaatgaaatcatgtcctttgtcccaacatggatgaaactggaggccaaagtcctaagcaaattagtacaggaacaaaaaaacaaataccagatgttcttacttataagtggatgctaaatgttgagtacccacggtcgtaaacatgggaacaatagacactgcagactactagaggggaggggaaggagaagggcgtaggtcaaaaaactacctactgggtactgtgatgactaccagagtgtaatacccatgtaacaaatctgtacatgtaccccctctatctaaaataaaacttggggaaaaaaagcatgattttcttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcgttgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcatttgggtatatacccagtaatgggatggctgggtcaaatggtatttctagtcctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatgatagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgtggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtgtggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgactttctcttttcctaattgaataccctttatttccttcttctgcctgattgccctggccagaacttccaacactatgttgaataggagcggtgagagagggcatccctgtcttgtgccagttttcaaagggaatgcttccagtttttgcccattcagtatgatattggcggtgggtttgtcatagatagctcttattattttgagatacgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgatcatggtggataagctttttgatgtgctgctggattcggtttgccagtattttattgaggatttttgcatccatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcaaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgagtttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctggagatgtctattaggtctgcttggtgcagagctgagttcaattcctgggtatctttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacatgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcatcagttgatgcagtttcttcctagtctcgatggtctttacattttggcatgattttgcagcggctggtaccggttgttcctttccatgtttagcgcttccttcaagagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggttgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttgattccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggttcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagctgcccggctgctttgtttacctaagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgctttggctcgcgcacggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcctcccatgattttctttttttaaactaaaagggatttttaaaaatatgattaagaaacagtgaaaatatgagatgggaaaattgttggctattaataagttcatatttttgcatctagctttgtatcataaggtatcaaagtatttgaagatgaaactgaagaactttcattaatagtttctcataatattttagcttttatttatgtacaggagtatgataaattttaaaaaatcttgaaaaaatgtgatgaatgccaaatgaccagagagagaaaaaatatcctgagtgccaaaaaggagtaaaataggaggccctgggctttgtatattgataagctcaataacaattcctagaaatattctagatagaatattaagcaaatgatttataataaatttgagggccaggcacagtggctcatgcctgtaatcccagcactttgggaagccaaggcgagtggatcacttcaggtcaggagttcaagaccagcctgaccaacatggtgaagccccatctctactaaaaatgcaaaattagccaggcatggtggtgcacgcctggagtcccagttacttgggaggctgaggcaggagaatcgcttgaacccaggaggtggactttgcagtgagctgagattgcgccattgcactccagcctaggcaacaagagcgaaactctgtctcaaaaaaaaaaaaaaaaagggaaagaacaactatcattcctagaaaataacataagttcatcaagagtaaaaaaattacattaaataatgcttatttcttattttgataggttaaccagattgctacatcaggggaatagagtagataaaatgtcttgatttcagcaaagcactgataagtgctttataatatctttgagggaaacaaagagaaattcaggtaagatgatagtcgtgggagaagaggtacctgataggggtgctccaaagtcaagatatggtgtttgtaaagaaattcggaagataagggtaaaacattaggaggttcttgtttagggagtgggtagttcatgctaggaataaatgaatcaagattaccatagtaatatgtaaatgtaacaaatataaagactttccagaaatccaagtgagcaaaatctattcattttcatttaagttcaatttgaatcaatggcgtcatttagttcttttaaaaaaaatgcaactttagattgaatactcccatttcaaagaaagagtagtaatagacaaaaacacatctttacggcttttgttacttggtcaaatatatcctgaataccttgtaacgtgcagaaaacatctgtggctgcttacataatatatgcggtacaagtggataaaaataagcaaaagtttgtcttcccatttaactgaaagccctgatgaggacacagactatgcctgagttcccagttcctggtacaatgtctgtaaatatttgtgattgatataatacagtgaaagtaagataatgatagaacagtgcaaagaaattgggaatgaagttaatccataaaaatgtataccagaaggatctgggacactattactatttgtaatgtgggtcccaaattcacctttgagcctcttggcatccaaggcaaggaaacaaatatgttaaaagatcacagtctccgaaacctaaaacttcatcccttttgccagaagcaacgtgttaatagatttttcttgcaataaaatcctgagagaaatttctcacaggatgcctcattgagcaaatacaatgtgaaatagggagaaattcttaaaatacggtaagctggttaaatgctttttactcctagttaaagtaattcctttagggaccaaagaagtagggtccaagtacacagattgccagtggtcagctttgctccaggccctgtggtgtggtaggaaaagtacaacaaattaagtgattgcatatacttgagacagtcttttttgaaaccaaacttttgctgtagctgggcagtatccagtttgaatctgtattccccagcaagaatggacaatgcagatatttactgttggtgattaaatgccaattcttttgcttacactgaagaatgagaatgagtctcagtcccactttgagggatgtaacaacaaactgggcaaacgtaaagaacagtgacaaggagaatgacacgtcaggacataatttcatatacaaagtaggcagcaaactgggctcggtatattgaatctgaagaccaacagggaagtcatgataaaaccaacctcaaacatctgaagaactctcttagggaggaaggagcacacgtcttctgtggtccagatcctgaccaaggagtaaaggtcccagacaaggagagcgaactcaggagaaaatcaatttccaacggtagagctgtctgtaacagggctatgccgccgtaaaatgatgggagggtcctggatgctggaggggtttagagagacactgcacaactgtctatcagtgatgtttcaaaaataatccctgtcctcaaagggagactgaatcagaaatccttctggccacacgaatttcctgatcctgaggtgagaaggcatgctccatgtctgtctacgcggagtccactgactgctctgagggaaacctcttgaactgtttatgggttctgttgccatctcctagcttttttacattagccatagtcctttaaagaaatactctaagcaagcagaaaccacagtttcccataccctccaatt

SEQ ID NO: 1287 - DNA, 8300 bp, Homo sapiens
tggattacaagagtttaacacattttctaagacaccaagtgagtaatgtagatactgaggagatattcagtagaaaaagccaaatcactaataatagcatattttcaatatacaggcaatttctcagttgaaaagcttagctattattgctatggccatggcttcaaagctgtgaggttcgctttttatttatattggcaattttcccatgtgcttataaaaatcagtcctttggatggttcactcagtgtatttgaataccttttccaattctctgaagctccttgatccagtaacagtttctttccttggcagaccatgaggagtgggaaagtagctttttctaagtaggcattgattggcattgagcagtgggaaagattggagctggtgaacatggggtgtgcaaatgtattcagccaacaggagctcttccagttcatagggtggatctgctggaatagttgccttggttctcctttcacttcagggtggaattaagctcctggctcaatagggaggaagcaggataagtcttagcctctggacacttaacctaaaattctaaagaaaaattccttattccttttttccttttcaatggcttacctttaaacagcattaatatcctgcctgttgtactgaagcaagaaactgtagtatctattttcaaaactagtacatggattttcaatgtgagtgtcttggtaataaatgctggtttattttgaatttaaaaatgtattttgattttgtactgacagtttaactctttgaaatataacggaggaagggtcagaaataaagcaatctttctttcttctggacttatttattcactcttctttaaacagttgttaaatctctcttatgcatttgacattgggctttgcactagtgatagaaaaatgaataagactgtgacatcttttggtactacatcatataaattgtctagattgtacttctaagccagcatgagcattttagaatataagaaatagaaaccaaaccaagaaactctagttcggagcaaaattatatgcccagttgtctaagaaagggctttgctttttaccagtaatttagaattttatgactaagacaaagcagaaaattgggaagaacagtgaaaagggcaagaagttaatggagtgcggtcagagctgagaggacaaaatctaaatgaaagggggaaaagcaataaggattgaggaaggttgtttaggtcattaagcttacaagatcttctatttcccaattagtacattctgaccctgaagacgtttaagtacatgacgaggatgtcactggagtgtgacaaattcttcacattctcacttccctttgctaattctggcgtcagaagttattgcagagaacatagtcaaccgtctgtggagatacatctaaaacagatgtgcctattgttaaacaaacatggtatgtttaaatccatatttatttattaaacaaaaattagataattactccgattatctggtacccacagggatcatacaaatgacaaacacaaagggccagcactctgagaatgagaagcctagagagaggccaggctgggatagtgccaaccctgacataagatagaatataattaggactttaaaggaaatacaaacaaatattgtgggcactcaggaagaaaagcacttttggtggttgtggatacaggtagagggagaaagcacaaacaactcagagaaactttcttgaaggagatagtatgctaactggccatggaaaattgtttgaatatcaacaagtgatgggatctcaacagggataaaggatacaggtgtcataggtaaggtagtggcataagcaaagccatgaaggaggacagcttgtttgatgactagcagtgtgtgttataggagatggggtggaggatgcagagaaacaatgtattttgagaccacacaactatgcctttaaatcccagcccttccgcttatgcatacgggaccatgcctaggttgcttaacctttctaaatctcagattactcatctttaatatggggacaataatattgatttttgcatttgtgtgtgtgtgtgtgtgtgtgtgtgtgtgtgtgtgtctgggagagagagaaaggagagagagaggagagaaagactggttataatctatgtaaaccttctggtgctcaataaatggtagtaattattatggcaagtagttaggctatctcaattttggacaatgtgttagataaaataaaaaaaataatttgtgatcaaattttgggtgatcttaaggagctagtttaggaatatggagttactttgataggcattggaaagccattgaagacttttgaccagggaatgatgtgattagggcttagaattgcagtgctgattctagatatattgtagagctacgacataaaggattagacaattagatatgaaccatggtgtcagacacctacatatctgttctttactctcttgcagttataaaaaccctgatttttagctggaaacatgactgtctaaaatgaagaccctatttacctgttttgcttgtggctaagtgtgcctatgtgacgatgttctggccagaagtatcatgcagtagcatacctaaaagatggctggcccaccttcttctttatcacttcctccatcctgcttcttagattacctgccatcttggtctaggtccagctgctaatttggaccctagcaatattggagggatgaactggcaggagactgagtcccaaagaacttcatggaacagaattctgccataccatcccttgactaaatttcactagccttctacatgagaaaagaatgaactaccttgttgaagcctctgagattttgagattctgttacatgcagttgatcttacaatctgattctaaccaattcagatatggaggaaataaatgaataagaacttagtttctaggatttcaagccagtagccattataggaatataaggaaacatgtttggagcagggggaggatgatggttttggtttgggattcaatccaggtggagatgtcaggtaattggaaacaaatgtcaggagcttggaagagaggccagagttggaggtttagacttggggtgggaagcaggactttaaatagctctgatagttgaatgtatgataggggaagacattttcaagggataaaagtataaaaagagtgcaaaaacctgaaggctgaccctggactaagtgtctgcttatacaggtgaggaggcaatagagatagtgaaattgggcaggaagaggtgtggtgaaggtgagggtaaagggaagaagagttgaggctgaattaatgagcttatttcttttgcatatggcatgtaggagaggaaaaggattcctaggtttctcatagtcaagaatgtactgattatatgcatttgcttcattaatgaatacagtgctattttgtttagtgtttcaggaaatgctttgattccagcattgttttccgcttttaatgcttggaaacagctttgctaggctcttctcaggtgagtagctgcacgccaaagtgtctcagtgacagcattgctaaggagttttatggagaatggatggtcttgactggaaagtcacttaatggcttttaaagttgtgagcagatgatcatactgtataagtgacagactgtgaagtctgagacctcatgaatggttttgatgttggcatcagataaaattactaacaaattagatctgacatattttaatggtatgtataattattattggtctttgtgattataggctacatagtaactgctatcactggtaatagccagtattacttttgtctggacacacaccagacatttacggaaatagctggaagaagaatgatattgagaattgagggagagggtggtttgtgccaaaaggaaggtttggaagaggtggacactattcctctctcacttcctaactggcttattctggagttggaggcctgcagtgcctcaccctgtcaagctgacctaggcacctagtatgtttagctgttccagtccccactctccagatttggccacattctcccagttggaaatgatggaagatattgccatctggagttctctgatttcctgtaagttcttggagactttatgcatggccccacccaaagcttttccttcaccccaacaggagagaaggaggctgcagaccacagaaacttcagagatgatgatttatgtggactcatcagaagtctaaaggggcatgtctgtgttcttaaagggtacgggaacctcagagagccaattggcccaagaagcagtatgtagaatggctacatattctatattttcaaagatcaaacagtgcagagtgcaagattataggaaacccaaaagggtcacaaaccaggataagaaaatatcccattcactgccatattttccaaacctaaaagagtgcctcaatcaatgtttgttgagttttaaataaatatctttatttcagtaatatttaaaaatgtatcctaaatctacttgttgtctgtattttcaaacatagggaaataagcaccaatagctaattggaggaataggatgggggatggggcacagcatgaggagaggagtgagagtatgtctctcccagaaaacatttattgtaggtattgattcaaattccagttcctttcattcctagctgtgtgatactggacaagttacttaaatttgagccagagtgtctccactgttaaactaagtaacaatatctactttataagattattgtgtaaagtaggtaaaatttatgagaacatgcttaataaattctaagtgacaaaatgttaggtgttattactgacatttataacaataataataataataaaataataaagattggaacatggccagggagtggtgaggggtcatagcattggtgtgaaagttggatttgaatgtcagtttctctggctcatatggtaactctgcctatccaggatttaacttagaatcaacagctccccaaacaacagcagagctctatccagtttgaacacttgaactagttcttttactcagtgagaacctgtgagtctgtctggagtagagaggcgggtgttgagattaaaccaccacagtgggctgtctctgtcttagggaagaataacagagaaggagtttctgcacaccagtctgacttagagctgagcagcacatagacgtgtacccaggtatctcatgccttatgcccagcgggacccttcctggtgtgtatggtcgatatgctaccctgtggagggtggctatttattgaattcctattccactcaacttcagtttatctgactttggaggggttgcaacacggccttgcctcttatgctgagctttctttggaattgctatgtgactgtttctttgacagacttagttagaaattcagatgatactgatttaaaatagacccgtggggtttgagaacagttagagagagcacagatgagaaggagaggttaaattttttctaaactcaagttgtcagtactaaattcattatcccccattaacaggcataataatgaaaataataatgtataactttttcactccattcactcatttattcatgaaatatttattaagtgcctatgtactagagtgtatactaaatgctagacatatatagataaatagataaaccatgcctgtcttagggagtaaggtggaaagcctgagggtggcatgtaggttagtctggcatataatctcaacaagcttttggaaagatgaaatggttgtacttagaggcagaaattgcattggttttggtcacagatgtagcctacctccattgcctgccacagaacctggctcagctaagtacccaatagatgttttttgaattggcttaatatttctaattgcatgattaagtggccagaatcagttaatttaacccatgagtccttttcactccttttacagagctagaaactttttgtggccagtcaacctggtaaccaaacatttaaattctggtaattggtaaatatgcctcgtcacaggtttgttgaatgatttatttttcataaaagcaggaggttcatgacaagctcagcaaatctgttggcagttttaagacattataccgggtagtttagggaaatttctcagcacatgagaccctttagattatgtaatattcttgcaaggcaactaggaaaaatagtttttaaaattatgtctattttgctatatttaaaagcagaaattatcttattacggagaattgattaaatatttgatagcatttttgtatgatttaacatatttataggtgttaatttctcacaaaatttaagttatagctctaagtgtagaattaatagtttccctttgattacagtttttttggtgttaacgttcatctatttttggatgatttgacttacccttcctttttaaaattcagactctaaatttaaggctatacatcaccatagtgtttatgaagtgaattaaatcttacagaatgttccagtgcaatctgaaactacagcaactacttgaggttttatgtctgaaaagtgttttaatcagtgatggatttggaattattgcagctgattcctgaattcttaggcctaggccttaggaacacactatccagatgtttataaaatgccattttaccaatgtcctgtttatactttgactttgtggttcaaaaaaaatacatttgcctacttcaaagtaccagatgaaagtattttacatcaactaaatactgcatttgagctgcccaacagtccctaacactgactccttctgccttaaaggcatttatttcctatcatcacctgttttctccaagacatgtgagaagaataaagcctgtattgtggcattttgtgtgaatgctaagatcttggcaatgtttcttataccttccctagctcttctattttccctaaaaagtattctctttttgaaagaaaaatttaatttctcaatttcttaaaccagattattaattaaaactgcaaaatgaaggaaggaacacccactaattcttcaaagctcagcaacagaatcaaatcctttgaagatctgtctgcttaactcatcactattaatcagtttaagactatttagaaaaggtactgagagaaagaaatgaataaaaatgggtgaataaggcaatattaagctgacactttatagtccggttggtagagtaaaaaagcaatcaaacttaacagctttttaaaaaattaagaatgttatataggttgatgttatttttattattataaatataatatttactccttttgccaacttggaaaatgtagaaaagtcaagaaaaacataacattcatccatgatcccaccacccagacaaaaccacttttacctttcccctattttttaagtcattttttgctatgtaattaatcaatttgcataaatacaaaattgaggtaacggtatatgcacaattttgaaacatgttttaatcactttcttgtggcattaaatattcttcaaaatatgtttttagtggctgcagagttatgttatgactttctcatcctttagttggtctttagtgtgtttttatggtgtccagtttcagtattcatgttgatctcctttcaccctttgtcttcactgagtcactcttggctcactatggtaatcattagcactggtttctagatatttctggctcttcacctgcacataaaacagggctgtacatctcagtcccttggagtttgggtgaggacatgtgactttttctaaccaatgagatgtgagtagagcatttaattactgatgagagagacctttcagagtgctgtcctctttgccacagtgactggcagctttccagagagtggctgctccattagcgtggatcccagagtgaggttgaggccaacataaacacctaattggcctgggatggataggtaatgtgagaagaaaatgaaactttgttttagtgagtgaaatcttaggggctgtttgttatcagtgaataagtttgcctgtcttaactgataacaccaatcatttgtatctagattgggaatctgatttagaccttgtggtcatcttatagactcatgttcaccttcacatctgtaaattatgtggcaggtcatcatatacactttctcaaacaattggggaatctttgcccctatgcatctgttttcagggtgtttctttagttgacttcaggcgtattcaataactcatatcatatacatacataaacactcata

SEQ ID NO: 1288 - DNA, 16382 bp, Homo sapiens
ggggtctttagaggtttcaagactagtgaaataatgattgcaccatattcttttggatgattaagcttcccaggagggaagtcctaaaatggctagcttacttcccataatacctccatcaccccttggaataacatattcagcaagctgtggccattcaccatgatttcacggtcatgagacttaaattatggagctggtctgttgctttgtgaaactgggtgattgccagaaacctttatttaagaactactactcataagactaataaattcccaaatgatttaatgcacagtaatttgtcaggattcactggcatttttttttttttttctggcataatgaagacatctggaaacccaagctacaacttaggagtaccagtagaattgtccagcaagggacttcagaatctgttgctagcctctaagactgattataatgtttcactgattttatagccaatccatatttcactggactcttaacttgtataattctattctttcaacatttataaatacataataacattggactttacatagcactttagaatctttcccatgttactttatttgctctgacaacaattcagtggctcatgcagaagggtcattattagccctattttattgatagggaaataaaagttcagacaattagacatattaacatgtttaagttttgcatcctaagaaataaaaacgaaaataaaatgagataaactatgtttgtctacttctagcttattgtttttagaaccaaatttctttgatgagtattctatattcctacctctaattcctcacctttcatttgctcttcagactattatagcctggcttttgccaatactgaaacaggacttgttaaggtcgcaaataactgcctacgtgtcaaatttaatggacatttttcaggccatcatcttacttcacttttatgaagcacttgcctccatcaactgcattttcagtgtttcttctctttggcttccatgacttctttctcatgttttctctctctttcttgcttgctgtcactctcactctcttctctattccttccctatatctctggcttctcactgtgactgtttgacctgtgtatcctcatcatgctcctatgaatgcggttcatacttgtgaagatgtgacttgaaccacaatctacattgtggccatttccaaacccctctctcccatccataccactgccgccagctctaggcctatatattcacctgcctgtggattcttctctgggatgttccatagctatttcagtttcaatttttttcaaaattgacctcatccttcatcttctaagtcacatggtcctttattgcttttttctctttctgtgtccatcatttctaacagacactgagtctcttaggttctgctccttatcagtcatttcaacaattacacacggaacagctccatttcccagcatgactccacattccagcagtcagcaatcactaacacttttcccacgcaccacgtttcctcaaagtgttgtgactttgcatatgctttctcctctgcaaccctccatttcccttctcactgccacacacttatgagtttcttcctctggggatccctccctgatatccacttgtagcccaggtgagttacctcttttttggtatttccacatacatcgttctgtgcatgctctgtatcataatgtcttggaagtattgatagttttggttcgtgctttggtagagtagactaactgttgtaacaaacagcttcaaatctcagtcacttcacacaataggagtcttttgcatgttcacataatggtttcaagggggtggtcagaatgtggccttctgctcctttccatctgtggctctatcatttttgagatctgagttctctgcagagtcttctgcattcatctgacgcataaggggatagagagagaaagtcgataacctagagggagattttccatggttatccatatctaggcctggatatggcacacctcacttctgctgacattctattgggcagaatgctattacatggaggctaggaaatttggcctatctttatgtccagggtgaaaggaaagtgaatttggtgaaatactgcccagtctgccccaattgcctgtctccacactagactctaagttccagaaagacattgattacgtgtattttttaacctctggattcctatcatctagtataatgtttgaaacatggtaataacttaggaaatgtctacggaaggaatgaatttgtctgaggatgtagagtaaatcatggcagggctctcgtaacaaaccagctgacccggttcctggtgctctttgtccgaactatgtaacccatgtatagtaagtttgaaacaacttgaacttttagggtactttgctctgcatttggaggaaaatattcagatgcccaatatgccagattatacattttttctgccactacacttatgaacaaagatgttttgagttgctgattaaggaaaatagctcccttctctctgaaaagcatttcacctctatgggagtgggtgatactggatttcatctaaaaatattatagaggtcagcaacactagagaacattatattatatatatatatatatattatgatttgttgctgttggattcaaaatttgagaatcccctggagggtagtttgatttgaccagtttgattggacactttgtggtgtaatcatcaatatcatcagccattttgggtctgcagtggtcacacagttgcatgacagatgtcctgaaaaaatgtccattgcttgttgtcagcatcgtctccaggttcattattgttattctctgtgttgccattattagtgttcttgggctcaactttacttctaggagatattccctttattaatgcttttctaatgacacttctttccatcaccattatcaactgagacccccccattagagcttttttagtttttctgatggtaaaatacctttctttgcttttgtcctgggaaatatgttttaagaataaatgcaattaattagagatttaagtcccacagaggaaagcttctctatggaacaatttgtcttgcattatttctctaatttatcatattgtttagtacatatttcttgagagcttcctagttgctcagaaatttccgagtactaggattactaaggtgaattccatgtgttttttgtcctcaagaaatatttttatgtagccaaaagagaagggggtaagaacatgtaagtgattagtgttatttattttatatttagtgctaagtgaatgattgggggaaagggataaagaaaggaaattactatttattaagcaccaactttgtactattctaaagggttaaagagtttgtctcaattaattctttatgtaacccaatagaagtagatactgtattggtatctcttttactgaaggagagacaggttcagaatgattaatggcttatcatgctacacatctaatgaaagaactaggattcaaactcagtctctggctctaacttccatgctgttagattgtaccaagcaacctggagagctaatgctataggaatctagaggagataacagaaatctgattggggttggttgcactgacaatgtggatttggggtgtgttcaataaaaaggcagaattgaccaagagaaaggaggtggaaagactctctgtaaatatcaaagcaaggtgggactgcatgatatatttgggtaaaacacaagcagatcagtttagctggagccaggcctcctagggggtcagagaaatgcaattctggggtgagaggaagagaccaggcttgaagaattcagggtagcagattaggcagttttaagtctaatgtggaggaaatggagaaccatggaatgtgttaaagatatggggtgaattttacagcagtggttcttgaagtgtggtccctggaatagcaacatcaacctatctaggagcttattgatgtgcaaattattaggccccacctaatacccgttgtatcagaaaagctaagggtggggtccagcaatctggtttaacaagccctccaggtgattctgatacacattaaagtttaagaactactgttttagaaagatcaatttggccattgtgcatagcatgcattagacagggaaggacaggttactcctctaataatgcagatatgaagtaatgagggcatagatgatggcaattggaatggaaagaaatcagcaggaggcatagtatgagaacattagaacttggggattgattgtattcaaagggggaaggagtaggggtccaagttgataggcaaggattaaaatctatgggatgaatctgtatttagttcagcccaaaatttaaaaatcttaagtttcaaataacaataaggatttgtggttttagagaaaaaccagatttggtgatatatcttgtatgttccattgggcaaacttcagctgagcagattagccatcaaattcttcttgttgatgggatgtcccccctcttatctgccaagttttcccctctttttttatatactttattcatttatgttgcctattcgagtcctgtagatatttgagctgatgatccctgctctaaggatcccagcttggggacaggagaataagaaatgtaggggtcgggagagggagctggcttggagggaaaccagccagtttggtttctagacattttgagtccgaggcaactgtaagatagtcccattaatctggtctttatattttgcaagaaaaacagttcagcatttccatttctctgttgtccgctttttagatcacccaaggcagtttaaaattctaggctggctttcttgcaataccttgggacttctgcctcctgctttcttagcatgcgagctcaagaatgcaaagtaatttttatattagcccatgtaaaatataattcaaaaggtaactctactgaggccaaactgtttgttgtattcccactgccacacatacattttttcctagttattttctccattgccccagatagttgaacagggactgcgacttttaatcagctaaggaagcaaaagactttctcttcactttactgtgaaaattgcatcaccacactgggtatgaactcattgaggtgggaatgagttgttgatagggcttggctttggaaatactactggctgatgttttatatcacttggcctttgtgtactgtattgacagagtatagtgaagaggaggaggaagaggagcaatttagtttgaagatgactaagagctgattaaacattcagctggggagagagatgagtgaatccaggtgatgtttatggagtgtcagagagggagaatgctataccatctggtgagagagacatgaaaaagtacataaatcaatctctataatgatacttaattaatacagagttgataaatgacataattgaagcaatgggtgggctacatcatagagttaaatagcttcaaagagggtgctgattaaagccattacaatttataaaacattcttcatgttaagaaagcatcttgatgagatttcacatgaacattttgtaatcagagggccagcttaaaacactcagagcagaggtgaaatgtcttaagaggtctattttggatgatttttgaaaaccagttattctcagggaataaaaaagcttgctttccccactccctttgttttttaatgggaaaaaaattaatgttgcattcttcacctttagacaatctcagatttttgatgtcctggtggtttggttcttaagcatgaccttaagataattagctatcaagcttcatttaaattgttttgaaatatcattgcaatttggggagcatatgtgcctgctggtgaaaaataaggaaaataccactgggactcaaaaactgtacaagtgactcacctcgattagtaggcttattttgtttttgcttaactcactctgaagctcataacagatgcacagtaatcaagcagaatgccaattctcatcattcatgcaggtggggccactgtgctcccaagggggaaccagagaagacccacaacaaacactgcgttttttcttctcatcatcctttcttttccccctttctgatttttggaaggtacattctttgtttggaaagcctttgttagaaattccaaaatgttctttaatcactggattcttattattgtatcaggtagtgtgacaggcatgcttcctcataatggatagagccaggcaatgtattttggagcccgcattctggagactccatgcctgtgtctttgttcagccacttgccagatgtgcctcattggtgcctcagtttcatctgtaaaatgggggaaatatcttctttgtttttcttcctggagttttgagggttttctttttttgtttcattttgtttttgtttttctgaggcagagttttgctcttgttgcccaggctgcagtgcaaatggcatgagttcggctaactgctacctccgcctcccgggttcaagcgattctccggtctcagcctcctgagtggctgggattacaggcacccgccaccacgtccagctaattttttgtatttttggtagagatggagagtcaccatgttggccaggctggtcttgaactctcgacctcaggtgatctgcccgccttggctcccaaagtactgagattacaggtgtgagccactgagcctggccttttgtggggtttaaaagcagtaatgttattaatgcctgacctatagtaagttttaagtacatgtaaagttgctactattatacagtcttattaactattgactggacatagttattgaatgaaaaggaggaagggagggaagcaggtaatcagggagggattgagggaaggaagaaagagaagaaaggaaagaaagaagaaggaaggaaggaagaagaaagaagagcttgatttagttaatgtcactgttgtaattggtggattataattgaagctgtctggttgggagacaaaccctatgccatttagatctctgtctgttcagtttgtccaaactctgctggggttatgtatttactagtctgtctccctttttggattggcaattctgcagacagactgtgtgtcttactcatctgggtatcgccagggctgtgctctatacctggcacacagtagtgctggaataaataaagagctggaagcagcacatccctttctctaacatgtaaattcaaggtgtcaccatttcacattcatagacattgaataataatgtagatgaggtgactaaccttttgaattgctactcatcaaaaatggaatctctggaatctgagaggagactatatagttatgtaaatttcggcaaagtattgcaaactccatattactatggtgctttgtggggctgctataattaatggtctgtttgcatttctagtacaggctgtcatttttcatctgcttataaccttgatataaacatttattcttggctgctattttgcattcataattgtaaaatatatataaacgttaaccttctgtttttcagcttttttatttatcaaaagcacagctcaagaatcacatcattgtggcatgtttttctgaatctctagtggcaaaaagaaatgaatgcattttgaattcaggcttcaggattaaggcaatgttgtttgcttatgcagtgccctttgaaaaatgtgtaatgtagcatatgaaccaaaagaatcctgagaaactttttccagccggtctttttctattacttatgccttttttatccctctgtgttcctccccacctctgtcatcagttcaagatgactcttaaagtcctcttgcatccatccaaatgacccattggcctctttaggtgcctggagaaagtaccagcaaaggtatttgttggagtctatcaaaggtaacaatacatagagtgggtttcaaaatcagacaggctgggttctattgttggctctcccatttagatgctgtgtgaccttatgtacattaaacaaccagtgtgagcctgttttctcatctgtaacatgtggagaacaatgtttacctcatagagttgttgagagaattaaatgaaatcaagcccttgacacagactgaaacatgggaagtgattgatgaaatataactgacgtcttatcttggccatggtcattattatcactgtcatcattagatagtgatgggactaagctaggtaggttgacatgagctgacttatcttaaaaggcaccagctctagatagagccctcctcagtgttcaaagactcaaaagacttgggttctgtttatctcccgatttcgggagcccactctccttagtctccctcagtcattgactaaaaactatgcacttgtcttttccattctctctatcctcatgttaaatgcttgatattgttcttgcaagctgtaccaaagttgtggtggcccaaatcagtatcagtggccagcttacccaaaatgcagcaaatattctatttcaaacaatacccaagatattttccacctcagggcctttgcactcactgtcccctttgtctggaatgctgtttccctgctttgtgtatggttggctctgtttcaatctttacattttaactgaaaggttctttttgtgaaaagcctttcctgactatactaagtagagtagcactctccctcaaactctctcacacataatctcctctgtatgcacagaatcctaattatatttggtaatttatgtctatctacctacctacctatctagttttcagcatgtacttctgcataaaaatataaattgcatgaggactggaactgtgtctttcgtgtacctcattgtattctcagtacctaggagattgctggcacagggcaggtacttaagagatattgattgaataaataactattttaaaaatcatctaagacaatagagaaccaattaaacagatacatactgtattatagctatttttctgaagccacattctaaagcaccacagatttttttctcaattttttgttttgttttgttttgagacagggtcttgctctgttgcccaggctggagtacagtggcatgatcatggctcactgcatccttcaccccctgggaccacagacacaaggcacaatgcctgtctattttttaaaaaaaattttagtagagatttttgtggaaaaatataaatctatagtaaggctgaaagaatagtaaatgactcatttactcttctgagatcagacaagatctcagtgtggtatggccatagatgtgactcatatactctttataagaaattgcctaactttttatttttatttttattttttgagacggagtttcactcttgttgcctaggcaggagtaaatggcgcgatctcggctcactgcaacctccgcctcctggattcaagcgattctcctgctttagcctcctgagtagctgggattacagtcatgcaccaccacacctggctattttgtatttttagtagagatagggtttctccatgttggtcaggctggtctcgaactcctgacctcaagtgatccacccacctcagcttcccaaaatgctgggattgcaggcatgagccacggcgcccagcctcctaactttttttaaggaagttgtaccattttatattttcggcagtcatgtgtgacacttcaggctgctccacattcttgccaaaatttaattttagcctttttggcagatatgtattggtatatcactgaagttttgatttacatctccctgatttctgaatccctctttgtgaaaagtctactccaggcttttgcccatctataatttttttaaaaattactgagtggtaggagttctttatataatttagatacagatccgtagtcagatatatgttttgcaaatattttctcccagctgatgtctttcccatcttttgtgtcatagagtcttttcttaatagtgccttttgatgagtagaagttttaaattttgaagtctaatttatccacttttagttgctttcttttatatgcatctacattcattactcaatattttgccacatttgctttctctctctctctctctgtttctggatcatttgaaagtaaggttgttataacactgaaaacatttcacccataaatatataagcatgtattcataagagcaaggaccacctctaacataactgtaatatctttgtcatgcctaagaaatttagcattgctatagaaatattatttaatttaaaattcatccatattcagattttcccaattgtttcccccagtaatgttgttgatcttttctttctgaattccataatccaatcaaggacatacattacatttagttgtcataaagctttagtctccttatatctaaaattgctccctagtctttttagtattttatgacactaacattttcaaagaatataagggagttattttgcacaatgactctcagtttggagttgttcctcattattagattcacgttaaatatatttggcaagggttctatatggataatgtcatgcccctcattgcatcacataaggaaacaaataatgtcacttttccttattggtgagaccaaatttgatcacttgtctaaggcattatctctggatttctttatcgaaaggtagcattccacctttgtagaggaaatacattgcaattattgtgggatgctcttgagactttgtgaatcttaagttctttaacaaaatttcacccagtgagattttaacatccgttgatgacccctgcctgaatcaatcattgtactggaagttgcaaatgtttttctaattcaattatttctattacaattatttgctgtgtgcttttgtaataaagagcatctgcctccttttccttctttttgtttctgatgatcacttcatgggtttttaaaaaatgtatgtgataaaattcattactatcatcattctttttgataaagcatcaaaaatttcaaaataattaatgtaaaagttagcattacatgataagcttgaatatttgaagcactggaaggaatactctttttattcatccaaagttacccagactaccacagataagtcaactaattaggagtgtgtaatcaatatcatttcctctgaactttttattaacagcatgagctttggggtaataatcctgaagttatttttagtttacaattgccaatgtatagaatatgcaaataaagatccttcatcccatacataattgctgttaattgttaaaataagtgagcaaaatctcaggtccagcaattgcttctgagtttctgcagactgatatttgttttccttttttttttttttttttaaactatgcagctctgatgttgaggagtatgaaaagagcttttttttttttttttttttgcaagagaaataaggatctcaatataggtttgcagaggccagcagggatgtatctttaggatgggtttacctcatatctgtgtaatacagagaactataaattatccacccactccaacctccccatgtcatcagtggttgtgaaggggtaactagcctctgcctgggtgtcaacagtaatagtttaatagctcagtgaatgtctgttgcctcactggttactgctccgtagagtaaatatttgacatcaaggacaagaatttaatttttaactttctcaacttaattttattcagtaaacatttattatgtgtcttctatatttcaagccaggagaagacccaatttttgtaggggtaggaacttacataatttgggggcctctttaagaaaaacaatacaaagttacttctacacatttagatataaaatcaacatttatttacaatagggaagaaattataacaatttatgaatttaagagagccaccaaatactacaaacgtgacacaattcagaaaaatatcttgttttgattaaataactacctatcaagctgctgtactttgtctgcattttttatttgcacattctttgattgctctttgtatgacagtgcttttgtgttgtagtttctaaaacaagaataaaaaaggaattcagtctttcctgtagtatggttgatcataatttagcttttattattgatagtttggaaaagtttatttcagctttatagcttttttattggtagtatcattatacaattttaggattgttgtcaaatttgggaaaatgttatcaagttttgttcatgtatgggctgtaagatttcaggacattttatgtttttgtatagtgacaatgaatgaacatcattccatttagtttgctgtctagatcctcgtttttagtggcattttatgaatttttgttatgtttgtatttgtcagcattttgtgtcaaaccaacaagaaatttcaatcttttctcaaggtgatgtactttttcattatttggcttattgagtgatctgtgagactactcatcccaaatacccaaagtatgtctctttctgtcaataaactgtagttttgtatggcttttgtctgggaatgccatactttgtcagaataagatgtggtgtatattttaacatgtaatccaatatgttaacacaaataaaactgtgacttcatacatagatgcatttgctctttgagctctacaatcacaggaattctgataaattctattttgcatgacttccttaaaaatataaaattagaggttgtgttcgcaatagcatactctgaattactgaacctattcttgataggagagaacttccattttaagtaggaattaatgaggattggatacctcgactgcagttctgcatatctgataactggaagcattttccagtgactggcttctggatctccaccactgtctccatgctttcactgccagatgttgcaggatgcattcttgttacaatatgacctctgaccctgtgtctttgtattatgacactagtagtcccgggacacattcctgtaccaagatggaaacaactgtgaatcacctaagcacatccctgtaaacccaagccaatatatctccaggtcagcttctcctagctggatcctcaatgcctatagtcaatccagtgctgctccatatgttgggaagtatgacagaaaggaagtcagagtggattaaaagattccacacctttggtgtgcatggattggtgcagcccttctagtgagacatccccagatgttagctgataacatcctcaccctcatcctccccaccatcacttctctatgttttactggcctgatccagtttttggtggcttggcacttggaattctttacaagcactttctttctatattgacttactatcatttttagaacccagattttttaaatgttcaagctggatgaacccttatacatttgctctactctttcattttataaatgaggagcttggggctgaaggtcattcagctaagtagaagaacaaggacacattattttttagctctttatgccatctttcttttctttcaagtctccatcagactacacccagccttccaggattaaagtaagttaattaggcatgcattgatttgatctccgtaggtcccccctaaattgatatttttaggagttagaatattcaatgtgctccccaaatgctacgtaatagtggttttttgctcattttgatagggcttttagcagagtgaactgtttcgtggacactgtcacaggaagtggaaactcaccttgtgaaaaggtaagctttccatgggctttgagttttcctttcctcagcaggggaagggcctatatgtgttagtgttagctgcctggccttcctctggggcttggtttttaatctccagggaggcaaggctgacaaaatgtcatctatttgcctactaaggaaagaagctgtgaaatagatctccattgcttatgcacctcaagtcgcttagttccagctgtatccataatatcatggtgtatttaaaatactgctcattgcaatccttttgaaaagagattctgatgctcgtaaatactccaaaaaggcattaaggtgttacactgatttttatttttattttattttattttattttatttatttatttatttatttatttatttatttatttattgagatgcagttttgctcttgttgcccaggctagagtgcagcagtgagatcttggctcaccacaacctctgtctccagggttcaagcgattctcctgcctcaacctccctagtagctgggattacaggcatgtgccaccacacctggctaattttatatttttagtagagacagggttgctccaagttggtcaggctggtctggaactcctgacctcaggtcatccactcagcctcccaaagtgctgggattacaggcatgagccactgcacctggccgctttttatctttaattggatttattccctttagaaaacttaagtttgtggattcatatccaaatattgccctttactgatctagctttttctgctgtaagttctaggaaccttttaattcagagaggggtaaagaaaagagctagcatacactcaatagcttttatgttttggatgcttcataaatatcacctcatttggacccttacaagagctttgggaggcagggagctttagacacattttacacctgagtaacttgatcaggacattttgaaaaaaaggtttttgattatctgtttttcaacttgagagagtcgtgagataactaaactacaaatgaaaaatacgtaggtaagtctctttgtaaggtcatattcgtaaaggttgcaaaagagaccaaacaatgtattccaattgagaagtccaggtagagtatttggttcatttgtgctgctataacagaataccatagactgggtaatttataaagaatagatctttatttctcacagttctggatcctgggaggtcaaaaaacaaggcactggcagcttctgttgtctggcaagggctgttctctgcttccaagatggcaccttatttcttcatcctccagaggggaggaacgctgtgtcctcacatgtggaagaacagagggacaagtgaaccaaatctttgtgtgaaacctcttttataaaagccttaatcccatttatgaggggaggagccctcttaaaggccccaccacttaatatcatcacattggccattataagtgtcaacacctgtattttggaggggacactttcaaaccatagaataaagaaaacgaaagggggaaaactgcaaacaaatgtgctatgagattagatggatttgaaggggactcgacagtcttgggccctttgttttggaagatggattttgaaagttatcttttattgtattcctgtgaggcccatttgtttcctacccttttctcttgtccccctcttccttctctttattcagtatcttcctctggcaaatagcagttactaaatttggttctctgttatcttccaactcgaaaggcaaaaggcacaggcagtaccctcctggtaattatttatgatatttctccttccagagatttgccctatggcagcttcaatccgttaccatcactttttatttttttgcccatattggcagcttcccaagactttgggaggaaaaagcagatctgcagatacgcaaacctcaaaatcaagacttggttaatgaaatcactcctccacttgcccttgcctgttactgaatcctgttccagctgggatggaaaaagtgcattggtcatgctgtcaaaagcatatcacatttctccactgctatttccttccttcttaactaaaaacaaaacaaaacaccatagacaacaaatagacacacacacaaaaaaaaagacactaggtgagagtgaaggtagtttgtactattttcatttttcgtgtgttcaatcgtatttctctcagcaaatatgattggaagtggtgcttttccttccttccccaccttccagcattaggtttgtaggtgaacataaaaatacactgacactcaaagaaagagctctttctgctctgcacacatcccatctcgccctcttccttgctcctgcttatttctctctctttctgcctccttacctccttcagtttagagcttagagaagtttttcactcttcttttgacaggtgtcagatagacagtatgagctcatttaagctgaactgtctgggggaaactaaatttgttcaggagaatagcaatttggatgacaagtgccaggacataccagatggcacggctggagaaattcttatcgggctcccagctcacgttccaggcggcctctctgtctctctcctctattcttatttgttcatggttgacccagatggaaacttga

SEQ ID NO: 1289 - DNA, 20915 bp, Homo sapiens
gccaagagtctatatttcagatgctaaatagtcagatgccttaaagtgtaatccttcccaggtattttccccagtcagtagttccagggtaaagttatgtcatcatcaggtagctagcccagggcttgaagggtttaggattataatactatcgctgtttggtcgagcaggctgggtgagctggcctaaggttgtgggcaggtgggtggcagggtgagagtgagttattgggatccttagtctgtagcagctatggagtctcagaatctgaggctgaagtatttaggcagaggagttcttgagagccagagggctgagatagtgctggctctgacagcttcatgagggacattaacatcttctggctaggagggcttgggcctatttgtcagctcagcctgactcattcttttattttttaaaatcagctgaattgaggtataacttatataaaataaatcaaccaatctaatgtacaatttgatgagtttggaaaatgtataatgtaaccactactacaattataatatataatatttccaccacccaaagtttcccttgagttcctttgtagtccatctccgactctaccaccctgccctggcagccagtgatctcctttctagagctatagttgttttttaaattattatttcatatataagtgaaataatataatttgtagtcattttctgtgaggcttatttcactcagcataatgcttttgagatgtatccatgttgttgattcagttgtttcttcctttatatccccgagtaatatttcattgtacagatatatgacaattcgtttatccattcagcaattgatggatatgtgggtggtttctagtttttgattattgtgtataaagcttttgtgaacattcttgtactagtctttctgtggacttaatgttttcctttcttctgagtaaatatcttggagtggaattgctggactggcctaaatttaagtacccttctctctgtcaagatgcttcactctgtattttgtcggggtagcaccttctcccagaaggtagatggacaatttcagagcaatcatgagatttaggatgttgcctagaattccaagagttgatcataaatactttgttaccaagatgtaaaaggtagaagtttaacaaaacttcttccacaaagaagtaacagcattactttcacagaaaaaaatgaaaatgaggacagtaaagtcaagtctgtggttgcgttttgtggagggaatctgcattctagctggcctggaaccgcaggggacatacagactatgaaggcaagcaagaagcatgaagtccctctgcaggtgttaagttgactaatgagcctgaaaaagaatggccttatccccaataaatgtcgcttcttccatgaagactgctttgataacattcccctcatcccaacacttcatgccactgttatggtgtcatctcctagcagaacttgcaaatgccctgagagcaggcactctgttcactctatttcctttcttttcctttttcccgccctaatggctatttcaggaacttggcatgcagtggcttctcaacacatgttttattttggtaaaatgaaggagtaagtaagaaaaaaatggttggaggatgttactaatcttgatcctctttaaatctggaagttttactgcccttttagaataccaattgttcattggcacattgaacctcatccctgaatgtagtgcaacatgtccaaatatgaacacattggctccctcatacctgattttttgtctttgtttcttgtttctattaaatgaaccatatttatctaacagcaaagttataaaacttcaagttaattttcattccctctcctttatcactgtcctacagtcaggtatcacatcctattcagtctattttcagcatattaaaaaaaaattctgttcctaccttgcctttactgctactactgccttaattcaggccctcactatttccccccgattttttttcttctggtcttttccatacttctttgcaatgaggctcaaagttattttaaaacatttgatctcaacatggtgattccctgctttcaggtccctctctcctgtttcttataagataaaggttgtgatgaagataaatgctgaggtgagtaatcagaggtgagcagaagacagagaaaaaaagacaaagagagaggggagtcagggttagataagaggcagttatagtaagaagaaattatatggtaccattcataaatgaacagaaaatgagaatgaagaaaggggaaaaggaaatgtatgatggtgaaaggcaatgtctggtggagattcaaggtcaactgagaactgatctttcataggccagggaaggagttcagttccaaagtctagcagactttcctaaaatcattcatttttaagttatcagtaatgctaacagtaacttaaaagttggtttttataatttaggttgactaacttctgcctgacacaaccttgctactttgctccatagcatactaaagaatagtggtgctaaataacttataaaattagctgcagtggaaattatctctataaaaggagaaggtctgttgaaactatcattattctgcctgcagaataatgcaaatatctttggagacttgaaagtaggcagaggggaggaaagtgggtatcttagtctgttttatgctgctattgaagaatatcatagaatgggtaatttataatgaacagaaattagatcagagttctggagacagggaagttcaagagcatggcaccagcaatttgcaaggaactaaggaacttcatgctgcatcatcccatggcagaaggtggaagggcaagagatggtgagagcaagagagcaggaggggaccaaactcctttttataacaaactcatttttgagataattaacccattcctttgataatcatattaatccattcctgatggcagaaccctcatgatttaattacctcatattaggccccaccttccagcaatgttgcattggggattaagttctcaacacatgaactttcgggtgacatatgcaaaacattgcatggactaacactaggcagtggctaatagatattgttcagtaataacacccagtatagttccttacatctcatcaaccatgcagagaaccttaataaaagtaaagcagttagcatgtaaataatccttccattttggcccaaaacccatgggcaaaatgtggtaaatatcagctttagaaaagtgtatatgtgattgataaagtattagtacatttcaaaaccctgttgcataattcatccataagcctggaccgaattaaccacaggctttaaaaagatgccaataggccaggcgtggtggctcacgcctgtaatctcagggaggccgaggcgggcagataactaggtcaggagatggagaccatcctggctaacacagtgaaaccccatctctactaaaaaatacaaaaaaaagttagccgggtgtggtggcgggcgcctgtagccccagctactggagaggctgaggcagaagaatggcatgaacctgggaggcggagatcgcaccactgcactccagcctgggcaacacagtgggactccatctcaacagaaaaaaaaaagccaataatgaaaatactttattgggtttcactttgtgaaaatagcagaataggggtaatatatacctaaaatctaccctctttccaaaaaaccgatggtggcacattctggctcctctaagcccagaattctctctccactctgacttcctcagaaactgtactcttctgtgatttgggcatgttttgcaggacccagaagatcttggacagtgtgcatgagtgcacttcactggggctaaagcagtcctctggaagctctgacattagcctcagaactgcattctctcaagacagctttatccctgggaaatcatggtatatttaagacccatctatggttgagaataaatccgagtaggtgaaaatgagcgctttttgatttctgagctgatacttcatggtactaaaatagcaatattatttctacccccacttatcaaggaactactttgcatttgaaaattcagaggaaacttcttaccatctgtgaataggttttattttttgttaactctatagaggttatcctaacaattaaaatagtcttagaggcagagacagagagtagggatcctagagatttagtacaaactctatgactttcagattaggaaaattgaccaaggagaacttgtccaaggggacacagcaaatatgtggtacaaacacatctggaacataactctagatttctggactcccatttcttttaacctctaagagattccattatgcctgggcatgccttagttgaatggtgtataaatttgagggctatacattgattcaggatataggcagttccatccttaccaagtcatttttataggagaaattgtacctttctctcatgctttttctcctgacatcttttccctaagcacaaagagttctcatatctaccgtcctttgtcgtctcagagtttccttagagcacccctgaaggagtttcacctgggaaagtcgcctgtgcttgatccattgattttatgtatcctccctctaagtcctccttgggtcatttctttttagctccttgtcactttggaagaggatctgatgaatgcatcacttctggggtgttaatgactctttatgacgccttgttcccctgtgcctcttttcacaccccttcaccaatcagctactcaggtccatctttatcagagggcaacagaaaaagccaaaatagatgcactactaatcatattatattgtaaaataaattttttagaaataattttagactcacagctattgtaaaaatagtgcggaaagttcaaatgtatgctttgaccaggctaacatgatcagtgataacatcttacgtaaccatagtacattaacctgttgaggacactggtgagaggagactcctgagagcgagctgctttcttggaaagcgagggctgtcttgtgggcatctctgtgtagcacccagtgcagggtggacctgctctgactttagcccccttagtctttttccagttttaatttatgatgctttcatgattttccacaaacagatgaacaaataaacacagaaggaaggttgtgcttgaattgacctgaccagaggacaaactgatcctaaactggactctctctcaccagtaatggattctctaatgttgactcttggggctggcccatttcttttgatccccagcaatttcctaggtcttattttgaggtttgcttagtaaaggcaatatttttaaaatgttaatatattcatgaattattctgaagttattgtatggaaaggaaagtgtttgggattttggagtggttggcggttgatggtattcaaacccattttgataaggccttgatgcagtgaattttttttttaacatgcctttttcttacagcagttattttcatgcattcaaagaacaaattcagttttatatgccagtattattttaaatatagtacagtactgtgaaggctagtggggaacattgaaatgaaaactctagtttgttaactgaacacttcactttcttttttcagtgtggggcaggatttctcaacatcatctctgttggctctttggatcagataattctttgttgtagggggctgtcccgtgcattgtggggtgtttagcaacattcttggccactaaccactaatgtcacttcctaccccacaccacacctcctgcagtctcgagcatcagaaatgtctccagacattgccaaatgtcccttgggggacaaaagccaccccaagttgagagtcactgatgtggagtaatggaaggaagactagatgggtgttgtgaggctttggttctggttttatttctggcacaaataagctgagtggcttaatccttcatctatagaaggaggaactttgtctgaaaaagcttgaaggtcattgccagccctaaaattcctttattaaaaaaatactgaaagatgaaaaaaaatacttaaagatgaaatttatcatcacactaatggtaaattctgtgtactgttaaatagcaacaagacgtcatggaagccctttctaaagctggtgctggagaaaagcattatttacagagtaagggtgttgctgttttgttttgtttttaaattctgtgttcgaatacagttgggaactttcctattcaaaaagttaaacaggctccctttttctgtggtacttcttaagcctttaatgtgctgatgtgcactgggaatctttaagaggtagctttgcagtattctgcaaatttttgatcatggaacactgttttcacagagtatcttaacataaaacattttgtgaaacagtaggatgaggcatgagttttgctgggtagattatgttttagtgttttttattatattctttttaaattgctcttacattaattcagcatctatttacttattgggtattggtatgtgtgaggcactaaggttatagcaatagcatggggtgggcagtatgctctgagcataacctgtaaaatttgcatcctgtctcttatattttgttggtagactattttgcctttctggatgtaaacatcagcctttcctgaagatgggagaacttatgcagaagttgagaaataggagaggcccattaggagggacagcccacggtgggtctgacatgccatgtgaagggccagggctttgtcctgtaggcagcgcgaaggcactgtagagttttagcagtggatttgcgttttagcagtggattttcattttagcttactctggccactgcatacttttgagtaggcaaagactgaaattcagccagaagataatagagtttaaaccaagacagttgaaatagtgttggaaaagaggagaaggattcagaaaatgtttggaaataaagttggcaggagttgttgaagtttgggtatatgagagaaaaagaggtagaagtgcagtttgggtgagtaggagaattcatccattaattctacaggaatttattgagctcctactttgctgggtgtattagggttctctagagggacagaactaataggatatatgtgtatatgaacaagagtttattaaggagaattgactcacacgatcacaaggtaaagtcccatgataggcaatctgcaagttgaggaacaaggaagccagcagtggatcatcccgagtcccaaaacctcaaaagtagggaagctgacagtgcagccttcagtctgtggccaaaggcccgagagcccttggcaaaccactactctgagtccaagggtccaaaagctgaagaacatggagtctgatattcgagggcaggaagcatccagtacagaagaaaggtggaggtcagaagacttagcaagtctgctttatcctagcctcactggccattgcttagatggtgcccacccagattgagggtgggtctgcctcttcccgtccactgactcaaatgttaatctcctttggcaacaccctcaaagacacatccaagaataatactttgcatccttcaatccaatcaagttgacacttaatattaaccatgacaagttcaccccttgtcaacttgaacccatacacatctcctgaaatcgtatataatctccaaataaagacaataattatgcctaatataatacagctatctcttgtgcaacccggagcacactaattgttaacctaaatgctattacataaagttaacaatacttaaatactgatatgaagtcaataactcttacgtcacatgacaaaggaaaaagaaaatgaagatattttcttagtgcaagtgtatacatctacatattcttaacaaaattaggaggaaatattcacaacaattacagtcctctttctgtagctggtcacgtggttgtagctggtattgatgactacctttttctactacctattctgtattccctttgccttcagcaagcacctcagtgggtcgtagttttttacttggtgtagtgacccaaaccttcactcctgaagggtctgggccatttgtagtcatgcctggattgggttgttgtagtttcccattgaccataatcacaaggcatggtaatactaagagatgccgtaaggatctcctgtattccatgcatactcttccttacctccattatgggataatagactaattttatcttgataatccggatcagttgccccggccaacactgtaactcccttcttagcctgttgacttagaggtaggcagagcccaaagtgtccagatggcaaccttaacttccaatttaatagaatcattgttgtgcctcctggcaacattcctccctctggaactaagacttctaagccagcagaatataatgtagcaggaacagaaaacaagaattttgctagtgggtcactaggggtgatggtgagtgatgccacttccatttccaccccttgttttttggacctgtgaatcctggctatgggagaaacagtaccatgtattggatgctgattcagatcatacacagccttctggagaacttcactcgagccctgcaaagccctgcaaagtattgtcgcctagttggcattgtaattgtgacttcaaaagtcattccaccattctatcaatccagctgcttcaggatgatgggtaacatagtaagaccagtgaattccatgagcatgcacacattgccacacttttttagccatagagtgagtgtcttggtcagaggcaatgctgtgtggaataccatgacggtggataagacattccatgaatccatggatggtagtcttggcagaagcattgcgtgcagaatgggcaaacccatatgtctattccggtgcagacaaactgctgccctttccatgatggaaaaggtccaatataatcgacctgccaccaagtagctggctgatctccctgaggaatggtgccatatcgagggctcagtgttggtcccggctgctggcaaattaggcactcagcagtggctgtagccgggtcagcttggtgagtggaagcccatgttgctgagcccatgtgtaacctccatctctgccaccatggccactttgttcatgggcccattgagcaatgacaggggtggctggggaaagaggctgagtggtgtccatagaatgagttatcctgtccacttgattattaaaatccccctctgctgaggtcaccctttggtgagcactcacattggatacaaatattttcacagtttttgaccactcagaggtccatccttaaaattttgtatatacatattatcccattatcaaatattgtcaaattgccctcatagcaccatagctgcatggtaagatgggcaattaaacaagcaacagtgatagaaggtggtaagtgccacagtatggcagctacatgcttctataggggctcatttgagggcaaccgtcctggtctaggaagccaaggatggctttctggagagattcagtttattcctactaaaaagaagattaactgcatgctagagattataaggatggggttgggatgaggtatattacaagctgaggaagtacatgtgaaagcctgaagagtagtgttactcttttttttaagaaacgtgatgtgacttcctttaacttctgaattcatttgctaatgaatcctgtttttatggagttatcctgtaaaataacccaaagacaaagacatggcttttttaatgtatatgtgtttttagaaataaatcattgaaaagctcagtaatccctttggagaacagctttagcattgatgctgtcaagacccttgtcaaaagaataaaccaaacctgattggcctggtggataaactcattccatacataactgaatagttagagactgtacagaaatgcagttttgcctttcatcttaatatgtagtctgatgatttgtaaaaaccttcttagtgggaacagcaggttattctgcctgggtgggagcctttttactagcttaagcagctgtttaaactttcataagcaaagtaattattaaatgtttcatgaacatattggttggaacgtttgttcacattttaaccttgagttggaaagtttcaggggggtggggttaaagagttttaagctggcaaattcattctttttttctttcttattataaactttttatggcttagaaccagccaacctaaatcatggaaggaaaaatacatgtgtggcaagcatgagacatttcattgtttatttttcaaatttctgaaatgtgctcatagctgtgcatgcctctgggctcataaagacagcaaatggaaatagctgaagccagacagactgttttagatagatagccacccaggtaggcaaggaaaaccttgtaggttactctttcctccaatcaagtcatattaatttgccaaaatgggattttcaagcaggaggatgtgatctttcataggtctgaacaccttgcctttttcaatgatggagccatttaataataatcataatcagaagatgaggaataatatacatttatagaatacttagtacatggcaagtgtatatgacacatagtagtctacgtgtttctcatacattatctcctttaatgttcaccacaaccttgtcaaacaagcaatgctgttatatccatataacagatgaagaaacgaaggcttagagaggtcacagaatttgcaaagcttctgagtggctgagctgggatttaaattcatctgtcctatccaagaacaattcattatcctgtacttcttagtgcctttttattctagtttgtgaagtgctgctacctaaagagtttcccattttactctaaatgaaaaagaaaaccaggacaaccatcagcatcaacagcaactaatgcttgttgaacaactactatgtgcaggacgctatgttataagcttgggaaatattctgggatgagaataaagaagataaaagggtccttgcccgtggctggtgaggaaaataggcagtaagttctagagctcacactgtgcagcactagtgcagggcctgcagcactgtgtccttgctggcccagtactaatgtctgcatatagtactttacaatttgtaatgtgccctcactgatattgtcccacataatcccaacaataggactgataataatgattcccactttaaagatgaggaagctgagattcagagggacaaaataattggactaaggtcaggcacacaccaaaataagtggaaaatacgattcaaaatgtggttctctataacttgctgtagtcattacctagagccctgcaattttatatagcataaaataaatgctttaaggattacctgaaacacaaccttaaaaaatgaaagcctttaaataataataattacaatatagtgaagtaatgagagcaattttagtagttttaaaatatgtccacatttttttttaaaatttctgtttaaaaggtggagccgaattctcttcccctgcatgtgtactgtacttagtgtctgacttctagtgaacagaatattgcagaagtgctgggttatggcagccaagattagaacataaaatgcagtgtagcttcctccttgctctttctcttgcatcacttgctctgggagaagccagctgccacgctgggaggagcacttggagaggtccaggtggtaagacactgacttcttctgctattaaccagtacaaactagctaacaagtaaatccaacaggtccagtctaggcttcagatgacttcaaccctggccaatattttgaccacaaccttatcagagaccctaagccagaaccacccagctatgccactcccagattcttgactcacaagaacagtgtgagataataactgtttattgttttaagccactaagttttggggtaaactaatacagcaattaaagggcacaagatacacagaaaggaataactgtgtctaagctgtcacaaaagatgggtactaaaatgtgacaaatatgagtaggaacttataggtggacaaggaatttattgggaggtgttctgggcaaagaggcaagtgtatgcaaaaaagtgtggaagtgtgccacagcaaggtacatttatgaaactgcacagtacagcacaagataaaaatcacaccaagaaatgtaatatatcataatataacaacaaatgttcttaagagtgactttgagtctgcaagaaatttagttctatatggactattttaaaagataggaaagcaattaaaacattgtttgaaatatttacttcaaaatttttttaaagtactgtataaatttttagttagagtctaagctatccagaaaagccacttccctgttttcttacttcactagaactgtctggttccatgttttgaaaactttagtttaaatgtagagccaagaattaactaatgaagaacacctggattttctgcaggatttcactgcaccaattctgttacaacaatcaggtagaaattaacattttataaccaattatatgttttacttggcatcatgctaaccaactgaatttttacaaaagagaattggccaaattgactcattattctccaccatacctcactcattgactgactatttattgagtgccgtccgtgtgttacccactgtgataggcccataaaacaaccctttatggttgcaaaaatcactttgcatcccagttgcagctctactgttttctagagttaatagaagttcctggtgaaaaaaactatgcttagtttttttctaagcatgtttaacttgggtttttaattaaaattaatacctactcatttgaaataaagagaaaagtgaaaagaagttttacttggaaatacattaattgaaagacagttgctgttagcatcttgctgcacttctttcactctattttcttctatgagtatctttataaagttataatattttatagatactgtcaaatctagttgttgtttaacatcaggcaaaatatcccttgaaacagaatttttaatgtatttaagttattctaacaaatggatatcctgcaatttacttaacctggtattagatgttttgattatacatgaatctttcaggaaaaatgatgtcatagttaaataaatatgtagctagtgaattttgaatgtgtcttttgaactgtttatgggctttgtgataattgggtaattttaaatgataatcagtaggaagcttaggaagaggttaacatggtttctctcccttccaagagaactgcctttgtaagattctgagatgaccactgtggccatgtgcccaagtgtgctgtcacagttatactgtcagttaaattaagcatgaatgattggatggagaacattattattctctgcacattcttgattcttaatttaaggttaaactaatttaatgtcatgtgaatttttagcagcaattatggacagttaatgcatgttcttccttagttatgcctcatctctttgcaaaattacaatatttcattccaaatttcttctgaccagatttggaagtagctctctcttctcttttccctcaatgtttatatcagaagggttttgagtttatactgtaaatctccatttgtgtattttcataataagactctaagaaccttgactggttatgagggcactggaatcaaagcaaatgagggcactggaatcaaagcactggacccagtgctttctccatccttcaggggatattgtacagacaatagagatgctatcttaacatctctgtttgagtttttccctctccacctgtcttgcataccaccctaaccaatactccttaagtatggctctatattactatgcccctatcaacactctattttaaaaaggcatggcttcacacttcctgtaagataatagccagtagtccttgaatctggcattcaaagctttaaatctacaagatgatatactggtcataccttttcctgcctattttctagagtcttttcccagaagactctgttccatgtatttggtgtcactttcctgtctctgtgccttcctcatactgacccccttttctaacctgactgttgaaatcttacctactcagtcttttttcatttatttgttgattgtttcaataaaattaatttacttaataagtatttactgagcactgattgctcatcagacaacattcaagagcctactgaaatggcaccttccctgagaagcctctcttaattacacacccatatacaatgtttctctcttcagaacttccataggtctcttttttatgctttccataaaatttgtcacaaatcccataccttatttatgtgcatataggagcatctaatgggaactcaaaattgctttaaagaacataaatgaatgaatgaacatgaatgagctaatgaatgaaagaaaagttatgccttctgcaccagcagaagctaatgactaaaataaaatggttaaactggactagaaatttaagattgttatgggtttctagtctaggaaacaccctcaatgtggtttccatattggattatcccaacagagaaagatatggaatccccatcttctgattcccacaccattactctttctgcaccatgttatcacatgctactctattaaaattgaggcagtattatcatactttgttattgcttttcattattagacatagtgttttaaggacagtattgaataggaagattgttttttcagagtgctgtaacctattttagcattcaaaggggcaaatgtataaacctgagtggtgagaaaaacgtagcagattaactaattttgaaagataatttattttgaacttgagtaggggctagggaccttcattagttcctaagaaaagtagaccacaaactcaacctctatgctcttttttatctagtcatgatattagagtatgtgtggactttgacagtgacacctaaatggtttttacttgcctcattgtttccttactaactgtatgaaagaagaacacgtgttgagcccctccaatctaaaaatacaaactctggaatgctccaaaatttgaaactttttgagtaccaacatgactccacaagtggaaaatcctgacctcacatgttgggtcacagtcaaaaggtagtaaaacaattgtttcatgtacaaaataattaaaaatttgtatgaaattatcttcagactatgtgtataaggtgtataagaaacataaattaattttgtgtttacacttggtcccatcctcatgatatctcattatgtatatgcaaatattccaaaatctgaaaattccaaaatccaaacatttctggtcccaagcatttcagacaaggaatactcaacatgtgagactctggaggtgaatttttgtttgtttgtttggttggttggtttttgcagtaaattgttgaagtcttagaaggggcgcattcagcagttagagcttcccttttaatttgcataccatgccgaagaagaggaggtgtgattctccttctggagatgatcattctttcaaaaagaattatggtgaattgtgttttttaaaaatagacttctagggcagagtaggggaaaaacatagggaaccgttaattaaggtatcagggcttgagaacgttgtttttgtctgcccaagacccttcctttggaaacagcacctctcccaacatttgtgctcctagtggactggtaacttgcactcctaagaactggaatcttgaggaagacacagagcgatagatgagattggggctgagtcatccatgatggtatcctgggcagttcagaatctctgagcctcagtttttcttccccccaaaatgggattctatgtctcactgagttatttgaggattcagtgagatgatgtctctgcaagctttggcacagagttgttattcaagtgaatattagctaccactctttgaggttagtagtcctggggacaattcttttctccccctaaagaaggaaagggaaaggaaactttctactgaggaggtagcaaatgcagaatcactgaaagtgcttgcgaagaatatccaactattcaaattatgaattagcaaaagataatcaggtgattgtgaactgtgggttgctgctgctttgttgtaatactgctgttaaaacccacgttagagatcacatggacacaggaaggggaatatcacactctggggactgtggtggggtcgggggaggggggagggatagcattgggagatatacctaatgctagatgacacattagtgggtgcagcacaccagcatggcacatgtatatatatgtaactaacctgcacaatgtgcacatgtaccctaaaacttagggtataataaaaaaaaaaaaaaaaagtcaatagtactgcagaaactcaggcttcttgttgggtcggggagtggcgaaatgtaaagggagtaaaaagggtggtagtctataaaggaactagccatccagccacccagaaaccaagtccctcttttaattaatagagttatggagaggctccagcatattaataaatgtccccctatgggtggtgagaacgtcaaatgtgaaacagagcatattggattttgtaataaaaatacagagaattataaatgagatgtccaggaggcatctaagttaaggacacctaagatcaagaatttatattctagttgataaaaagttgtggataaaattagggtgctgagatggaaaaagaaaggctcctgttggcaggaggaacactgatatgaagtgatgggagagttttgatcaagcctgtatctttggtatttaatatggggatgcgtagagagtattagaagccataggtacagccacatacattgttaaaatgtgactttttgtatattatttcacgtttgagcaattaccaacttactagcagttgtacaaaaagtaagccattgtgaatttgggatgcattttcacatatacattgtattagaccattcttgcattgctattaagaaatacatcagactgtgtaatttataaagaagaggtttaattggctcatgactctggaggctttataggaagcatggtgctgacatctgctcggcttctggggaggacttaggaagcttacaatcatggtgaaggtgaaggagaagcaggcaactcacgtggcgggagtgggagcaagagagagagagtgggaggagaggtgccacacacttttaaacaaccagatctcatgaaaactcactcactattgcaaaggcagcaccaagccatgaggaatcttcccccatgatccaaacacctcccaccaggccccacctccagcactagggattacaattcaaaaggagatttgactggggataaatatcgaaactatattagacatgaagctgcaaattattatttaattcatattctagcattaggtataccagaacaaggtatctgggtaagagaaagtcgatatgaagggcacaagataatggaggaagacagtttcttctatcgtctagggactttgagccaattcttgggaaaaaaaatagatgatgttgtctttgatggtccttttgttgttgttttgatcctcttcttcaaattcctggtaccttttctttctgactaacagaactctcttgttgtaaaacagcccagtgaaataggtattatcccaatgttacagttgagaaaagggggctcagaaaggttttgttaacttgctcatgccagtataataaataggaaaagccagtttcataatcaagtatgtctggctctaaagctcaccaagtccaacatttttgccttggaatgtgtaagttaacaatgcccccactaacaacatgaagcaatacagaaggaatgggttgagatggggtttgggcaaagaaaagatgagcttggttttaggtatgttgattttgagctaccttggaaagccattttctgttttgtggttgcaagagaaatcgtggtttgttgccctgtgttagacatgggtaaacttagagtgttccatttgctgtagaattagtggaggatagatagatgggatatataggcagagatcgatagatagttgtttgtacattggttgtttgaaagttgagcaatgtctgcagtcactagtcagtatttctattgcttagcaactctatttcctcatgtagccataacaaatggaacttttatatttattttttatgcttaagggtacatagtgctgcttataaatgatgcataagtgacaattttatactgtgagcattactctgactcttggaatcatagaatctcaaggttggacgggaacttaatagttggatttgttctatattcagactgctttacacctccatgaggtcctgactgacacatactactcatttagatagtgctccctatctgaaaagtcttggttttcagataacattttctttcctttaggcaaattattcctgttttacccatgaaggacaaatccaaatatcttgtcttcatgagaactcattgcacatttagaaataggccccatgtctctgccaattttctctttcctgggctgagcttcttctccatcttttcagtggctccttggagagatatattccttgagcgcaggactctttagcccaggttctgggaatgcacctcacagaaggctccagtgtcatcccctgcaggcattgtctcactggcagagagccactcatccatggccatagccttttccggtgtagtccccatctaatgatcaattcagatggggtataaaagctcagttatttcagtccaatatgtgacaactctgacaagccattttagtctcagagctgctcatggggtcagctgagtctattgttgggctgcattgcaacttgatttgttttctgttccttcttgagtccttcccctccctttctcaggtgttcattcccagggcataaacattctgcctgccaactctgatgcagagtctgcctcctggggaaccaagcctgcaatgtatgacttcaagtcttcttatgaaaccattccaatttgtttatggacttagacttctggagtggatagatacctctaggtgtaatctcctgtgtaatcagaatacattttgctttgaagaatattttaaattaagtaagattccacaaatctaatgtgtaaagctcatgcagtagaaagttttcagtgtggatgtcttagcttaggttccccctcaaaagcagagtgtgaaacaaggacttacatgtgagtagtttatttgaggaaattatcccaaggaacagaagtgggagactggaaatgattgttcacaataatctctgtcatttcatagccatagtttttcatcaacactttcctaatgagctcatctttgggatgccaagtgacattgctgtgtgctttcttcaagagatctgagcaatgtagtcagacagccaattaacatttttatttactttgggaaagctttgagtcctgagacctgcatgagatttttctggtagtatttccaactgtctaacaaaacatgtcaaaaatttcatatttgtcgttccaggaattcagcttaataagactacacagaccaggactgagaggttggtggcaaaggaaggagctactgagagccacacatcaataaaatgagatatccaaagcatggaaggagggtcagtcaaggcaatgagggatagactgggatcagttcaggaggctcctcccagaaccaggaatctaattaggagactgaaaagaaaggaagtgaaggggccccaagccagagagccctatgtataaaattatacatgattttatatatgtaagtcgtaatttaattctcacagaaatattgtgaagaatgtgccaatattattatcaaaactatttagcagatgaagtaactgaggcacaaagaggccaaataaattgtccgatgttgcataggtagtaagtggctgagcctgacttcaaacctcgatagacttttcccaaagttcatgctcttctgaatattacttatttctcatgtacctgtttctgaggcagaggttctcatgtattataaatttccttgatgaaagaccaggactggttcagaatgtgtgtgttggagaagaggggtgtaacagatacacattttatagacctccttccatcccatccatctgggcccactgcatcttgcactgcaccactcagggaacttcccccttgcccttgtctgctactatgtatctcggtcagcaagttccaacttggagtttctggctcttcttgccacttcaggacttggatgagatactaagccatggggcacgcaatgtggccccacatgtgttggaagaagccagatgatacaccctggacatgaaggagagttaactccttgtagggtgaaatttgaccagaggagggcaatggacaggagggaagtggctaaattccctcatcttgcactgtccaatcgacttctctgaggcatgagtttttcttctagctcattctttcccttgtcaagtggacacaccagcaaaggacctgttgcgtctctttgtggcttagtgtgaagtgataggcaggatagtgatccttcagttggcattgcttggcatcttttcttgcctcaatttccttctagctcattctttcccttgtcaagtggatgcaccagcaaaggacctgttgcgtccctttgtggcttagtgtgaagtgataggcagcatagtgatacttcagttggcgttgcttggcatcttttcttgcctcactttccttctttctaatccttgtaccctgggtttacccctttcaaagaaagcattaaaggccaagctaagaa

SEQ ID NO: 1290 - DNA, 4282 bp, Homo sapiens
gactagtgtgtctctcccttagtatgttcctcctcagtttgaaaggacttcctggtaaaggactgaaagaaatgtccactccatcatgtctctgctgacacctagcttctcttctccagttataagtccattttcctactggggtaacacaagaaggaggaagaatagctcaggggtcttcccttcacatctctcctacaaggattgtgaaatgtcatatgcctcctcccatagacttagatagacctaaaattgtcaacatgtgtccagatagttgcaaaaaatatataatttccaacatattctccatattaacactttaaaataaaactgttaatcactcatatgttcaattcaatctaaatatcataatgttttgacacccattatcattaatttaaaaaatatacaaacaacctctttcttaatggttggaaattttacattgctcttttttcccactttgaattcatatttttattctaccccccatgtagaatttttctttttctttttttttttttttttgagttctcaaccctggttacatcctaatgtaatttttttctttgttcttggaaatcttttattgagccacctattctgcttctttgcaacaaaatatgttcttacattgaatttttaatttcttgttgtaagtgtaaaagttatatgggctgggtgcagtggcccacacctgtactcccagcactttgtgaggctgaagcaggaggattacttgagcccaggagttcaagaccagcctaggcacatagggaaacctcatctctacaaaaaaaaaaaaaattactggacatggtggctcctgcctgtagtctcagctacttgggaggctgaggtaggaggatcacttgagcccaggaggtcgaggctgcagtgagccatgatcgtgccactgcatgcactctaccctggatgacagagtaagatgctgtctcaaaaaaaagttatatggattaagataggattaccaactgttagagatcaaaataatgtcagtacagattggatatgccttatttgaaatgcttgggaccaaaagtgtgttggatttcagattatcttggattttaaaatatttgtatatacataatgagatatcttgaggccgggacccaagtctaagcatgaagttcacttatgtttcttatatacattatgcacatagcctgaaggtaattttataccatatttaaaataattttatatgtgaaatgaagttgtgttaagtacagtacttacatgtggcatcatattggtgctcaaaaagtttcagattttggagcatttcagattttctgatgagggatgctcaatctgtaatacacattttggtaaataaaagtgtaagtttgtaatggtaaaatttaactagaaatgcatctcttaatgagatggatagggactttattttcccaatttcatgttgacaaatgttacttattgttaatgaatctgggctgtatattatttcaattaaaaaattttaacatgaaagaactaaggaatcttgatcatataaatgaatgagaaaataaagacttgttgaggcaacttcacccaatttttaaaatttcttcttagtcgtatgcaaaactcacataatgggctattattaaataatatttttaataatctgtcagctgacaactcaagtataaggttcttcttcaattttgttgaaagcaaagaattagaaaccaattgacttgcaaaactatttttatacatacattaggttctttcactttgtttttagaactataccaaagacttcacaaagtcttataaaataactaataattatacctgctgctctttcccttagagataccttgttcatgaatctcaaattagataaaactagggttaaagaaaaacaaccccccacacacaaaattggagatcaaaaatcaataggttcttaaaaaatatctcttcattttttatgtcatctggaagtgccttttaaaactatgacacagagatggtgctgtatagtttacagttcatgtgtgtgtgtgtttaatttcattattgtacaaaattgttaattttataatcatgcatttgatagatgtaaaacagtgtgtcagcctccaagcgggagaaattaatccaaaataaatgaagctggatttctaaagtttagagcatcacatccaagattgcatttgggaacattctgttttgtatccatacacaaatgaatttctgtttttaagaacacaatttaatctacttagtggaaatcaacagcaaaatgaagagaaggtattagataattaataaatataggtttacagaaattctattactgactgctattatgtgcattaattacagcagaatccacaaaacatttccatcaaattaaatcttactctaggaggtatatgataaaaataaataaatgaacagagaaataacagcatactataaactgttacccaaatagaaaaatatatttacactatccagaaatctttggtaaaagttaatgaaaatatttcccctattagttagaagaagttcaagaaaacatacattaaaataccttcaatatgtgtttgttttactccaagatgtgatgttgatctgtgagaaattaattttgagcgttttgcctccactgccttgaaataatgcaaaataagcaactgagctgggggcagtggctcatccctataatcccagtgctttgggaggccaaggagggaggatcgctggagcctgggtgacagaataagactctctctctctctctgtgtatatatatatatatttgcaactgaagcacagatgggacacaggtaagtgggagaactcaccaagctctttgttagtatttagagtgtttcatagaaagttaatatttcttaacttttttttttttttttttttttttttacaaatttagaatatcctagctctgagacaaaaattgggaacctcagcatgagtttgtcacctgaatgaaataaaaaaaatcacgttgaaggctggtgcagtaacatgtgcctgtagtcccagctactctggaggctgagtcaggaggatcacttgagaccagaagttcaggaattcaagactggcttgagcaacatagcaagacttcatttcaaaacaaacagaaaaaagccaccaccttcagtatttcttgccaaagcaaaggagccatttgttctttacgatggtcaggaaaggaagcatcaaggtcatcaaatgaaaaattttcagcatttcagcctctctgctcagggaaatatctgaatctagaatatcacaacatgagccaaaaccgccccatttctcatgccacatgtcactcttaacacaaggttactcaacctcgagcatggttggcatttggggctgaataattcttttttgtagggggctgtcctgggcattgtaggatgctcatgagctacctcagtctctaccacccactagatgccagtagcattgacccctgatctctctacccaagttgtgacaactaaaaccatctctggataatggaggaaccttaaatgcatattgctaaggaaaagccaatctgaaaggattacatattgtatgagtccaactatatggtaatctggaaaaggcaaaaccatggagacagtgaaaaggtagtggttaccagtggtccatgggaagggttggatgaataggtggagcacagaggatttttaaggcagtgaaactattctgaatgatactgtaatggtggatacatgtcatacctttgtcaaaaccaataaaatataacaaccaataaaactgcacaaagagtgaaccctaatgtaaactatggacttaataatgtatcaatattggctcaccaattttaacaaatgtaccacactaatgcaagatgttactaatagtggaaactggagggaagagggcttgaggggacatacgggaactctctgtaattcctgttcagtttttctgtaactgttaaactgtccaaaaaaagtctgtttttataaatggaggcatggttttatatggactaaaatactatgattgcctttttattttacacatggtgaaattagagcaggacatattttaaactcaaaattcacaaaattaatttatgaaaatgtttacccagatcaagaatattaaagaaacttagattaatattgttaccttgaatttattttactgagtaatcctctaagactcctctacacattattaatctagaaggatttttaaagtctttatgacaattaattat

SEQ ID NO: 1291 - DNA, 6242 bp, Homo sapiens
gactagtgtgtctctcccttagtatgttcctcctcagtttgaaaggacttcctggtaaaggactgaaagaaatgtccactccatcatgtctctgctgacacctagcttctcttctccagttataagtccattttcctactggggtaacacaagaaggaggaagaatagctcaggggtcttcccttcacatctctcctacaaggattgtgaaatgtcatatgcctcctcccatagacttagatagacctaaaattgtcaacatgtgtccagatagttgcaaaaaatatataatttccaacatattctccatattaacactttaaaataaaactgttaatcactcatatgttcaattcaatctaaatatcataatgttttgacacccattatcattaatttaaaaaatatacaaacaacctctttcttaatggttggaaattttacattgctcttttttcccactttgaattcatatttttattctaccccccatgtagaatttttctttttctttttttttttttttttgagttctcaaccctggttacatcctaatgtaatttttttctttgttcttggaaatcttttattgagccacctattctgcttctttgcaacaaaatatgttcttacattgaatttttaatttcttgttgtaagtgtaaaagttatatgggctgggtgcagtggcccacacctgtactcccagcactttgtgaggctgaagcaggaggattacttgagcccaggagttcaagaccagcctaggcacatagggaaacctcatctctacaaaaaaaaaaaaaattactggacatggtggctcctgcctgtagtctcagctacttgggaggctgaggtaggaggatcacttgagcccaggaggtcgaggctgcagtgagccatgatcgtgccactgcatgcactctaccctggatgacagagtaagatgctgtctcaaaaaaaagttatatggattaagataggattaccaactgttagagatcaaaataatgtcagtacagattggatatgccttatttgaaatgcttgggaccaaaagtgtgttggatttcagattatcttggattttaaaatatttgtatatacataatgagatatcttgaggccgggacccaagtctaagcatgaagttcacttatgtttcttatatacattatgcacatagcctgaaggtaattttataccatatttaaaataattttatatgtgaaatgaagttgtgttaagtacagtacttacatgtggcatcatattggtgctcaaaaagtttcagattttggagcatttcagattttctgatgagggatgctcaatctgtaatacacattttggtaaataaaagtgtaagtttgtaatggtaaaatttaactagaaatgcatctcttaatgagatggatagggactttattttcccaatttcatgttgacaaatgttacttattgttaatgaatctgggctgtatattatttcaattaaaaaattttaacatgaaagaactaaggaatcttgatcatataaatgaatgagaaaataaagacttgttgaggcaacttcacccaatttttaaaatttcttcttagtcgtatgcaaaactcacataatgggctattattaaataatatttttaataatctgtcagctgacaactcaagtataaggttcttcttcaattttgttgaaagcaaagaattagaaaccaattgacttgcaaaactatttttatacatacattaggttctttcactttgtttttagaactataccaaagacttcacaaagtcttataaaataactaataattatacctgctgctctttcccttagagataccttgttcatgaatctcaaattagataaaactagggttaaagaaaaacaaccccccacacacaaaattggagatcaaaaatcaataggttcttaaaaaatatctcttcattttttatgtcatctggaagtgccttttaaaactatgacacagagatggtgctgtatagtttacagttcatgtgtgtgtgtgtttaatttcattattgtacaaaattgttaattttataatcatgcatttgatagatgtaaaacagtgtgtcagcctccaagcgggagaaattaatccaaaataaatgaagctggatttctaaagtttagagcatcacatccaagattgcatttgggaacattctgttttgtatccatacacaaatgaatttctgtttttaagaacacaatttaatctacttagtggaaatcaacagcaaaatgaagagaaggtattagataattaataaatataggtttacagaaattctattactgactgctattatgtgcattaattacagcagaatccacaaaacatttccatcaaattaaatcttactctaggaggtatatgataaaaataaataaatgaacagagaaataacagcatactataaactgttacccaaatagaaaaatatatttacactatccagaaatctttggtaaaagttaatgaaaatatttcccctattagttagaagaagttcaagaaaacatacattaaaataccttcaatatgtgtttgttttactccaagatgtgatgttgatctgtgagaaattaattttgagcgttttgcctccactgccttgaaataatgcaaaataagcaactgagctgggggcagtggctcatccctataatcccagtgctttgggaggccaaggagggaggatcgctggagcctgggtgacagaataagactctctctctctctctgtgtatatatatatatatttgcaactgaagcacagatgggacacaggtaagtgggagaactcaccaagctctttgttagtatttagagtgtttcatagaaagttaatatttcttaacttttttttttttttttttttttttttacaaatttagaatatcctagctctgagacaaaaattgggaacctcagcatgagtttgtcacctgaatgaaataaaaaaaatcacgttgaaggctggtgcagtaacatgtgcctgtagtcccagctactctggaggctgagtcaggaggatcacttgagaccagaagttcaggaattcaagactggcttgagcaacatagcaagacttcatttcaaaacaaacagaaaaaagccaccaccttcagtatttcttgccaaagcaaaggagccatttgttctttacgatggtcaggaaaggaagcatcaaggtcatcaaatgaaaaattttcagcatttcagcctctctgctcagggaaatatctgaatctagaatatcacaacatgagccaaaaccgccccatttctcatgccacatgtcactcttaacacaaggttactcaacctcgagcatggttggcatttggggctgaataattcttttttgtagggggctgtcctgggcattgtaggatgctcatgagctacctcagtctctaccacccactagatgccagtagcattgacccctgatctctctacccaagttgtgacaactaaaaccatctctggataatggaggaaccttaaatgcatattgctaaggaaaagccaatctgaaaggattacatattgtatgagtccaactatatggtaatctggaaaaggcaaaaccatggagacagtgaaaaggtagtggttaccagtggtccatgggaagggttggatgaataggtggagcacagaggatttttaaggcagtgaaactattctgaatgatactgtaatggtggatacatgtcatacctttgtcaaaaccaataaaatataacaaccaataaaactgcacaaagagtgaaccctaatgtaaactatggacttaataatgtatcaatattggctcaccaattttaacaaatgtaccacactaatgcaagatgttactaatagtggaaactggagggaagagggcttgaggggacatacgggaactctctgtaattcctgttcagtttttctgtaactgttaaactgtccaaaaaaagtctgtttttataaatggaggcatggttttatatggactaaaatactatgattgcctttttattttacacatggtgaaattagagcaggacatattttaaactcaaaattcacaaaattaatttatgaaaatgtttacccagatcaagaatattaaagaaacttagattaatattgttaccttgaatttattttactgagtaatcctctaagactcctctacacattattaatctagaaggatttttaaagtctttatgacaattaattattggtctacagtcaaattgcgtatccccattaactagagttatatttttccattttctgatccaaaaactttaggaacaggaaatgtttattttagaaaacaagaacacttcttaagcatttgctgttaacagttattttcacatgtgcttgtacttattttacacttgtcagaacatagtatttacctttgaaccaaggttttataataagcaagcactttttttatttagaagtcacattttccaagtagaaaaatcattaaaaattcagtcctctgaaggctaatttctttaaatcatttaacctaattgtttaaggtatagattggaatttttctcagcactctcttgaaaacaggtgacagtggaaccctgttaggttcacaaatcctagactttgattatatagcccaggctcaaatttttctcgaatgttacgaacattcaaagcattaggagtcttggtttcatttcttaattttttttcttctgggtatatttgagactcatcttggattcaaataaattaataatagtctcatgaaaccgataaaaatgggagctccattgaacatgagagacattgattcgtagtttctaacatcctccaaatgaggagcccatccctaatttagatgcttctttcaaaggaggctcctttccttcgttatccataatatagtcacaccagtcctgaaaaaacatggaacagactccagatctttatatttcatactctaaagtcgtacaagccaatctgcatttcctctagtggaaactgtatagctggtcatctttccaggacccttttatcaagaaacaatgcagcttctacatttgtgctgcttctacaccaaaacagctggaatgtatatagtatggttctggatgctcttgtatacctcactcttcatttctcacctaacccatgtgctatgatttgaatgtttctcccctgcaaaactcatgttgaaatgtaattgccatgataacagtattaataggtggaatatttaagaggtgattagggtgggattggtgatgttataaaagggtaagttcagccccttcttgctctctctgtcacccttccaccttcctctgtgtgatgatgcaacaaaaaagcccttcccagatgccagcatcttgattttggacttctcagcctacagaactataagccaataaatttctgttatttgttattagtctgtgatattctgttacagtagcacaaaatggactatgacaccatgtgtttacacagaaagaaaaaaatatcatacggtaattgctcctaaatatgcagagaatatgttctgatatccttagtggatgcctgaaactgcagatagtaccaaaccttatatatactatgttttttttcccatacatatgcatgttaaagtttataagttaggcagagtaagatatgaacaataactaataatgaaatagaaacgtaacgatgtgctgtaataaaagttatgtgactgacgcctctttttcttcctctttctttcaaaatatcttaatattttcaagccatggataactgaaactgcagaaagtgaaactgtagataaactattaactctatttaaacaataaaagaattataattatattcttgggaaaattaacaattatccaaagtccctttgcaaagggaaaaaaaatgcatgtattggaaaaaatctcaaccacagggttccctaagctttgcaaacaacaaatagcatccacctatccatcctcagagagcaacagttttactgttatttagaaaaagcaactatttcaggctgcaggttgtgcacatcagcacttcccagctctctactaatatgggaaaactgactatccctgacttcagtttttgtgaagctaaatgcctgactagagtttaaactgaggctaattggagatcataaaattttacagcttgctagaggtggac

SEQ ID NO: 1292 - DNA, 30940 bp, Homo sapiens
tctgctctttctctttttcccatttaataatgaactttctacatttcagtatttatggcttttatttttacaaattgttccattagttattttctggtttactttgatattctctttataattctttgaatatttacttggctattttaagacattcttttaaaatcgggtcttttaaaacttctactcttttaaattcactgaggtgttgtgttttggccatattcaggaacttgcatttataaaagcacccccaaatttttgaaggtttccttaaaattagttacactattttctcttttactccttaacgataaaattttcaacatgatattaatacattcactgctaaaactctcacacttattgtttatatttcccctgataaacagatacacatcgtcccatgaagtttgtggcttgtcagaatgggatcacaagtctctttctttaaaacccatgagtccaacaccacataaattgtgcagagtgctaccgaaaattcagttacttcattctattttgtgggcttctggctgtaaaggccatgtcactcttcaaagaggctgatatcctgtagccttgggaaaaggcaatgtctccttaatgtttctattcactaaagtatcttgctcaaaccctggacactgcagattctaaaacagtatagattgtaggtgtctggtgaaacagtaggcactaaaacttagagaaatcacagttaaattcatcttgtgccaagtttaagaacttaaccctatcaacacggactcagtacaacgcagaatatgtcccacagggggttatgtggggcacagtatatataacagggggatatgtgtggtccaggaggtgagagaagcagggagagaagcaattgttgcattcctttgcttctgctgggcgctctgtgatgctatatataaaataaggtaagtgtgcggttgagtgggtagggagaaaggtgaggcatcttaaggcctggtggaaggtgactgatttcatcctgtctttgttatgcatctgataagcaggtttataaccagtacctgtcagtgttcaatatttaacaaactccagttaaacaggtaagaggtcagcagtagcttataggccttggttctattatccatgtgcccaactgcagccatcgtgggctggtgttaaaattttcctttcaattgtcatttttctaataattgcaatcagtgagaggagaagaaaaagttcaagggaatgacctgacctttcaccatcctacacaggagatgactgatgacatggattcatacactaatgtatatcgtatattctccaaagaccctcaaaaatcacaagaagttttgaaaaattctgagatcataaactggaaacagaaactccaaatccaaggtaacaagtctgaagaaatgggcaagcagctgtgcttctcaaattgtgtcttcaactaacagcattagcatcacctgagagctcattagaaatgtaaattcatagaaactctctgagctgggagaggtggagcaatctgtggtgtgccaaggactatagctgattgtggtgtaaactcaactttgaaaactactaagcactgaggtattaatcaggtgggagcaatgtaagtagagaactgcatgtctgacaatattgctttcttggctttctctcaggttttcaagaaagtttaggtgaggggataaaagcagctgcattttcaaattcagtgaaggtagagcattcgagagcactcctctttgttacggaagatatcctgaagctctatgccaccaataaaagcaagcttggaagctgggctgagacaggccacccagatgacgaattggagaggtacaaaaaacatgtgctgatcatttataattgctattccttgtacatttttgtaattcacataaatcagttttggaatgaagagacgatgaattcattccttgggatgaataaaggttgtcaatggtcaaaatacgccactttgcaatggtgggtcttttaacaagaagagggcctgggatctctagaatggaagggcacctagaaattacaggagtggggatgaaagttgttgtctttctttttgttttctacagcgagactcccaattttaagtatgcccagctgaatgtgtcttattctgggctggtaaatgacaactggaagctagggatgaataagaggagcctgcattacatcaagcgctgcctaggagccctgccagcagtctgtatgctgggcccagagggggtcccggtctcatgggtaaccatggacccttcttgtgaaataggaatgggctacagtgtggaaaaataccgaaggagaggcaacgcgacacggatgatggtgcgatacatgaagtatctgtgtcagaagaatattccattttacggctctgtgctggaagaaaatcaaggcgccatcagaatgaataaggcactaggtttccttgaggcctcctgtcagtggcaccaatggacctgctacccacagaatcttgttccgttgtagacaatgaagctgcttagcaatcttgggcaagccatctcttaatattaaagcagacaccacagaatagctttcttcacttacaaatgttgattgggcatttatgatatggcaggaactccttctcacatggagacctgatgttaaaggacacagccatgctcttgaggagcttacaatccaagctggaggcaggggagggtatagtctttaaatatgcttaagtgttgtagggaaggacagagttaccaataaacatgtaactagaaagccaggctcagttcttacctctgggaatcagaactctttatgaaacttgattgatagaatctactatctggaagataattgaagaactttaataaaattgtcaatagaatatacctaatctatatggatactttattggaaagaaatacccctgctatgtatagatttatgaggcaatggctatactaaagaatggaatcagtctcttagtttagtgactagcaaggtatcaaaggtgaagcctcagacaaatggctttcctaggctacctttcatcattgttatgcagaaaaggatctccagagaatcaagtgggctggtcttgcggcctctgctatggaaatgacatttgttgtgcctcctttcccctactctttctcacttcctcatcattagtgaagcatggcacaggacaaggtgttgcctgtgagtctggttataaattcagcttttgatgtttgcagcactgctatcttaaggggtcaagggcattccagggagaagagaccactaaggtgaagactggagagtgagtaagagtgagccatacagtaaaagtggaaaaatccagatgatggaaagggcacgtgccatgcactatcataataactttataattgaacacttatattacaatctgaatccctgatctcaaaaaaaaaaaaagaaaaatactcttcatgaaaaaaacgtggcctcatttggctctgctctcccaccctgtcattggagcttggattactgtgaacattgtagccacagcaaaaagaaaaaaaaatggcatttttactccttctgatagtctagattttaaaaaaacaaaagaaatcttaatagaattgtcttttggagtaaagtctaccagtattaaacaacacctcatctctccataaaaaataaacctccacaaaattgaatgtttatacttgatgcgatttgaaagtgtgcaattccagcacctaaagaatagtgtaggtcatggagtttttaagaaactccaattcatcttagaaggctatggtagatctgttacatcttagtataaatcaatccaatcagatttctaaactcctgagacctggctgatttgttacattgactgaaatgaaagcatggtctgagagagagagtaaacatgtcatttgggatttcaaagggtggaaaattcttacctaaaaaataaactcaggaacttggagtcatataaaaacagctatattttggcactcaagaggcaaaagctaatacagatgatgaaagaacacaaagaaaataagatttgcctattcaaaatggtgcctcgggcaggtcctgtatccagaagaggatgttcatccagggtctggggctaaggtcatcttagcacagcccagctgccagcttccctcctctgccgcttccctgaacacaagccagcttcccttatctagcccttcttggccctgttaaaaaagtgattcctaaaccttatcatgcacttggattgaaaaaacaacaagaaagcatgggaaagaggaaagaggattccttaaatatggcacaagtaagtccaacattatcaataaacgcactaaaaatgaatggggtaattttcttattaaaatatatgtttttcatactgagttaaaaacaaagtccaaaaagcatacatctctgtgccctcacatggtagagacagaggagagctcagactctcttccttttcttagaaggacttaataccatcataggggctccacccttatgacttaatctaaacccaattacttctcaaaggcccacctccaagtccattgggagttgggtcttcaacatatgaatttgggggtcactgtcagtacataagaaagcatatctgaaataacacacaagtgttcacggaaaggaaaaagatatactaaatgaatgtgaaactgaaaagcaaagtaataccatcaacacttggcaaaatagaacgtaagttgaacatctgctaaatacagaaattctcccacaacatagatcatgaatctgcctcaacacaacacaactacaaactatacatggcaaaagctgacggacatacaaaagaaaaatgcaaatccacagtctcagtgggagaactcaaaaaacttccctcagaaagcaacagatgatgcagacaaaaaataaagacaatttgccaaaatgccatcacaacttgatatttctggtgatgttggggttatctgcttactgtgtatttgagaacttctgttcacctgcttgtcaaactgaccagcagggggtgctgcggagggaaacactccatctggagaatgctggcaacttgtctcttaagtctagaggctccttgtccccctcatgatcatcacctatgaggtgcaagcactgctgatacaggagctaaaaagaaattattaagcagttagtgtaggtaagagagtcctcggtaaggtttttcttttaataaaaagcagcccccatataatttcttttctagcaaaaatcagcctaaaaaatcaagccacaagcatacataagcaaactaaaaacttgcatagctaaatgctggcacctatgcaaatagaaaagggatacttggaagccaggcatcctcaacatagaggtttcctcttcctatttttttttgtttgtttgtttgttttttcagatggaatcccgctctgtcactcaggctggagtgcagtggtgcattctcagctcactacaccctccacctcctgggttcaagcaattatctccctcagcctcctgagtagctgagattacaggtgcccaccaccacgcatggctaatttttttttcgtgtttttttttttttagtagaggcggtgtttcagcatcttggccaggctggtcttgaactcctgacctctcgtgatccatcgtccttggcctccgaatgtgctaggattacaggcatcagctaccacgcgtggcctcctattcccttttctttgtattcacgtgtgcaggcgacatggcacaggccaggtagaggccccgtttgcatactaaagattcatgtgggatggccaggctcttcatgcatcacataaatggcacacctgctccaaccaaccctctgagccctatgtaaatcagacactgcctcctcaagctcctctataaaaccaaccacaactcgccccaaacccggaaacctgctcaggcacctttccaatgcatgaggaaactctctcttcattcttttgcctattaaacttttgctcttgaacccactcctttggtgtccacatctcaatttccatactgtgagacagcaaacctctggcatttccccagacaaacgatgccgcttcactgccatctcaagcccaagtgccaaaaatgaccactttagtctgaagaatgccacagctgccaccatgctgcttaggataagcaaggacatgaagatggagtggggacgggtttattagagaggccgcaataaaagcatatcccaggcaactttccacttcttaacttctgtcattttcaaacttaaaggtgttttttattgttgttggtttgcttttctttttaacagtttctatttctggccaaaagactgctttttgttttcctgctatgacatatttattctttgttcaaaagtcttttccatgatttcatataggaactaagaagacagccatgtgtttgctcaacacattgatcccctctccacctagaactctctttactgtttctcccaggaagattccacccctcctgttctgccagtttcctcatatttgcctcatacaattgcccttgtaggcagatgaacccgggctagttctactttactatggacaccaaagcttctgaaataacatctgagtcttgggatttgcatatgaatcttcccttgacacagcaaacagtctttccttttaccttcactaaagtcatctacttgggagaatggagagcactaaaattctacagatttcaaaaacaaacctgctgtgcctttccagagtccttggaatgcaaaagagaaaataggttagaagggatattttctccttcctttcttaccttgaaggagctcctatttttaaagggaatcattggggacaatccaaaagaaactcttgcaaatcaagctttgccatgccatcacgagaagggtaacatgtgtgcccagtggtgaaatttttaaattttggtaatgatctccagggtcacccctatggataacaaaaatattttaaaaacctataatggtgccagcctttcagaaccctgtctctttgcaaggacctaccaaggtctagagatcatagcacctcactagcagcctacaggcattctccaaaggttcccacctgccccacccaacatacacacacacatacacacacacacaccctcctgctatcctttggccctagatttcacctaactttattctaaatcttaatcaccctgtgcccccaaactcatgtgttatagggccttggtaatccctttctaagcatattccctgacttcttaaattctatttatgagacatatatctaaagtaaaactatatttcaggccagatcagcacgcttcttattacaattataaacactgaacttcttagttgctgggaaaatatattgaaaaggcattattatgcttgtatagccatagattatctagggaaaagtattgagtgtctcgagaatgagtgaaaattgtttccccaatatacacctttttttcttttgaaaagtatatcctgcgtatattcaaaagataatgtttttcaaaaggggaaattgcctccactgtggactcttattaattcacttatccatcaagttctcttattaactcacttatacatcatattcccttattaactttttattcaatcactggtatttgtttctagtgctcataattgaacacaaatttgtttactattatataaaataaagtaacagctattcaccgtttcctcctttacctcaataagttgacatcttccaatagatttatttccctgttttgctccctcctcagatccagatgagtgtgctaagtgatacaaaatgcttttattcctctaccgttcaaccccctgagcccgatgttttagttccacgtgttttagttccaggtgtcacagaatttcccttgcagtgtgtctcatcaatttaaagaatccttctttaaaacttttcttacacattcccagagagcctatcattgtccatttagagttaactctctacataaaatttgtcaatttttttttactcaccactgtttcctctccttattttctgctcctatctgaaatctcttttcctatttgattaaattgcttcttcagtatttcctgcatgtacatatgctaccgatataatatctgaagactctcaaatccacaaatatctttctttgaccctcacaagaatataatttctgcagccttatacattgacaaatgtttgtcttttaccctcaagtgactgattccctatgacatcacattttaggatgaccaaatataattttccactttatacataaggaaactgaggtacaaagaaacaaggtagccttgaactttcattcaaggtcacaaagctagcaaaaagtggatgactagcgatgaggtcttcaggttgagattaacaaacaacatcacaggatataataggatttaacccaacttcaacttcataaaatgaatggacattccctgatcttccctccactcccacccccacctcaggggatttcaggatgcactgggcaaaactgtctccctccatccccaaccgtttctcaggcagtgacaggtgtcaagaactcctcgccgcccttcttgaagcttacattctggagcagggaggcagaagctaaaccaaaaattaaaacaactgtgaacatattccctataaactcagatgtagtatatgaaaacaacacatgatttgacgacagaagatgatggagggagaaagaacaacaaataaataggaaaagaggcctcagataggagcaggtaaaaaggagagaaaacaggaaggggtcaggactggtttccctcaaagcctgtcatttgacagagagctgcagaaagaaggaatagagccaagcacataacaggagggtagagttgcagtctgaagcacccaaaatggtccactaggatggacaaaggacatacttgaaccaccacttagattcatcttcatctaaaaaataagaaattaagtgtgtgtaatatttaattatttagtacattaattacagtagaatatatagagttgatgctcaatttgttaaaaaatagatatctaaaattaaacctcagagattactcttgcctatgacaacgagcttctgaaaggcaaggataggtctcacccatctctgtatcttcagaatccatcatattatgtggaacataataggtatcaatagtatgttggggaaaaaaatcgaaaccatgctgagcaccggaattctgtgtaaatctttttaaaaagtctcttctactttacatcagagtcccttttgtatttttagtatcatccagccccacgccttgcagataagcccctaagaaatgaatgggtgaatgaatgtgtggacagcgggatggatcattgagtgaggagcagtgattcgcaggacctgcatgcattgaaatcctgccaaagcagcctctgcaaaataaaagaccttgggctttggtttctgacacaagttaaaattatccaaggactctccttgggccacttagttgaggtttcctaatctgtgaaacagaaaatgaattcaatagaaagatgattgagacaaatttctggaaggtgccaaagcaggatgcctggcattgagggacgcttcacacctgttatctctctccctattctctcttcacccctactcccgcccggcaactccccgctgtcagctccaggaatacttacctgctgagaaaaggaaaagcacaacactgactttaccccgcgacgcttttaaaaactccaaaacacccagcgcgatggggagtaggtttccctaaagacaggtggagcagccatagttaacttagaggaaggtgaattgacaaagagggttgagccactacgagcgggagttaccttggactaacagttgtatcttcagcgagcacaagtcctggaatctcccacgcccatccctttttttagcgccacaaatgcagcctcctaagagaatgggaagcttgggagtcagagaacagaagattgagctaccattggccttaatggatgtcaatcttcacttgtctcttttttttccttcctcgcctccttgcccctccctatcccggtaggcgcgttctctggcgccatcatatggcagaatgcgggactacaccaaatgcggaaaggcaccttccccttccctgagtatctgcaaactcagggctgggcttggtttttaagagctcagctcctgtgccaggggcggtgctaaaaggggctgcctgcgcagatgtcattcccacaagatgcaagtaaagaagcaccgcggacaccgggggagggtcacagagtgacaggaggactggttgaccagctgactggcctcacttctgacaaatgcaaattacccagccacagtccaaccaagggtatcaaaacaggatctctgcagatggagctcagtgttatgtgttttggatgctcgcaataagattttcatgcaccataaactttcctgagtatctcaaccagttttgttgatgccggggtttgttcaaagctgcagattactgggcctcaccccagacctactctacttaaatatagtggggttcccataatccccattttaaaaaacctatccaagttaaagtacagagaatcacaaactggaagaactccttaatttacaaataagaaatggagacccccccaccaagagagaaaggaatttgcccaaggtctccctgaaagagcctaagaaagcgtgaggctctaaggttaaaatcctacctgacaccctttcctttccccaactagtcctgtgacctctagcaaactatcctgtcctaatctgtgaaatgggagcaacagtcacacctaccccaactggtgactgcaaatattaaatggggccacaatgagtcaactaccaagcaccaccccattgtaagttgaggttgaaatgattctagatcgccctacccccattcatctcccagtaccattgtatgaccgtggaggtgaaaccatccagccgcctgttggtcccaaaccatgttcacctccacccgtggctcagtgactatttcttttcttgaagagagagagaggctccttggagcctctggaatctggagggggatgttaccttccccctgtgtgcattgtcttcccaagataggatggactacggggtctccatgtgaagagttagctgccagggcatcaaggatggctcctaagtggttgctggaggcttagagaccccactccagctctctctcaaatgggggcagcttgtttgcagcagtgagtgaggtgggcccactacgaacccacaggaggagaggaaaagaccgtcccatctaagcttttacataacccattgcaagctccagaatgtggtgcccaggcccatatctataacccacccccagaggccagttctcctcagcctttcctgccacttctgccattgtacatccagacacttcccctgttctcttctatcaaactcctactcatctctcagccatctagtccaaatattaatctttctctgtgatatactctcagggtagaggcagtggtgccttcctctgtattcccagaacatgttgtctgcaactctaaatacagacatcatcctactattagggttcaagagcatcttttatgggttcatgaaggaatcactcttcgtaaacactggccttattccctaacttcaccagacctgaccttagtgcatgatccattcccacctctcccaaccacatgagaggccttttcctctttatgggtttgcaaaccacaatatgacctaaccaccagttactggccaaaagcattcttgtcacgtttattataaaatccagccaacaagatgctttgtgccaagggaatgttccttttcagggcaaacactctgtccccagggatgttagacaacttccatagccccgtataagcattagctagaaatgagtttttcctagtggcccaacagattccctgagcatccctactctttcacggattcccattgcagtgggattgcatcaaacctctcagggcaaagctgcaaagggaaaagcaaagctagagctctactctggacctatcgctctagacagttagtttctctgtgagggtcagttttatacgtaaggaagaaatggaagattgctccccaaaacggcatcaggttacttatcccaattgtgtggttcagttgctacgccagtgatgagcaaataaacaggaagtagaagcacaactattcctaagctcaagaagcagggaagctcaggaattggtgtgcagcagtgctgcttggagcgccattacgaaggaacaagcacggtccactgggaggtaaaattcagggaatcgaagacacagggggtatgggaaacaaggcaggcttttttatttatcatttgccatgatatctctctgtgaactttcttctcccttttaattttccctgtactttaattataattcttaggcctgacgtggtggcttacatctctaatcgcagtactttgagacgctgaggcaggcaaagcaactgaggccaggagttcgacccagcttggccaacatggtgaaaccccatctctattagaaaaacaaaactcagttgggcatggtggcaagcacctgtcatcccagctgctcaggaggctgaggtatgagaatggtttgaacacaggaggtggaggttgcagtgaatcgacatcatgccactgcactaaagcctgagcaatagagcaagactctgtgtccaaaaaaaaaaaaaaaaatacaaaacttctcagctaatggccaacattgaaatacaaaacttctcagctaatggccaacattgttaccatcataagtcccagcttccctgtcttcctgtcatcatgtgttgaatgtccacttccctccttatttttcagttggagtggattagcatcaccaattcaacatgtcacaagtagaattacacaaacacacataagcaccgcaatcctggcacacacagcatctctgtcctcagacttccccatccttctagttgctcaagtcaaaagcccaggaatcatcattgagccctctgtttctcttatttatggaccatccataagcaaattccatgggctggcccttcaaaataaatgtggaatccagccatttctaacacttccaccattaccatctgaggtcgggctccaacatctttgcaatcctgggatagactcttagctgccttctcccttccacatctcttcttgtcctcccagagtttgtaccgcgcacaaacgctgctagggtggttttaaaaaatatgtcagggtatatttctcccttacttcaaatcctccatttaaaataaatttcacatttatagccaaatccagacttcttcatatggcccaccaggggctttatgctaatggaatgtgcagatgctcctccctgaggagcaccttttaccagggcaaattttctatctccaatgatgtcaggcaattccgacaacaccattctctactacctcttggttttcatagatatttttcctccagattctacaaaaaaagaagatcaagtctccttgtgcaatgatttactctctgatgtatattggtgccaggcacgtgtactgctttcagatgattcaagaataacagcgatttgagaaagctgtccttaagttttctcttctccttgactgtatgacattatttttacaattatacttccaaagtttgctctttccaaacaccacaagacctatgtaatttaagcagtgattttaggggtctctgtatattttatattaatttcagaaacatgctcatgattattccaccaaaactatcaactgttacataaacatctgtccttctatgagttgcaaaataattgtcaccatccccacttaatcaaccatcttgtatccttctttgaccaacttctgaaaaataacacccaatactaaaggcatctccttctattcagggtctcagacagtaagacgttctttccttaaacagtaagacgttttctcaagtcccatggaaagcacttctttgatatcagtttggggaggccgaactctggagtcttcatccgaagagtaaagtaccgcactcagtaatgcgcgtcctgggaaccaagcctaagcagttttggccgcttcctcgtccaggctggcattgtctgtgttcgccagcccctccgcgaagttagctcatttgcggatcaggccaaatccctggagacttcacgcagacgcgggtgcagcctgctctgggacttgaagtccgctggagcctgagcctctgcatcatccgggtggagctctctctgctgctgccaaaggatcccgcctggatgctcatcccgccaccgtcgcccaccccgcagctgcagaatggcagcaactgccacacacctaagcaacttggctggctattcgccctgcagctcccgccagcgcgctgcccaagctggcaatcaaaagtctgggaaagcgcgaaagcgccacgtgcctcgcactccgcccagctgccgcgcagctcctccctggcttccactgggagacaggggactcccatgagaaggaaggagcagggcagtgattgcttagtttatcctgggacgcgggagctgtccccgtggactgagtggcgcggagaggggatcactgagaccgggaagggtcatccagacaaataaggaggggtgcgggtgggcgcgcagtgccctccgcccggccttcagacccacccgcgcgcgcgcaggcgtgtgctctcatccttcccttcccttcactgtctggagtgatgataattggcttccaaagtggatgagagatgagtcatttacatccaatgagggaaaaacagcctccagagactcttcgtccattggccagtgagagtgtcaattcccaggctcctgccgcacgcgggcgagcccttctaggcgggaaaagttcagctgagagatataagagagcagactttccagcacctgtgaatccagagcggtgggcactgacgggcacgtgcaccgtgtggacagactctccagttctatgagtggtttttcttttcccgggtcggacctggagttcttaagaggatggctgacaagggcagtaggcagaaggacctcagcccaaagtcaaggaggttttggatggggagctgggcagccgcccgttgtaattcccttcccgtctcagcttcaaaggccaagagttgtactcctgaaaagatacttggagatcatctgggtgttcctgaatctcaagagggtcgtttgaccctggtgggtcctttccctacccggtgcctttctcgcccgtagaaggagaccaggttcggttaagcagagcagaaactattcactgatcaaggaatggagtaggagagctcctgctcaaagtgcctggggtgtagtgtgggggtgctccttaaggtcttttagggcacgtagttggaaagcaaggattcctggaaagagatggggctttccagaaccagctgagtgtggcagtctcctatttgctgttgccgcccaacactacatgtgcctagcaagctgcatttctcccgtaggcacagattgaggtatggtaattagcaattgaggattcaggttagggtagcgcttctaagttcgtttcccatcttgtagcacggtggttactgacatccagtctctgtttctgtaagcaagcacagcttcaagcacaggttaccttaattggttctggggctttaggaaagcattgaggtcatcctgcggtgacagaggcagctgttcaaagaacttggtgcgagtttgaggcaggggttgtggagtgaggcaggtaaaaatgcagattccatagccacaccccgacatactgaatcagagtctgtgagggtgggatctggaatcctttttaaaaagctcagaggaaccaattcacacgaacaataaaagtttcatctgagccaaagaccttaatctagaaatgagaaaacggggatccccaaaagggttacagggagagggttggaggaaagttagactatgacagttttagggtggttctttcctggccttgggaagttttctcagctgctgctctgatcagtacgcagctgaatgctttaggggaaccctcttcatatatccggagttccctctctgtgcaggtctcccaccagggtctgtggcccgtgacctcttgccaccctggtctctccgctttgtctcctcaaatctagaattccaactggctttgtcttgctgcccttccttgcgacactggcctggaatccttcaagttagtctgctagcgtggattgtaggatgcatctcagttgtcactatccttaattgcatgatgtccagttcctcgcaaagcgttgtttcatatattttgcccatttttgttttgttttgctttcagactagggggaaatccagtccctgttcttccattttggccagaaattcaaggtaatgacttttaatatttctgactactagttccatcatctctctcacttctggatctgtctctattcactgatgttcctagtcattatgggtcatatttatccacttcttaaatgcttgctgattgttttattagatatcaagctttgttaatttcacaactttgggtgccagaaatttttaccttcccatcaatattcttgaactttattttagtaccttgatattttacatggaaaccattttataatttcaaagtttgcttttatttgttaggtgggagcagaactagggctaattttgtcccactgtggaagaaatacctttcagagtagtctctctgatatttcatgaattgtgaaattttctagtcagatttttgtgaactgaatctattccctgtcctgtatgagcctcagaaattgttacatctgctccttttgggtacttctttttcctgttccttttcaacagctttattccactcatgcattgaccaagctgaaatctcaagggatacccactgcagatctctgatactatgtgctcctgtggctctcttctccctagtactctgccatacaagctccagtcagcctggcctcccaaaactccaagcttgtcttctcaactcagggaaactgctagactctgcctgttctcttgcctaagatatgccttggaaactccatacagtaacctaaatagccacagggcttacctcatatgattttcttctcagatatcagagatgaggtcccacacagcctgatgtccaatgattgagagttgttatttcacagatctttcctttttgggttttttttagacatttcatgtggcagaatgaactcaatccttgtttctccatcttatccactagtaaatattagttatattctcttcgaattcatcatgaattccatgaagactgaagaaaacaagtcacttagtgccacaaaagatgacccgaggactagacctgaagtttcaaaggtatatctacttttttacaactcctcagaggagtgatagtctaaccatagtgccatatgaggttcttggagataagttcttaaacaatggtcgttataagcctttctcttaggtagtttaaaatatatttgggtagctcatacacataagtgcttgtggaaagcataatgatagagtatgagttaataatgctaaacgtgtcttaagacaacaagatgactaacaaataatatagacacttaaaatcatggaaagtatagacaggcaaaaataattagctaatgttttctgaggaaacactgtgtgcctggaattgtgtcccatcatatggattatcccatttaacagttaatagaactgtgcagtagttattatcatacttattttacaaaagaagaaactgaagctcaacttgcttatagttgcagaagtaacggacttcaaagcaaggatcttaacctaggcagtcagactacagagactggtttttgacccacactattttgctcaaaatatgcaaaatgataatactaaattgagatataaacaagtgattttagagtacagagagaagaatacttaattcagactaaggaaactacagcagcatcatatgagaaatgatttattaatgaaaaataaatctaaaattgtcaaactcatagatgtagaagtggttgctgggctgggaagagagaaaaatggaagtgttagtcaagggatacaaagtttccttacacaaggtgaataagttgtagggatctgaacagcatgagtgccaatagttaacactattgtgcactcaaattcttgctaaaatgatagattttatgttgtgttcttattacaaaaataataaataagagggcaggaagagactttgggaggtgatagataggtcgatgtcatagaatgtggtgatcatgtatcttcacattcatcaagttgtatacactaattatgtacattaattatgcatttggtatgtctaaaactaatttattttttaaaaagaatgaataacatttcactagtgtatcaaggatgaaggaatggcctgagtaaagtcatgtacacaggaaaacatatttggggaacaggatagctgcatttgatgctatgtaaggagaattcaagaatgtggtaggcaaataatgctttctatactggtaaggtagtgtggtgccaagatcacagtaggctttatatcaataagagcttttcatattgacagtaaaaatattttctacttgtgaaacaataaaatggattcattggttcacctgagtggacattccagaattcagcagagctcttaattcagtagtatacagtttctttgaggacttgtttgtgtgttcagtctctatgttctgcttttcatgttatcccctggctggctttctgcatagtgacaaatacagctgcagtaatatcggatgtgttactctcccgataatgagtctaccctggtttcctgaggaaacttctctttgccatcttattgtcccaacttaagtagctcacccatttcagcacaaaaccttgtgactccgagggcacatatagatattcttaagctgtcatgaattcatttccatacatgtatggctcctaaaaagtgtgagagaggtagaatagctttctggaaaatagctgcagtatctcctacttctttgaaatccatgtgtaggtttttggattttcttctgtaaatagaggagacgcgtttgccgactttatctctgtatcgcttaggaggagttatttaattcactttagactttgttaagttaaatattaatgttaaaatgcccagggctattttgttcaagacagttgccactaatcacgtgattttttttttttttttttgagacggagtctcgctgtgttgcccaggctgtagtgcagccccacgatctcggcttactgaaagctctgccttctgggttcacgccattctcctgcctcagcctcctgagtagctgggactacagggatccgccaccatgcccagctaattttttctattttttaggagagacggggtttcaccgtgttagccaggatggtctcgatctcctgaactcgtgatccacccacttcggcctcccaaagtgctgggattacaggcgtgagccaccgtgcccggcccacatgtgattatttatattcaaatttaaattcaacttaactaatatcaaataatgaaaaaggtgaataatacaaaatctcagttgcactaatcacacgtcaagtacttaagaaccacctgtgacggtagtattaggcagtaccgatgtagaacatttccatcactgcagacattttattgggcaatacttgtttagggcatccaattatagaatagaactacagtgtaaaactgccaaactatttgtctagaaaatagaatgagaggaaaaaatcaaaataaaggaggcaacaaagcaaaggtttataaattgtgaaaaagtggaaaaagtaggtgatacaaaaaaagatgatagaaataaacgcaaaacacgctacacccaattaattgtcttacagattattcgaaagactttaacttttcttgtttcttttaaattcatttatttcatatacagtaaaattcagtctttttggtatatagttcatgtaaccatgcctacagtcatgtaaccatgaccaaaatcaagaagcaaagcagtttcatcacactaaataactccttttgtggttccatcacaataaataattccgcgttctccccactcatcccctattcaccctagtccctcgcaacaactaatctcttccttactctagtgttaccttttccagaacatcatataagttgaacatacactgaatcatacactttgagtctggcttctttcacttagaacattccacttaagattcatgggtgctgttgcatgcattgacagtttttctctttttattgctgagtagcattcccactgtgtgaatgtatcaaaaatctgtttatccattcactcactgaagaatatttgagttgtttcccgtttggggagtttgtaaataaagctgttgtgaacatttgcatacaggtttttgtatgaagattagttttcatttctcttgggttcacctagcagtggaattgctgtcatggaaagtgtatgtttaactttataagaaattgtcaaattgatttcaagatggctgtgtaatttcacatcctcgataccaatgtgtaagagttccagttgtttcatatacttttcaacacaaagtttttctgattcatttattatcataggtatgtaatgacatccttttgtggtattaatctgcatttcactaatgactcatgatttgagcatcttttcatgtgtctatatcatccacatatcttctttgggaagtgtctattaaaatattttgcccatttttatactggttacttattgctgagttttgagagggctttacatattttagaaacaagtcctttgtcatattgcttttctcataacatttgtgataattgctgatattttatctctgtatagcttgtcctttcatccccttagtcctgttttgggagggaaaagttttcaaatttgatgaagttcactttctccatatttctctttgtgaatcatgcttttgttttttacatcagagaattctgctaaatgtaagatcacaaaaatcatttctaagttttcttccagaagttgtatagttttaggtttaagtctgcaattaagtcttatttttatttttttgtatggtgcaatacctggatcaaagtttgtgtgtttgtgtaaactgtgtgttaattgtataaacaagttatctcaatagtggatgattagcgtcttatcattgctgagtcttccaatcttaaacaaggtatatttctccatttattttggtcttgtttaatttcttttgcttcgaggcacctgggagaataggcaaacctggcggatgaaggcagattgggcagtgggggggctgaaggggcaatgggactggtgcacaactctctccaaggccagcagacaaggcaagaattagaaagaccggaaggacaaggcacgagtgacagagaaggttagtgatcctggcatcatgcagcttgaagattgtccagtaaactgtgagtggctcctcctagcagactttctactattacctctgggtttctggagtgtgtctgcactgtcttgcccctttgaccagaaacccttgcttcctccacactccctgaattcctcaaaggacaaacctccagcactggaatctccctccccagacaaaatatctgcacagatgtagtcacgtctccatcaggggtccccagagttacatccccctggaaactgaatggtcaagataataagctattgggacttttgtatgccaaatgcgacagtctgctgggcactttatcaatgtcttatgggagtctcaccacaccaggaggaaaatgttttccaatttagctttctttcccacgcccagccatgcactttttgcatggccatacctaaagactgcatttgcctccttaaggttagctctcaaagctcatggagatcacctataatatgacttataattggggtttgccagccgaatgagatctcataggatgaatatccagtttgtttggtgacggtgcacctgactcagaggagcacaacgggcgagacctgatcccacctcagatgagtttcctgacaaagtttcttcagcagctgcttgggtgtccatttcatgcacttcacttttcctgagctctgtggccggtaagctgagtgtaacttccattttatttttaatagccgagttaagtcctgaagtatttcagccacaaatgctggtccatcgtctgacccaagagtcagggttagtccaaatctgggaataatgtcttttaacaacaccttggttacctctcatgctttctctgtcctggtagggaaagcctcgacctgcctcgaaaaggtgcaaatgaacaccaacatgtaccgaccgagaacaccctgctcaaggcagctctttaaaatccagcattgtgtgtgagtggctccacaagtacctcctagtgcagcccctcagtttaaagaggaaagtgggggaaaaaagaaactccagaaagctttaatgttcttgagtgattcctttacgtaatgagcatggttttaacaactggagatgagcctactttggaaacagcccctcttaccccatgtttattgttagggcactcctttatccactccatgcccaatatgtctcattcccaagtagcaatgagttaactagaaatttaacaattttctacaactttacacttagattatgctttgttataaatttttacacccttcttctgttaaagatgcagaattgggctttaaaaaaaatcattggatcaaataagcccttccctttccacttgactctgggaatgtgagcagacggttcttaagatgttgagttttgtctactatccactgctttttagccaggaattctctagtgatctgaagcaatgcaactgaagaacactttttaaattatgtgttgacaagttgccttatatataaagaggaaaaaaaattacctggtttatattatgccagatgtcagtaacatgaagtcctaatttattgttctcagttgttttcctgcctaatgtgaacttccgtgtccctgagccctcaggagtacctacagcttatggtgcaatgtcttctcccaaagtgttggccaccatttcacccaagggcctcttccaattcttgcttatctgagtcagatttagagagtaccactgtctccccttatcccttacttcatctccaaaccacatactcgtgctatacttttcttctcagtacctctccctgaatggtgagctgccattttaggaaattggaccagataccaatttgggagctttcagtcaaacaacctcaaacccatgtcttcctatgaagaggtgcaagtctctgaagctctcactcacccctgcagtctgtgtagaaaatgtactgtaatccccctggcccccaactgtcattgcctttggtgtgagatattccctatttcctagtttagcttgagtccctctctcctctgctagccaacccccatccagcaataaggaaccaagcgacagcctcctattcacactccctgcctcctttccacacaaccctagggaatacctggattgccccactctgtccacatactgtagcattcattctctatcatcctctcacctgtggtggtttatggatgtgatagagtttttaagattactacaaactagtaaaaaggaaaagcaactcaaagagagacaaagagagaaagaaagatctgttcagcgtctttgcccatttttaatttggattgtttgttttcttgctattaagtttctcattattttaaacattaaccccttatcagatgtatggtttgcaaatattttcttccattccataggttgcctcttcatcctgttgattgtttcctttgctgtataaaactgttttagtttgatgtaatcccatttgtctattttggccttcgttatctgtgctttagggattctatccaaaaatcattgccacaactaatatcacgaagcttttctcccatgtttttgcctagtggttttacagtctcaggtcttacatttaggtctttaaaccattttgggttgatttttgtacgtggtgtgagataaagtctaatttcaattttctgcacgtggatatgcagtttttttcaacagcatgtattaaagagactgccccttccccattcacatgttcttgacaactttgtcaaaatcaatcatcttaaatgcatggatttatttctggacgttctattctgttccattgtttcatttttctgttttgatgctagtaccatcctgttttcattactattgcttcttagtacattttgaaattaggtagtgtgatatctccagctttattcttgttgctcatgattgattttgctcttaaggatcttttgtgataacatatatattttttggtgttttatatttctttcaagaatgtcattggtatttagataggaattgcattgaatttgtaaatcacttggggcattgttgtcattttgacagtattaatttttgcaatctataaataataaatagctttctatttatttgtgttttcttcacttttttcatataactttcataattgtcactacataagtctttaaccaccttatttacatttactcctaagtatttattttttctagcttatgcgaacaggatttttttctttgtcaggtctttcattgttagtgtatagaaacactactgatttgtgtatattcattttgtgtcttgccatattactgaatttgttcagtagttttaacctagtttgctgcagtctttaggattttttatatataggaccatgctatatgcaaacagggacatatttagctacttcctttccaatttggatactttttatttttttctcttacctaattgctctgagtagaacttccattaatgcactgaatagaagtagtgagagtgagcatccttgtcttgtccttaatcttagaaaaatgtttttcatatttcaccattaagtgtgatgttaactgtggatttatcgtatatggtctttattgtatgagctacattccttctatacctcatttgttgagcgttcataatcaggaagtcatggtgaactttatcaagtgctttttctgtacctatcaagtgtcatatggattttgttatttattctgttgatgtggtatttcacatttatggatctgtatgttgaactatctttgcatccctacgttaaagcgcactgtatcatgatgaatgatctttttgacatgttgttgggattagtttgttagtattaatatttattgatgcacctatgttcaatagtgctattgcctaatattttcatttgttgaagtgtccctatctttggtatcaggattatgcttgccttgtaaaacaactttggaaatattccctcttcttcaattttttggaaggcttttagatggattgacatgagttcttctttaaatatttggtggaattcagcagtgaagccatcaggtcctgggcttttttttaatggaatattttttattactaatttaacctcctaactcattattggtctgtttagattttcaatttcttcatctggtggggtttatgtatctaggaatttacccatttattgtagattatctaatttgttggcatataattggtcataatagtctcctgatttttttgtgatgtaagttgtgatgtctcctttttgtttatgattaacctttttttttctgttagtctggataaagatttgtgaatcttatttaacttttcaaaagatcaaatttcaggggttttttttcattgttgtcatagtttctatttaatttaactgccctgatctttatttattccttcattctattaactttgggcttagtttattctttttatagttccttgaagtgtaacattaagttgtttaagatctttcttctttttcactgtaaacgttttgaagcatctaacaagttttggtattttgagtttccatttttgctggtctcaacatattttttaatttccactttaatttcctctttaatccatctgttgttcagaagcatgctgtttaattttcatgtatttgtgagttttctaaaagttctcctgttattaatttctactttcatgtcattgtgatctggaatgataaatggtatgatttcagtcttcttaaatttattatgacatgctttatgtcctaacatttgttctctagcatttcctgtaagacagctctgatggtaataaactccctcagtttttgtttgtctggcaaagattttaatctctccattatttgcaaaaaacagattttcccaggaacagtatttttggttgacacttttttttctatagaacattgcatatatcattccacactctcagcctataagtttctgctcaaaaatctgctattagccttcttggaactcccttatatgttattggcttattttctcgtttgttttcagaatctttcttttctttgatttttgacagtttaattaaagtatatcttgtactcttgatgagactgaatcttatcaaacatcttcaatgttcctatacctgtatatttctctttccgcagacgtggaaagtattctgctattatttcatcagacaagcattctttccctatctgtttctcttctctttctgggacacacatgatatgtgcattggttctcatactgatgttctataattgccaaaggatgtcttcattttttctcatttttttccttttgtgtctctgacttggtaatttcaaatgatgtgtctttgagttcattgattctttattctacttgatcaaatctgctttcaaagaactctatgaaattttcagttcaaccgttgtgtcctttatgtccagaatgtctctttttttatgatttctttctgtttgttgaactttctattttgttcatgtattatttctctgattctttttagtcatccatctgtgttttcttgaaactcactgagcattttaaagaccattattttaaattcactgtcagaaagttcataaacctttattttttggggtcagctattggttattctttttttttcctttggtggtatcatttttctcttatatttcttgatttttaggctgtgcattggtgtctgcacatttgaaaaacaagaaagttattccagtctttgcatactggctttgtctggaaaaaccttttcccagtcatccagcaattcttggtagggtgtctgctgtggtctgcaggtgaacttgttgctgaagtcttcaggcaggctggcctggtgcctgtgtcagcaggtggtaggcttggttcctgggtctgtagagttgggcctgaatcctgtatccactggttggatattttcattgggtatgtggggatgaacataaagcctatgtctataagggcaggcatacagcctataccaataagggctggactgaagcccctgtctacaggggctgacatggctctgatgtgggcaatgagtctgtgtctacaagggctggctaggttgtggaatgggcctagtgtctgggtctactgggatgagcctggaatctgagtcgatggggactggcctggtactggtgcaggattagagcctgaatctgaagaaacgggcctaggatcttggtagatgggagctgacctagagcctgtgtcttcagagatggtcctagagccttggtgcatgatggccagcctagcgtcagggtctgctgaactcagcctgtacactgggtttgcaagagcacagctcggctctgagtttattgcatcctgggtcacaaaaaccagcctgaaccctgaaattggcctagggttggagtggggttggggccagtctagagcctgagattatagctgctagactggtgcctgtagccataggagctggcctagaaactgcggaatggcctggaggccgggtgtgtgaattctggcctagaacctaggtcttcagggctagcatggagactaggtccacgaaggctgcctagggtcccagggctggaggaactggactggaacctgggcccacagaagcagtgctagatactgggtctgtgggcacaagcccaatagtggagtcaactgtgatgggtctggaccctgggtctgctggagcatgtgaccctgggaactggcctcaagagtggggtggcagaaattagctgagtgctaggttggcctgaagcctgtgtctgcagatgcttgccagatacctagctaagggctagtgctagggctgcccacctggaactggggttggcctgaatcctggatttgtgtgagccaacatagttctgggctggtctggaacctagggtagacttggagcttgtgaccacaggggctagcctggcactaggcagtcctggagcccgtattcacaggggccagcctggaggttggatcgatggacactggcctggtcactagagttcaaggggccagcctggccctggggctggtgtgaaacccggagttgtggaaggcagcctggtcctgggagcagtctggagcctggagtcactggggctgggctggtcccagggagcatctgacacctagggcactggggtagatctggcattaagatatatccagaaaccatgtctgccaggcaagtctggaacctgggctgtgggatctgctctggcttagtctgcagctacgagcctggagtttgaggccatagcggcatacctattactgtatttcactgaatcaggctgtgtttccgtcgaaggcaaagttcagtgcccacttcccttttcttcttcaatacaaaggttgcctctctctgtgctctgctgtccgttattgtgggagggatgacataggtaatgtaaaattgttcttcctatgctcttcaattcatcttttcttatttctctgctacacaaagattctgtgttttttcacctggtatccctagctcttgtgaaggtatttttgtccacagatagttgtttaaattgatgttcttgtgtgaggataagtactagaaagtcccattctgacattttgctgatgtctagttgtgtggcatctcatcagatttctaaatagtgattttcaaagtgcctcagcagcatcagagacaggactcctgctaatttggaaagaaagatggcaaaccttatgttaaatgatcttaccaaacacatatatgcaaacaataatgataataaatagagcagacaaaacttttggaagtgacgaatatgtttatggcataggttgtggtgatggtttcatgagtatgtattcatctctatcttcatcaaggtttatacattaaacacatacagcttattgtatgtcaatcatacctcaataaaatagttctacaaaaaaaagaaaggtaaacacaacagaggaaaactactgttggcctatttctcccattaagtatgacttgtatttcagagttctgatggttactgaatcttccagattttctgatgataagtataataagagaaataacatgttaggctagaaaagataaaaatatgtatttgaggattaatcaatcaaattttcccttaacataataggacttgttgttcaagatattcaagccagtaccaggctagagggagagaaaagttcccagatcaaatatctgtgtaaactaattcaactaaagccacaagaggaagagactcatgatgagatatttggaggtacaacatgcaaaattcatcacaaagtggaaaccagcatcttacaaaaaaagaacaacggcttgggatttagaacgtctgggctctggtctcaagttttgcacattcaatcatgtgtctatgcaatcatgtgtctacattccaggacttagtttcttgagactagaccatctctgataaactttctacctgattttcctctctttcagaaagttaggcaggtgctcagatcaactttttcgtcacaaaggaggaaggaagaagactttgggtgtctttcttaaccacagttttatgacatgggtttagagaatgcattagcagggactaagcaaataatgaaagctaaatttggtgtagaaaaatggggaacagaagatgaaagaatcagaaagaaaatatttaggagcaacaaagagagtcctctattgctttgtagtatagcgaaagttcctgtttttctcttctttagactctaagaaaaccagaaaacataagacagctttagagctttaaaatgttcttggatgccccaagacaagaaagcatgtcctgtggatcccacactttcccaattccctgatctagctaaaaccatatacaacttcctgatttccctggaggcattgaacctcatcaccaacccagaacagtttggcacgaattggtctctccatgaagtatctatacatcccattgcttcctctgtaaaagcttcaagattccactttggtgtcaagtttttctacagggcagattgttgtttatttcaaactccagaaaccctcactcttttctgggatccatttaaattggtgctatcaggctttttgaccctaaagaacctgtgtttacttggctcttctatgccttctcaccagcccccagtcagttaaaacacctttcttttgctacagaaaactgcaaccacatctaaagccaccatcagttcaaggtcttctgactgaatgaacaacccctccctcagtgtccagatgtgaaggatctgctcaatcaccaaagctcctgaattaagagtta

SEQ ID NO: 1293 - DNA, 37040 bp, Homo sapiens
gaagaaagaagactcttcaggcatctgatgaccaaaataaaagaaacattatgatggtggtggtggagtgttctgctacaggcatgtgggaggctcacagaactcttaatattcacttttaattcattccaccagagaggaaatgcatgggttttggataggactctgtcatttatccctgtaagaacttgagaaatttatttagtctctctaagctttggcgtattcaaaatgaagacgatactaacagtacctacatcatgagtgttacttgaatggagatgtgtaaagtgcattttaatttcatctggtcctttaacattttcccttcacttctcttcagagttttttcttgaagggctcgaggactgaagcatcccacaaaatgattctattgaataattctgagcagctgctggccctattcaaatctttagcaaggagcattcctgagtccctgaaggtgaaggaacagtgggaggttggggtatgggagtaggggtgttgaggatgagaaaataacaggcccaagaatctcgtccttcctgactttgtgcagagggttggagctgggaaacaggatggggttggggacaaaggaggcatgttaagagctgctgcttctcctcggcaacaggcaactaggccgactctgcagattttatcactcatttggagaggtggtgaagaatggtggctacgaacatcggtttggggccagattcaataaatatgcattgcaaggctgccattttttagtcagatatcattgtgcctgtgtctttagctttctatgcctttatctttggtcttttcattaataaaatgggaataatattagtagccacctattaaagttgttgtggacactgaatgaatccatacaatataagtgctaagtgcattgtcaagtgcccagctactgcacagtagctctgtggtatcacaaggacacctccctgggagttctgcctgtttgctggtgacttcacgtccatcagtatggtcctggagatgctgctcatcacactatcaccaacttggtcccagtgctgtctcctgacttccatttttctcttcctcttcacatacagacccccatctctggggatctcaacctctcctattccctttcatccctccttcaggtgtatggctctctgtttcacatcaatcacgggaaccccttcaacatggaggtgttggtggactcctggcccgggtatcagatggttattatccgacctcaaaaacaggtaggcacacagacagggactggtggagccaggcaggtccaaagggcctgaggaactgtccaattcagacaccatggctgctttcatagggtgaaaggaaatgtgagtattttaaaacactccttcgttaatgagcagcttgcatgaatgccacatgttaacactcttcccgtaagcataagactaatttgggaaaggggttcaagggggaaggggaggaaaaggacaaggctgacactcacagattaagggccctttgaggtggcaggggtcacctgcaggggctgaatggaggccaatttacagggaaagttgtgtgtctgagatatcagaacagtgatttagaaacaaaaaccaaggcagtagtctaccagcaaaattacctctcatggccaggcatggtgtcttttacctgtaatcccagcattttgggaggccaaggcaggaggatcgcttgaggccaggagtttgggacctgcctgtgcaacatagtgagacctcatctctacaaaaaaataaacaaaattagcagtgcatggtggtacatgcctatactcctagatgctcaggagatggagatgggaggatggcttgagccccagaaggttgaggctgcagtgagccaagatcacaccactctactctagcctggccaacagagtgagaccctgtcataaaaaaataaaagttgcttctcaggaaccagggaaggggcacacaattactgtgtgtcaactgtttggaagcacctcactcattagtgactgtcatcatcagaacaattttacaaagtgagctttaatatcttcaatttagagatgaggaaacaacactgagaaatattaagtcctgtagctgctggataccaactgttaaagcattccccaatctgaattcaagttcaacggactctgccacttttactagctatataaccataggcccttctgtgagttttatcatctgttaaaatgggaaaaattggaggacactcttcagaggatcacagaaggtttaaatgagataccatatgtcaaacacttagtacatagcacataattctaaatagtatttaccataattagccattgttggccgaggaaacacaaggtatacacgattaagctgaaatagtaatacaaacctaggtctattttttggccctaaaggcttcccctttttgtatctgtttcatgcacatctggttagtgaactgaagcctcatggacagcccagcttcaggtgggtatagacgctgagcccccacataataataagctgagcctaacaccttcccagggatgttcttttgatctcaaggtttcctgacaatttcagatggaagattaatgcttagtttatttgatccatggtccaatttcttcaaagtgtgatatgctaaataactgtatgaggtcaaatagttctttttacttcagtaactttgtagttactatgtgtattttaacaatgtaactgcaccatcaagctgtaacttcatatatgcattgctttgaacaaggctagtttttataaagtgagtcagtaaacaaaaatattaaaatataaaagttccatgccacacatacatgaccaaaaaaatggaaagaatgaaatatgctgcaatttacttggaaatacattcacctagtctgattccatagtataccacgtttctttcagtattgaaaatcgatgcaattttgaagaagacctttttaaggtgagatgcaggagaatttctctagaaaaaaattaattttttctttcttggtttttaatcagaaagataatatatgctgattatacaagtggaaaaatccaatatgattttaagaagttaataacctctcacctcctttgccctcctctcctccattcctaccctttggggtaatcagtgtccttgcccatattaacacacaaactgtcatcactttttaatttgcctttgacatatggacattgctttgagtgaatcaatacagcactaacgttttcgttttagtaactgtggtgttccatagagtcaatgcaatgctagtcagtcattctcctcctgttgggttcaaattgttcatacttctttgccattacaaacaatgcttcagtaaacatccttgtatacatgtctttacatcctggaaacttttctcaatgcaattggtttccaaaagggatacgtccaagtaagagcttctcttatcctaagtaggcactgccagactaccttcccaaaggattccacagtattatttccattagcaatttgtggaagaattgtttcccacattctcaccagcactgaatgttatccttcttctaatttctgccaaactggtgggtgaaaagtggcatcttattgtagatttaatttgcatttccctgactagtgatattcaacatatattttcatatgattatcagtcattttgggtttacttctgaactgtttatattgtttgaccatttttacactgggattttgtgtcattcttaaaattctctatgtgttttggatatgagggatactaacacaaggtgtatgctacaaatttgttgcccaattgagaattattttctattttattgatagattttcacatgaagcaatttttaattttcatgtaatcaaatatattatctttttcactatgattcctgaggctttgggggtttttttgttaataattaggaagatttttcctaatccaagatcatacaagttgtttttttcattttgtcttacagtgagtttttacttttgacatttcaaacttcattctatttgcaatatatttttgaatagcatgcattaacattcttttatatttattcaccttatggctggctaattacattagtgctatttattaaataagtcactctgctactgaaacataaatgtctattttgtcatgtaacatttttatatatttttgtagctatttctgtatttgttttagtcttttctcatgctatttcaatgttttgtggtaaatattaatatctaataaagcaaatcacccttcactaatgtttttcttgatttcctatttcttataaacttaagagctatatgaacaaaaactaatttttcagttccccaattcccccaactaagtattgcaattgtgatttgtattggaggagttttttagacaattgtggaagcattaatatttttgtgatactaaatatttttatcaagaaatatggtctttctctcacttttttcagtttctgttctatgccatctggtaaaatattagtgttttcctgaggtaaactacattgttttctgtcgaagtctcttatattttctaaatgtgtaatactgtaatctataaacaaagtaatttgctgcttctttgccaatatttgtatgggtttttagtttcttgccttattgtataatgtacaacctaagaaaacaatatcaaataaccataataatagttctattcttgtctcattcctgattctaatgaaatagctataaacacttacctttaaaattacatttaattctgtctttacaggcttagagcactttcctgttttcccactttcatagaaattatatttagaatgaacggtaaattttatgttatttcatttttgtctttttatggaaatttatatactcatgtaattttttcctcctttaatttattaccctaaaagatcttctgatcaaactcattctggcctttctaaaacaaactgttcatgttcacattcttttcatatgctactgaatattttattcagaatttttgcatctgtattcataagccaatatggtcagtaactctctttttgttatttctttaccagatttggcattaggatcttttcatcttttaccaaacaatacaattaaaattatgtgtttggttttgtcttatgtagaattgaaatgtaaaataatctaattttggctactttttagtttgtaatttcaactttccttttagataaagggggtacatgtgcatatttgttacatgcaaatattgcatgatgctgagtcttggagtacggacagatcccatcaccctggtagtgagcatagtacccgataggtagttttctaacccagcccctttccctccaccctctagagtccatagtgtctattgttcccacatttatgtccatgtatggtcaatgcttagctcccagttatgagtgaaaacgtgatatttgattttctgttacagcattaatttgcttaggattattacactgtggaaagtagtctggaaatttcttagagaacttaaaacggagttgccattagacccagcaatgccattactaggtaaatacccaaaagaaaatgaatcatcctaccaaaatgacacatgcactaggatgttcattgctgcactgttcacaatagcaaagacatggaatcaacacagatccccatcaaaggtgcattggataaaaaaaaaacttgctacatacattcatatggaatactacacagcagtagaaaagaataaaatattgtcctttgtagcaacacggatggagctggaggccataattcttgtccacttttcaaatggtagatgtttaatttcatttctgatatttctattagttcactgaagttttctattttttgaaagtcaattttgatagtttattcttgagggataacatccatttctttatcagtgaatatgttgccttggagtatataatcttctattataagtcttttttcttttctgtttccgttctcatggctcatactctatgcctttttttctcttttctctttctcttctatttcctttaaatgccttaccagaagtttatctctctcttctgctctttctctttttcccatttaataatgaactttctacatttcagtatttatggcttttatttttacaaattgttccattagttattttctggtttactttgatattctctttataattctttgaatatttacttggctattttaagacattcttttaaaatcgggtcttttaaaacttctactcttttaaattcactgaggtgttgtgttttggccatattcaggaacttgcatttataaaagcacccccaaatttttgaaggtttccttaaaattagttacactattttctcttttactccttaacgataaaattttcaacatgatattaatacattcactgctaaaactctcacacttattgtttatatttcccctgataaacagatacacatcgtcccatgaagtttgtggcttgtcagaatgggatcacaagtctctttctttaaaacccatgagtccaacaccacataaattgtgcagagtgctaccgaaaattcagttacttcattctattttgtgggcttctggctgtaaaggccatgtcactcttcaaagaggctgatatcctgtagccttgggaaaaggcaatgtctccttaatgtttctattcactaaagtatcttgctcaaaccctggacactgcagattctaaaacagtatagattgtaggtgtctggtgaaacagtaggcactaaaacttagagaaatcacagttaaattcatcttgtgccaagtttaagaacttaaccctatcaacacggactcagtacaacgcagaatatgtcccacagggggttatgtggggcacagtatatataacagggggatatgtgtggtccaggaggtgagagaagcagggagagaagcaattgttgcattcctttgcttctgctgggcgctctgtgatgctatatataaaataaggtaagtgtgcggttgagtgggtagggagaaaggtgaggcatcttaaggcctggtggaaggtgactgatttcatcctgtctttgttatgcatctgataagcaggtttataaccagtacctgtcagtgttcaatatttaacaaactccagttaaacaggtaagaggtcagcagtagcttataggccttggttctattatccatgtgcccaactgcagccatcgtgggctggtgttaaaattttcctttcaattgtcatttttctaataattgcaatcagtgagaggagaagaaaaagttcaagggaatgacctgacctttcaccatcctacacaggagatgactgatgacatggattcatacactaatgtatatcgtatattctccaaagaccctcaaaaatcacaagaagttttgaaaaattctgagatcataaactggaaacagaaactccaaatccaaggtaacaagtctgaagaaatgggcaagcagctgtgcttctcaaattgtgtcttcaactaacagcattagcatcacctgagagctcattagaaatgtaaattcatagaaactctctgagctgggagaggtggagcaatctgtggtgtgccaaggactatagctgattgtggtgtaaactcaactttgaaaactactaagcactgaggtattaatcaggtgggagcaatgtaagtagagaactgcatgtctgacaatattgctttcttggctttctctcaggttttcaagaaagtttaggtgaggggataaaagcagctgcattttcaaattcagtgaaggtagagcattcgagagcactcctctttgttacggaagatatcctgaagctctatgccaccaataaaagcaagcttggaagctgggctgagacaggccacccagatgacgaattggagaggtacaaaaaacatgtgctgatcatttataattgctattccttgtacatttttgtaattcacataaatcagttttggaatgaagagacgatgaattcattccttgggatgaataaaggttgtcaatggtcaaaatacgccactttgcaatggtgggtcttttaacaagaagagggcctgggatctctagaatggaagggcacctagaaattacaggagtggggatgaaagttgttgtctttctttttgttttctacagcgagactcccaattttaagtatgcccagctgaatgtgtcttattctgggctggtaaatgacaactggaagctagggatgaataagaggagcctgcattacatcaagcgctgcctaggagccctgccagcagtctgtatgctgggcccagagggggtcccggtctcatgggtaaccatggacccttcttgtgaaataggaatgggctacagtgtggaaaaataccgaaggagaggcaacgcgacacggatgatggtgcgatacatgaagtatctgtgtcagaagaatattccattttacggctctgtgctggaagaaaatcaaggcgccatcagaatgaataaggcactaggtttccttgaggcctcctgtcagtggcaccaatggacctgctacccacagaatcttgttccgttgtagacaatgaagctgcttagcaatcttgggcaagccatctcttaatattaaagcagacaccacagaatagctttcttcacttacaaatgttgattgggcatttatgatatggcaggaactccttctcacatggagacctgatgttaaaggacacagccatgctcttgaggagcttacaatccaagctggaggcaggggagggtatagtctttaaatatgcttaagtgttgtagggaaggacagagttaccaataaacatgtaactagaaagccaggctcagttcttacctctgggaatcagaactctttatgaaacttgattgatagaatctactatctggaagataattgaagaactttaataaaattgtcaatagaatatacctaatctatatggatactttattggaaagaaatacccctgctatgtatagatttatgaggcaatggctatactaaagaatggaatcagtctcttagtttagtgactagcaaggtatcaaaggtgaagcctcagacaaatggctttcctaggctacctttcatcattgttatgcagaaaaggatctccagagaatcaagtgggctggtcttgcggcctctgctatggaaatgacatttgttgtgcctcctttcccctactctttctcacttcctcatcattagtgaagcatggcacaggacaaggtgttgcctgtgagtctggttataaattcagcttttgatgtttgcagcactgctatcttaaggggtcaagggcattccagggagaagagaccactaaggtgaagactggagagtgagtaagagtgagccatacagtaaaagtggaaaaatccagatgatggaaagggcacgtgccatgcactatcataataactttataattgaacacttatattacaatctgaatccctgatctcaaaaaaaaaaaaagaaaaatactcttcatgaaaaaaacgtggcctcatttggctctgctctcccaccctgtcattggagcttggattactgtgaacattgtagccacagcaaaaagaaaaaaaaatggcatttttactccttctgatagtctagattttaaaaaaacaaaagaaatcttaatagaattgtcttttggagtaaagtctaccagtattaaacaacacctcatctctccataaaaaataaacctccacaaaattgaatgtttatacttgatgcgatttgaaagtgtgcaattccagcacctaaagaatagtgtaggtcatggagtttttaagaaactccaattcatcttagaaggctatggtagatctgttacatcttagtataaatcaatccaatcagatttctaaactcctgagacctggctgatttgttacattgactgaaatgaaagcatggtctgagagagagagtaaacatgtcatttgggatttcaaagggtggaaaattcttacctaaaaaataaactcaggaacttggagtcatataaaaacagctatattttggcactcaagaggcaaaagctaatacagatgatgaaagaacacaaagaaaataagatttgcctattcaaaatggtgcctcgggcaggtcctgtatccagaagaggatgttcatccagggtctggggctaaggtcatcttagcacagcccagctgccagcttccctcctctgccgcttccctgaacacaagccagcttcccttatctagcccttcttggccctgttaaaaaagtgattcctaaaccttatcatgcacttggattgaaaaaacaacaagaaagcatgggaaagaggaaagaggattccttaaatatggcacaagtaagtccaacattatcaataaacgcactaaaaatgaatggggtaattttcttattaaaatatatgtttttcatactgagttaaaaacaaagtccaaaaagcatacatctctgtgccctcacatggtagagacagaggagagctcagactctcttccttttcttagaaggacttaataccatcataggggctccacccttatgacttaatctaaacccaattacttctcaaaggcccacctccaagtccattgggagttgggtcttcaacatatgaatttgggggtcactgtcagtacataagaaagcatatctgaaataacacacaagtgttcacggaaaggaaaaagatatactaaatgaatgtgaaactgaaaagcaaagtaataccatcaacacttggcaaaatagaacgtaagttgaacatctgctaaatacagaaattctcccacaacatagatcatgaatctgcctcaacacaacacaactacaaactatacatggcaaaagctgacggacatacaaaagaaaaatgcaaatccacagtctcagtgggagaactcaaaaaacttccctcagaaagcaacagatgatgcagacaaaaaataaagacaatttgccaaaatgccatcacaacttgatatttctggtgatgttggggttatctgcttactgtgtatttgagaacttctgttcacctgcttgtcaaactgaccagcagggggtgctgcggagggaaacactccatctggagaatgctggcaacttgtctcttaagtctagaggctccttgtccccctcatgatcatcacctatgaggtgcaagcactgctgatacaggagctaaaaagaaattattaagcagttagtgtaggtaagagagtcctcggtaaggtttttcttttaataaaaagcagcccccatataatttcttttctagcaaaaatcagcctaaaaaatcaagccacaagcatacataagcaaactaaaaacttgcatagctaaatgctggcacctatgcaaatagaaaagggatacttggaagccaggcatcctcaacatagaggtttcctcttcctatttttttttgtttgtttgtttgttttttcagatggaatcccgctctgtcactcaggctggagtgcagtggtgcattctcagctcactacaccctccacctcctgggttcaagcaattatctccctcagcctcctgagtagctgagattacaggtgcccaccaccacgcatggctaatttttttttcgtgtttttttttttttagtagaggcggtgtttcagcatcttggccaggctggtcttgaactcctgacctctcgtgatccatcgtccttggcctccgaatgtgctaggattacaggcatcagctaccacgcgtggcctcctattcccttttctttgtattcacgtgtgcaggcgacatggcacaggccaggtagaggccccgtttgcatactaaagattcatgtgggatggccaggctcttcatgcatcacataaatggcacacctgctccaaccaaccctctgagccctatgtaaatcagacactgcctcctcaagctcctctataaaaccaaccacaactcgccccaaacccggaaacctgctcaggcacctttccaatgcatgaggaaactctctcttcattcttttgcctattaaacttttgctcttgaacccactcctttggtgtccacatctcaatttccatactgtgagacagcaaacctctggcatttccccagacaaacgatgccgcttcactgccatctcaagcccaagtgccaaaaatgaccactttagtctgaagaatgccacagctgccaccatgctgcttaggataagcaaggacatgaagatggagtggggacgggtttattagagaggccgcaataaaagcatatcccaggcaactttccacttcttaacttctgtcattttcaaacttaaaggtgttttttattgttgttggtttgcttttctttttaacagtttctatttctggccaaaagactgctttttgttttcctgctatgacatatttattctttgttcaaaagtcttttccatgatttcatataggaactaagaagacagccatgtgtttgctcaacacattgatcccctctccacctagaactctctttactgtttctcccaggaagattccacccctcctgttctgccagtttcctcatatttgcctcatacaattgcccttgtaggcagatgaacccgggctagttctactttactatggacaccaaagcttctgaaataacatctgagtcttgggatttgcatatgaatcttcccttgacacagcaaacagtctttccttttaccttcactaaagtcatctacttgggagaatggagagcactaaaattctacagatttcaaaaacaaacctgctgtgcctttccagagtccttggaatgcaaaagagaaaataggttagaagggatattttctccttcctttcttaccttgaaggagctcctatttttaaagggaatcattggggacaatccaaaagaaactcttgcaaatcaagctttgccatgccatcacgagaagggtaacatgtgtgcccagtggtgaaatttttaaattttggtaatgatctccagggtcacccctatggataacaaaaatattttaaaaacctataatggtgccagcctttcagaaccctgtctctttgcaaggacctaccaaggtctagagatcatagcacctcactagcagcctacaggcattctccaaaggttcccacctgccccacccaacatacacacacacatacacacacacacaccctcctgctatcctttggccctagatttcacctaactttattctaaatcttaatcaccctgtgcccccaaactcatgtgttatagggccttggtaatccctttctaagcatattccctgacttcttaaattctatttatgagacatatatctaaagtaaaactatatttcaggccagatcagcacgcttcttattacaattataaacactgaacttcttagttgctgggaaaatatattgaaaaggcattattatgcttgtatagccatagattatctagggaaaagtattgagtgtctcgagaatgagtgaaaattgtttccccaatatacacctttttttcttttgaaaagtatatcctgcgtatattcaaaagataatgtttttcaaaaggggaaattgcctccactgtggactcttattaattcacttatccatcaagttctcttattaactcacttatacatcatattcccttattaactttttattcaatcactggtatttgtttctagtgctcataattgaacacaaatttgtttactattatataaaataaagtaacagctattcaccgtttcctcctttacctcaataagttgacatcttccaatagatttatttccctgttttgctccctcctcagatccagatgagtgtgctaagtgatacaaaatgcttttattcctctaccgttcaaccccctgagcccgatgttttagttccacgtgttttagttccaggtgtcacagaatttcccttgcagtgtgtctcatcaatttaaagaatccttctttaaaacttttcttacacattcccagagagcctatcattgtccatttagagttaactctctacataaaatttgtcaatttttttttactcaccactgtttcctctccttattttctgctcctatctgaaatctcttttcctatttgattaaattgcttcttcagtatttcctgcatgtacatatgctaccgatataatatctgaagactctcaaatccacaaatatctttctttgaccctcacaagaatataatttctgcagccttatacattgacaaatgtttgtcttttaccctcaagtgactgattccctatgacatcacattttaggatgaccaaatataattttccactttatacataaggaaactgaggtacaaagaaacaaggtagccttgaactttcattcaaggtcacaaagctagcaaaaagtggatgactagcgatgaggtcttcaggttgagattaacaaacaacatcacaggatataataggatttaacccaacttcaacttcataaaatgaatggacattccctgatcttccctccactcccacccccacctcaggggatttcaggatgcactgggcaaaactgtctccctccatccccaaccgtttctcaggcagtgacaggtgtcaagaactcctcgccgcccttcttgaagcttacattctggagcagggaggcagaagctaaaccaaaaattaaaacaactgtgaacatattccctataaactcagatgtagtatatgaaaacaacacatgatttgacgacagaagatgatggagggagaaagaacaacaaataaataggaaaagaggcctcagataggagcaggtaaaaaggagagaaaacaggaaggggtcaggactggtttccctcaaagcctgtcatttgacagagagctgcagaaagaaggaatagagccaagcacataacaggagggtagagttgcagtctgaagcacccaaaatggtccactaggatggacaaaggacatacttgaaccaccacttagattcatcttcatctaaaaaataagaaattaagtgtgtgtaatatttaattatttagtacattaattacagtagaatatatagagttgatgctcaatttgttaaaaaatagatatctaaaattaaacctcagagattactcttgcctatgacaacgagcttctgaaaggcaaggataggtctcacccatctctgtatcttcagaatccatcatattatgtggaacataataggtatcaatagtatgttggggaaaaaaatcgaaaccatgctgagcaccggaattctgtgtaaatctttttaaaaagtctcttctactttacatcagagtcccttttgtatttttagtatcatccagccccacgccttgcagataagcccctaagaaatgaatgggtgaatgaatgtgtggacagcgggatggatcattgagtgaggagcagtgattcgcaggacctgcatgcattgaaatcctgccaaagcagcctctgcaaaataaaagaccttgggctttggtttctgacacaagttaaaattatccaaggactctccttgggccacttagttgaggtttcctaatctgtgaaacagaaaatgaattcaatagaaagatgattgagacaaatttctggaaggtgccaaagcaggatgcctggcattgagggacgcttcacacctgttatctctctccctattctctcttcacccctactcccgcccggcaactccccgctgtcagctccaggaatacttacctgctgagaaaaggaaaagcacaacactgactttaccccgcgacgcttttaaaaactccaaaacacccagcgcgatggggagtaggtttccctaaagacaggtggagcagccatagttaacttagaggaaggtgaattgacaaagagggttgagccactacgagcgggagttaccttggactaacagttgtatcttcagcgagcacaagtcctggaatctcccacgcccatccctttttttagcgccacaaatgcagcctcctaagagaatgggaagcttgggagtcagagaacagaagattgagctaccattggccttaatggatgtcaatcttcacttgtctcttttttttccttcctcgcctccttgcccctccctatcccggtaggcgcgttctctggcgccatcatatggcagaatgcgggactacaccaaatgcggaaaggcaccttccccttccctgagtatctgcaaactcagggctgggcttggtttttaagagctcagctcctgtgccaggggcggtgctaaaaggggctgcctgcgcagatgtcattcccacaagatgcaagtaaagaagcaccgcggacaccgggggagggtcacagagtgacaggaggactggttgaccagctgactggcctcacttctgacaaatgcaaattacccagccacagtccaaccaagggtatcaaaacaggatctctgcagatggagctcagtgttatgtgttttggatgctcgcaataagattttcatgcaccataaactttcctgagtatctcaaccagttttgttgatgccggggtttgttcaaagctgcagattactgggcctcaccccagacctactctacttaaatatagtggggttcccataatccccattttaaaaaacctatccaagttaaagtacagagaatcacaaactggaagaactccttaatttacaaataagaaatggagacccccccaccaagagagaaaggaatttgcccaaggtctccctgaaagagcctaagaaagcgtgaggctctaaggttaaaatcctacctgacaccctttcctttccccaactagtcctgtgacctctagcaaactatcctgtcctaatctgtgaaatgggagcaacagtcacacctaccccaactggtgactgcaaatattaaatggggccacaatgagtcaactaccaagcaccaccccattgtaagttgaggttgaaatgattctagatcgccctacccccattcatctcccagtaccattgtatgaccgtggaggtgaaaccatccagccgcctgttggtcccaaaccatgttcacctccacccgtggctcagtgactatttcttttcttgaagagagagagaggctccttggagcctctggaatctggagggggatgttaccttccccctgtgtgcattgtcttcccaagataggatggactacggggtctccatgtgaagagttagctgccagggcatcaaggatggctcctaagtggttgctggaggcttagagaccccactccagctctctctcaaatgggggcagcttgtttgcagcagtgagtgaggtgggcccactacgaacccacaggaggagaggaaaagaccgtcccatctaagcttttacataacccattgcaagctccagaatgtggtgcccaggcccatatctataacccacccccagaggccagttctcctcagcctttcctgccacttctgccattgtacatccagacacttcccctgttctcttctatcaaactcctactcatctctcagccatctagtccaaatattaatctttctctgtgatatactctcagggtagaggcagtggtgccttcctctgtattcccagaacatgttgtctgcaactctaaatacagacatcatcctactattagggttcaagagcatcttttatgggttcatgaaggaatcactcttcgtaaacactggccttattccctaacttcaccagacctgaccttagtgcatgatccattcccacctctcccaaccacatgagaggccttttcctctttatgggtttgcaaaccacaatatgacctaaccaccagttactggccaaaagcattcttgtcacgtttattataaaatccagccaacaagatgctttgtgccaagggaatgttccttttcagggcaaacactctgtccccagggatgttagacaacttccatagccccgtataagcattagctagaaatgagtttttcctagtggcccaacagattccctgagcatccctactctttcacggattcccattgcagtgggattgcatcaaacctctcagggcaaagctgcaaagggaaaagcaaagctagagctctactctggacctatcgctctagacagttagtttctctgtgagggtcagttttatacgtaaggaagaaatggaagattgctccccaaaacggcatcaggttacttatcccaattgtgtggttcagttgctacgccagtgatgagcaaataaacaggaagtagaagcacaactattcctaagctcaagaagcagggaagctcaggaattggtgtgcagcagtgctgcttggagcgccattacgaaggaacaagcacggtccactgggaggtaaaattcagggaatcgaagacacagggggtatgggaaacaaggcaggcttttttatttatcatttgccatgatatctctctgtgaactttcttctcccttttaattttccctgtactttaattataattcttaggcctgacgtggtggcttacatctctaatcgcagtactttgagacgctgaggcaggcaaagcaactgaggccaggagttcgacccagcttggccaacatggtgaaaccccatctctattagaaaaacaaaactcagttgggcatggtggcaagcacctgtcatcccagctgctcaggaggctgaggtatgagaatggtttgaacacaggaggtggaggttgcagtgaatcgacatcatgccactgcactaaagcctgagcaatagagcaagactctgtgtccaaaaaaaaaaaaaaaaatacaaaacttctcagctaatggccaacattgaaatacaaaacttctcagctaatggccaacattgttaccatcataagtcccagcttccctgtcttcctgtcatcatgtgttgaatgtccacttccctccttatttttcagttggagtggattagcatcaccaattcaacatgtcacaagtagaattacacaaacacacataagcaccgcaatcctggcacacacagcatctctgtcctcagacttccccatccttctagttgctcaagtcaaaagcccaggaatcatcattgagccctctgtttctcttatttatggaccatccataagcaaattccatgggctggcccttcaaaataaatgtggaatccagccatttctaacacttccaccattaccatctgaggtcgggctccaacatctttgcaatcctgggatagactcttagctgccttctcccttccacatctcttcttgtcctcccagagtttgtaccgcgcacaaacgctgctagggtggttttaaaaaatatgtcagggtatatttctcccttacttcaaatcctccatttaaaataaatttcacatttatagccaaatccagacttcttcatatggcccaccaggggctttatgctaatggaatgtgcagatgctcctccctgaggagcaccttttaccagggcaaattttctatctccaatgatgtcaggcaattccgacaacaccattctctactacctcttggttttcatagatatttttcctccagattctacaaaaaaagaagatcaagtctccttgtgcaatgatttactctctgatgtatattggtgccaggcacgtgtactgctttcagatgattcaagaataacagcgatttgagaaagctgtccttaagttttctcttctccttgactgtatgacattatttttacaattatacttccaaagtttgctctttccaaacaccacaagacctatgtaatttaagcagtgattttaggggtctctgtatattttatattaatttcagaaacatgctcatgattattccaccaaaactatcaactgttacataaacatctgtccttctatgagttgcaaaataattgtcaccatccccacttaatcaaccatcttgtatccttctttgaccaacttctgaaaaataacacccaatactaaaggcatctccttctattcagggtctcagacagtaagacgttctttccttaaacagtaagacgttttctcaagtcccatggaaagcacttctttgatatcagtttggggaggccgaactctggagtcttcatccgaagagtaaagtaccgcactcagtaatgcgcgtcctgggaaccaagcctaagcagttttggccgcttcctcgtccaggctggcattgtctgtgttcgccagcccctccgcgaagttagctcatttgcggatcaggccaaatccctggagacttcacgcagacgcgggtgcagcctgctctgggacttgaagtccgctggagcctgagcctctgcatcatccgggtggagctctctctgctgctgccaaaggatcccgcctggatgctcatcccgccaccgtcgcccaccccgcagctgcagaatggcagcaactgccacacacctaagcaacttggctggctattcgccctgcagctcccgccagcgcgctgcccaagctggcaatcaaaagtctgggaaagcgcgaaagcgccacgtgcctcgcactccgcccagctgccgcgcagctcctccctggcttccactgggagacaggggactcccatgagaaggaaggagcagggcagtgattgcttagtttatcctgggacgcgggagctgtccccgtggactgagtggcgcggagaggggatcactgagaccgggaagggtcatccagacaaataaggaggggtgcgggtgggcgcgcagtgccctccgcccggccttcagacccacccgcgcgcgcgcaggcgtgtgctctcatccttcccttcccttcactgtctggagtgatgataattggcttccaaagtggatgagagatgagtcatttacatccaatgagggaaaaacagcctccagagactcttcgtccattggccagtgagagtgtcaattcccaggctcctgccgcacgcgggcgagcccttctaggcgggaaaagttcagctgagagatataagagagcagactttccagcacctgtgaatccagagcggtgggcactgacgggcacgtgcaccgtgtggacagactctccagttctatgagtggtttttcttttcccgggtcggacctggagttcttaagaggatggctgacaagggcagtaggcagaaggacctcagcccaaagtcaaggaggttttggatggggagctgggcagccgcccgttgtaattcccttcccgtctcagcttcaaaggccaagagttgtactcctgaaaagatacttggagatcatctgggtgttcctgaatctcaagagggtcgtttgaccctggtgggtcctttccctacccggtgcctttctcgcccgtagaaggagaccaggttcggttaagcagagcagaaactattcactgatcaaggaatggagtaggagagctcctgctcaaagtgcctggggtgtagtgtgggggtgctccttaaggtcttttagggcacgtagttggaaagcaaggattcctggaaagagatggggctttccagaaccagctgagtgtggcagtctcctatttgctgttgccgcccaacactacatgtgcctagcaagctgcatttctcccgtaggcacagattgaggtatggtaattagcaattgaggattcaggttagggtagcgcttctaagttcgtttcccatcttgtagcacggtggttactgacatccagtctctgtttctgtaagcaagcacagcttcaagcacaggttaccttaattggttctggggctttaggaaagcattgaggtcatcctgcggtgacagaggcagctgttcaaagaacttggtgcgagtttgaggcaggggttgtggagtgaggcaggtaaaaatgcagattccatagccacaccccgacatactgaatcagagtctgtgagggtgggatctggaatcctttttaaaaagctcagaggaaccaattcacacgaacaataaaagtttcatctgagccaaagaccttaatctagaaatgagaaaacggggatccccaaaagggttacagggagagggttggaggaaagttagactatgacagttttagggtggttctttcctggccttgggaagttttctcagctgctgctctgatcagtacgcagctgaatgctttaggggaaccctcttcatatatccggagttccctctctgtgcaggtctcccaccagggtctgtggcccgtgacctcttgccaccctggtctctccgctttgtctcctcaaatctagaattccaactggctttgtcttgctgcccttccttgcgacactggcctggaatccttcaagttagtctgctagcgtggattgtaggatgcatctcagttgtcactatccttaattgcatgatgtccagttcctcgcaaagcgttgtttcatatattttgcccatttttgttttgttttgctttcagactagggggaaatccagtccctgttcttccattttggccagaaattcaaggtaatgacttttaatatttctgactactagttccatcatctctctcacttctggatctgtctctattcactgatgttcctagtcattatgggtcatatttatccacttcttaaatgcttgctgattgttttattagatatcaagctttgttaatttcacaactttgggtgccagaaatttttaccttcccatcaatattcttgaactttattttagtaccttgatattttacatggaaaccattttataatttcaaagtttgcttttatttgttaggtgggagcagaactagggctaattttgtcccactgtggaagaaatacctttcagagtagtctctctgatatttcatgaattgtgaaattttctagtcagatttttgtgaactgaatctattccctgtcctgtatgagcctcagaaattgttacatctgctccttttgggtacttctttttcctgttccttttcaacagctttattccactcatgcattgaccaagctgaaatctcaagggatacccactgcagatctctgatactatgtgctcctgtggctctcttctccctagtactctgccatacaagctccagtcagcctggcctcccaaaactccaagcttgtcttctcaactcagggaaactgctagactctgcctgttctcttgcctaagatatgccttggaaactccatacagtaacctaaatagccacagggcttacctcatatgattttcttctcagatatcagagatgaggtcccacacagcctgatgtccaatgattgagagttgttatttcacagatctttcctttttgggttttttttagacatttcatgtggcagaatgaactcaatccttgtttctccatcttatccactagtaaatattagttatattctcttcgaattcatcatgaattccatgaagactgaagaaaacaagtcacttagtgccacaaaagatgacccgaggactagacctgaagtttcaaaggtatatctacttttttacaactcctcagaggagtgatagtctaaccatagtgccatatgaggttcttggagataagttcttaaacaatggtcgttataagcctttctcttaggtagtttaaaatatatttgggtagctcatacacataagtgcttgtggaaagcataatgatagagtatgagttaataatgctaaacgtgtcttaagacaacaagatgactaacaaataatatagacacttaaaatcatggaaagtatagacaggcaaaaataattagctaatgttttctgaggaaacactgtgtgcctggaattgtgtcccatcatatggattatcccatttaacagttaatagaactgtgcagtagttattatcatacttattttacaaaagaagaaactgaagctcaacttgcttatagttgcagaagtaacggacttcaaagcaaggatcttaacctaggcagtcagactacagagactggtttttgacccacactattttgctcaaaatatgcaaaatgataatactaaattgagatataaacaagtgattttagagtacagagagaagaatacttaattcagactaaggaaactacagcagcatcatatgagaaatgatttattaatgaaaaataaatctaaaattgtcaaactcatagatgtagaagtggttgctgggctgggaagagagaaaaatggaagtgttagtcaagggatacaaagtttccttacacaaggtgaataagttgtagggatctgaacagcatgagtgccaatagttaacactattgtgcactcaaattcttgctaaaatgatagattttatgttgtgttcttattacaaaaataataaataagagggcaggaagagactttgggaggtgatagataggtcgatgtcatagaatgtggtgatcatgtatcttcacattcatcaagttgtatacactaattatgtacattaattatgcatttggtatgtctaaaactaatttattttttaaaaagaatgaataacatttcactagtgtatcaaggatgaaggaatggcctgagtaaagtcatgtacacaggaaaacatatttggggaacaggatagctgcatttgatgctatgtaaggagaattcaagaatgtggtaggcaaataatgctttctatactggtaaggtagtgtggtgccaagatcacagtaggctttatatcaataagagcttttcatattgacagtaaaaatattttctacttgtgaaacaataaaatggattcattggttcacctgagtggacattccagaattcagcagagctcttaattcagtagtatacagtttctttgaggacttgtttgtgtgttcagtctctatgttctgcttttcatgttatcccctggctggctttctgcatagtgacaaatacagctgcagtaatatcggatgtgttactctcccgataatgagtctaccctggtttcctgaggaaacttctctttgccatcttattgtcccaacttaagtagctcacccatttcagcacaaaaccttgtgactccgagggcacatatagatattcttaagctgtcatgaattcatttccatacatgtatggctcctaaaaagtgtgagagaggtagaatagctttctggaaaatagctgcagtatctcctacttctttgaaatccatgtgtaggtttttggattttcttctgtaaatagaggagacgcgtttgccgactttatctctgtatcgcttaggaggagttatttaattcactttagactttgttaagttaaatattaatgttaaaatgcccagggctattttgttcaagacagttgccactaatcacgtgattttttttttttttttttgagacggagtctcgctgtgttgcccaggctgtagtgcagccccacgatctcggcttactgaaagctctgccttctgggttcacgccattctcctgcctcagcctcctgagtagctgggactacagggatccgccaccatgcccagctaattttttctattttttaggagagacggggtttcaccgtgttagccaggatggtctcgatctcctgaactcgtgatccacccacttcggcctcccaaagtgctgggattacaggcgtgagccaccgtgcccggcccacatgtgattatttatattcaaatttaaattcaacttaactaatatcaaataatgaaaaaggtgaataatacaaaatctcagttgcactaatcacacgtcaagtacttaagaaccacctgtgacggtagtattaggcagtaccgatgtagaacatttccatcactgcagacattttattgggcaatacttgtttagggcatccaattatagaatagaactacagtgtaaaactgccaaactatttgtctagaaaatagaatgagaggaaaaaatcaaaataaaggaggcaacaaagcaaaggtttataaattgtgaaaaagtggaaaaagtaggtgatacaaaaaaagatgatagaaataaacgcaaaacacgctacacccaattaattgtcttacagattattcgaaagactttaacttttcttgtttcttttaaattcatttatttcatatacagtaaaattcagtctttttggtatatagttcatgtaaccatgcctacagtcatgtaaccatgaccaaaatcaagaagcaaagcagtttcatcacactaaataactccttttgtggttccatcacaataaataattccgcgttctccccactcatcccctattcaccctagtccctcgcaacaactaatctcttccttactctagtgttaccttttccagaacatcatataagttgaacatacactgaatcatacactttgagtctggcttctttcacttagaacattccacttaagattcatgggtgctgttgcatgcattgacagtttttctctttttattgctgagtagcattcccactgtgtgaatgtatcaaaaatctgtttatccattcactcactgaagaatatttgagttgtttcccgtttggggagtttgtaaataaagctgttgtgaacatttgcatacaggtttttgtatgaagattagttttcatttctcttgggttcacctagcagtggaattgctgtcatggaaagtgtatgtttaactttataagaaattgtcaaattgatttcaagatggctgtgtaatttcacatcctcgataccaatgtgtaagagttccagttgtttcatatacttttcaacacaaagtttttctgattcatttattatcataggtatgtaatgacatccttttgtggtattaatctgcatttcactaatgactcatgatttgagcatcttttcatgtgtctatatcatccacatatcttctttgggaagtgtctattaaaatattttgcccatttttatactggttacttattgctgagttttgagagggctttacatattttagaaacaagtcctttgtcatattgcttttctcataacatttgtgataattgctgatattttatctctgtatagcttgtcctttcatccccttagtcctgttttgggagggaaaagttttcaaatttgatgaagttcactttctccatatttctctttgtgaatcatgcttttgttttttacatcagagaattctgctaaatgtaagatcacaaaaatcatttctaagttttcttccagaagttgtatagttttaggtttaagtctgcaattaagtcttatttttatttttttgtatggtgcaatacctggatcaaagtttgtgtgtttgtgtaaactgtgtgttaattgtataaacaagttatctcaatagtggatgattagcgtcttatcattgctgagtcttccaatcttaaacaaggtatatttctccatttattttggtcttgtttaatttcttttgcttcgaggcacctgggagaataggcaaacctggcggatgaaggcagattgggcagtgggggggctgaaggggcaatgggactggtgcacaactctctccaaggccagcagacaaggcaagaattagaaagaccggaaggacaaggcacgagtgacagagaaggttagtgatcctggcatcatgcagcttgaagattgtccagtaaactgtgagtggctcctcctagcagactttctactattacctctgggtttctggagtgtgtctgcactgtcttgcccctttgaccagaaacccttgcttcctccacactccctgaattcctcaaaggacaaacctccagcactggaatctccctccccagacaaaatatctgcacagatgtagtcacgtctccatcaggggtccccagagttacatccccctggaaactgaatggtcaagataataagctattgggacttttgtatgccaaatgcgacagtctgctgggcactttatcaatgtcttatgggagtctcaccacaccaggaggaaaatgttttccaatttagctttctttcccacgcccagccatgcactttttgcatggccatacctaaagactgcatttgcctccttaaggttagctctcaaagctcatggagatcacctataatatgacttataattggggtttgccagccgaatgagatctcataggatgaatatccagtttgtttggtgacggtgcacctgactcagaggagcacaacgggcgagacctgatcccacctcagatgagtttcctgacaaagtttcttcagcagctgcttgggtgtccatttcatgcacttcacttttcctgagctctgtggccggtaagctgagtgtaacttccattttatttttaatagccgagttaagtcctgaagtatttcagccacaaatgctggtccatcgtctgacccaagagtcagggttagtccaaatctgggaataatgtcttttaacaacaccttggttacctctcatgctttctctgtcctggtagggaaagcctcgacctgcctcgaaaaggtgcaaatgaacaccaacatgtaccgaccgagaacaccctgctcaaggcagctctttaaaatccagcattgtgtgtgagtggctccacaagtacctcctagtgcagcccctcagtttaaagaggaaagtgggggaaaaaagaaactccagaaagctttaatgttcttgagtgattcctttacgtaatgagcatggttttaacaactggagatgagcctactttggaaacagcccctcttaccccatgtttattgttagggcactcctttatccactccatgcccaatatgtctcattcccaagtagcaatgagttaactagaaatttaacaattttctacaactttacacttagattatgctttgttataaatttttacacccttcttctgttaaagatgcagaattgggctttaaaaaaaatcattggatcaaataagcccttccctttccacttgactctgggaatgtgagcagacggttcttaagatgttgagttttgtctactatccactgctttttagccaggaattctctagtgatctgaagcaatgcaactgaagaacactttttaaattatgtgttgacaagttgccttatatataaagaggaaaaaaaattacctggtttatattatgccagatgtcagtaacatgaagtcctaatttattgttctcagttgttttcctgcctaatgtgaacttccgtgtccctgagccctcaggagtacctacagcttatggtgcaatgtcttctcccaaagtgttggccaccatttcacccaagggcctcttccaattcttgcttatctgagtcagatttagagagtaccactgtctccccttatcccttacttcatctccaaaccacatactcgtgctatacttttcttctcagtacctctccctgaatggtgagctgccattttaggaaattggaccagataccaatttgggagctttcagtcaaacaacctcaaacccatgtcttcctatgaagaggtgcaagtctctgaagctctcactcacccctgcagtctgtgtagaaaatgtactgtaatccccctggcccccaactgtcattgcctttggtgtgagatattccctatttcctagtttagcttgagtccctctctcctctgctagccaacccccatccagcaataaggaaccaagcgacagcctcctattcacactccctgcctcctttccacacaaccctagggaatacctggattgccccactctgtccacatactgtagcattcattctctatcatcctctcacctgtggtggtttatggatgtgatagagtttttaagattactacaaactagtaaaaaggaaaagcaactcaaagagagacaaagagagaaagaaagatctgttcagcgtctttgcccatttttaatttggattgtttgttttcttgctattaagtttctcattattttaaacattaaccccttatcagatgtatggtttgcaaatattttcttccattccataggttgcctcttcatcctgttgattgtttcctttgctgtataaaactgttttagtttgatgtaatcccatttgtctattttggccttcgttatctgtgctttagggattctatccaaaaatcattgccacaactaatatcacgaagcttttctcccatgtttttgcctagtggttttacagtctcaggtcttacatttaggtctttaaaccattttgggttgatttttgtacgtggtgtgagataaagtctaatttcaattttctgcacgtggatatgcagtttttttcaacagcatgtattaaagagactgccccttccccattcacatgttcttgacaactttgtcaaaatcaatcatcttaaatgcatggatttatttctggacgttctattctgttccattgtttcatttttctgttttgatgctagtaccatcctgttttcattactattgcttcttagtacattttgaaattaggtagtgtgatatctccagctttattcttgttgctcatgattgattttgctcttaaggatcttttgtgataacatatatattttttggtgttttatatttctttcaagaatgtcattggtatttagataggaattgcattgaatttgtaaatcacttggggcattgttgtcattttgacagtattaatttttgcaatctataaataataaatagctttctatttatttgtgttttcttcacttttttcatataactttcataattgtcactacataagtctttaaccaccttatttacatttactcctaagtatttattttttctagcttatgcgaacaggatttttttctttgtcaggtctttcattgttagtgtatagaaacactactgatttgtgtatattcattttgtgtcttgccatattactgaatttgttcagtagttttaacctagtttgctgcagtctttaggattttttatatataggaccatgctatatgcaaacagggacatatttagctacttcctttccaatttggatactttttatttttttctcttacctaattgctctgagtagaacttccattaatgcactgaatagaagtagtgagagtgagcatccttgtcttgtccttaatcttagaaaaatgtttttcatatttcaccattaagtgtgatgttaactgtggatttatcgtatatggtctttattgtatgagctacattccttctatacctcatttgttgagcgttcataatcaggaagtcatggtgaactttatcaagtgctttttctgtacctatcaagtgtcatatggattttgttatttattctgttgatgtggtatttcacatttatggatctgtatgttgaactatctttgcatccctacgttaaagcgcactgtatcatgatgaatgatctttttgacatgttgttgggattagtttgttagtattaatatttattgatgcacctatgttcaatagtgctattgcctaatattttcatttgttgaagtgtccctatctttggtatcaggattatgcttgccttgtaaaacaactttggaaatattccctcttcttcaattttttggaaggcttttagatggattgacatgagttcttctttaaatatttggtggaattcagcagtgaagccatcaggtcctgggcttttttttaatggaatattttttattactaatttaacctcctaactcattattggtctgtttagattttcaatttcttcatctggtggggtttatgtatctaggaatttacccatttattgtagattatctaatttgttggcatataattggtcataatagtctcctgatttttttgtgatgtaagttgtgatgtctcctttttgtttatgattaacctttttttttctgttagtctggataaagatttgtgaatcttatttaacttttcaaaagatcaaatttcaggggttttttttcattgttgtcatagtttctatttaatttaactgccctgatctttatttattccttcattctattaactttgggcttagtttattctttttatagttccttgaagtgtaacattaagttgtttaagatctttcttctttttcactgtaaacgttttgaagcatctaacaagttttggtattttgagtttccatttttgctggtctcaacatattttttaatttccactttaatttcctctttaatccatctgttgttcagaagcatgctgtttaattttcatgtatttgtgagttttctaaaagttctcctgttattaatttctactttcatgtcattgtgatctggaatgataaatggtatgatttcagtcttcttaaatttattatgacatgctttatgtcctaacatttgttctctagcatttcctgtaagacagctctgatggtaataaactccctcagtttttgtttgtctggcaaagattttaatctctccattatttgcaaaaaacagattttcccaggaacagtatttttggttgacacttttttttctatagaacattgcatatatcattccacactctcagcctataagtttctgctcaaaaatctgctattagccttcttggaactcccttatatgttattggcttattttctcgtttgttttcagaatctttcttttctttgatttttgacagtttaattaaagtatatcttgtactcttgatgagactgaatcttatcaaacatcttcaatgttcctatacctgtatatttctctttccgcagacgtggaaagtattctgctattatttcatcagacaagcattctttccctatctgtttctcttctctttctgggacacacatgatatgtgcattggttctcatactgatgttctataattgccaaaggatgtcttcattttttctcatttttttccttttgtgtctctgacttggtaatttcaaatgatgtgtctttgagttcattgattctttattctacttgatcaaatctgctttcaaagaactctatgaaattttcagttcaaccgttgtgtcctttatgtccagaatgtctctttttttatgatttctttctgtttgttgaactttctattttgttcatgtattatttctctgattctttttagtcatccatctgtgttttcttgaaactcactgagcattttaaagaccattattttaaattcactgtcagaaagttcataaacctttattttttggggtcagctattggttattctttttttttcctttggtggtatcatttttctcttatatttcttgatttttaggctgtgcattggtgtctgcacatttgaaaaacaagaaagttattccagtctttgcatactggctttgtctggaaaaaccttttcccagtcatccagcaattcttggtagggtgtctgctgtggtctgcaggtgaacttgttgctgaagtcttcaggcaggctggcctggtgcctgtgtcagcaggtggtaggcttggttcctgggtctgtagagttgggcctgaatcctgtatccactggttggatattttcattgggtatgtggggatgaacataaagcctatgtctataagggcaggcatacagcctataccaataagggctggactgaagcccctgtctacaggggctgacatggctctgatgtgggcaatgagtctgtgtctacaagggctggctaggttgtggaatgggcctagtgtctgggtctactgggatgagcctggaatctgagtcgatggggactggcctggtactggtgcaggattagagcctgaatctgaagaaacgggcctaggatcttggtagatgggagctgacctagagcctgtgtcttcagagatggtcctagagccttggtgcatgatggccagcctagcgtcagggtctgctgaactcagcctgtacactgggtttgcaagagcacagctcggctctgagtttattgcatcctgggtcacaaaaaccagcctgaaccctgaaattggcctagggttggagtggggttggggccagtctagagcctgagattatagctgctagactggtgcctgtagccataggagctggcctagaaactgcggaatggcctggaggccgggtgtgtgaattctggcctagaacctaggtcttcagggctagcatggagactaggtccacgaaggctgcctagggtcccagggctggaggaactggactggaacctgggcccacagaagcagtgctagatactgggtctgtgggcacaagcccaatagtggagtcaactgtgatgggtctggaccctgggtctgctggagcatgtgaccctgggaactggcctcaagagtggggtggcagaaattagctgagtgctaggttggcctgaagcctgtgtctgcagatgcttgccagatacctagctaagggctagtgctagggctgcccacctggaactggggttggcctgaatcctggatttgtgtgagccaacatagttctgggctggtctggaacctagggtagacttggagcttgtgaccacaggggctagcctggcactaggcagtcctggagcccgtattcacaggggccagcctggaggttggatcgatggacactggcctggtcactagagttcaaggggccagcctggccctggggctggtgtgaaacccggagttgtggaaggcagcctggtcctgggagcagtctggagcctggagtcactggggctgggctggtcccagggagcatctgacacctagggcactggggtagatctggcattaagatatatccagaaaccatgtctgccaggcaagtctggaacctgggctgtgggatctgctctggcttagtctgcagctacgagcctggagtttgaggccatagcggcatacctattactgtatttcactgaatcaggctgtgtttccgtcgaaggcaaagttcagtgcccacttcccttttcttcttcaatacaaaggttgcctctctctgtgctctgctgtccgttattgtgggagggatgacataggtaatgtaaaattgttcttcctatgctcttcaattcatcttttcttatttctctgctacacaaagattctgtgttttttcacctggtatccctagctcttgtgaaggtatttttgtccacagatagttgtttaaattgatgttcttgtgtgaggataagtactagaaagtcccattctgacattttgctgatgtctagttgtgtggcatctcatcagatttctaaatagtgattttcaaagtgcctcagcagcatcagagacaggactcctgctaatttggaaagaaagatggcaaaccttatgttaaatgatcttaccaaacacatatatgcaaacaataatgataataaatagagcagacaaaacttttggaagtgacgaatatgtttatggcataggttgtggtgatggtttcatgagtatgtattcatctctatcttcatcaaggtttatacattaaacacatacagcttattgtatgtcaatcatacctcaataaaatagttctacaaaaaaaagaaaggtaaacacaacagaggaaaactactgttggcctatttctcccattaagtatgacttgtatttcagagttctgatggttactgaatcttccagattttctgatgataagtataataagagaaataacatgttaggctagaaaagataaaaatatgtatttgaggattaatcaatcaaattttcccttaacataataggacttgttgttcaagatattcaagccagtaccaggctagagggagagaaaagttcccagatcaaatatctgtgtaaactaattcaactaaagccacaagaggaagagactcatgatgagatatttggaggtacaacatgcaaaattcatcacaaagtggaaaccagcatcttacaaaaaaagaacaacggcttgggatttagaacgtctgggctctggtctcaagttttgcacattcaatcatgtgtctatgcaatcatgtgtctacattccaggacttagtttcttgagactagaccatctctgataaactttctacctgattttcctctctttcagaaagttaggcaggtgctcagatcaactttttcgtcacaaaggaggaaggaagaagactttgggtgtctttcttaaccacagttttatgacatgggtttagagaatgcattagcagggactaagcaaataatgaaagctaaatttggtgtagaaaaatggggaacagaagatgaaagaatcagaaagaaaatatttaggagcaacaaagagagtcctctattgctttgtagtatagcgaaagttcctgtttttctcttctttagactctaagaaaaccagaaaacataagacagctttagagctttaaaatgttcttggatgccccaagacaagaaagcatgtcctgtggatcccacactttcccaattccctgatctagctaaaaccatatacaacttcctgatttccctggaggcattgaacctcatcaccaacccagaacagtttggcacgaattggtctctccatgaagtatctatacatcccattgcttcctctgtaaaagcttcaagattccactttggtgtcaagtttttctacagggcagattgttgtttatttcaaactccagaaaccctcactcttttctgggatccatttaaattggtgctatcaggctttttgaccctaaagaacctgtgtttacttggctcttctatgccttctcaccagcccccagtcagttaaaacacctttcttttgctacagaaaactgcaaccacatctaaagccaccatcagttcaaggtcttctgactgaatgaacaacccctccctcagtgtccagatgtgaaggatctgctcaatcaccaaagctcctgaattaagagtta

SEQ ID NO: 1294 - DNA, 590890 bp, Homo sapiens
actataaaaaaaaatctaactcatcctgatcattttaaaaaagaaattattgcaagtagaatatgaatactagtcactgctaataatgctaatttaaatattgtctgttcattaatagaaggagaaggaaaaaagcctgaaaggatatacaccaagggttgggggaagtcacacaatgaaatactttcttactttactacttttaatagacaggatcatggttggatttcattattaagtttttttttttttttgagacagggtcttactctgtcactcaggctggagtacagtggtgtgatcatggctccctgcaacctccacctcttggactcaagcgatctttcaaccttagcctcccgagtagctgggactacatatgtgcactggccacccagctaattttttttattttttgtagagacagagtcttgccctgttggccaggctggtcttgaactcatgacctcaaggagatccacccacctcagcctcccaaatagctaggactacaggcacataccaccacacctggctaaattttttaaaaaattgtttaagtagagatgaggtctcactatgttgcctaggctggtctcaaactcctgggctcaagcagtcctccgccttggccaccccaaagtgctgagattacaggcatgcgccaccacacccagccagttttcactattttttaaaaaatgtgtttccaataaaaatttcttagaaggaaaagtactgaactgcagcgaaacaagtaagagggtaaattccttgattgtcatcatgttctaagcccagcatgtgctttaatatggggcttcccagtccaaataattaaatctaactgcaacacagatgtgaattgcatggaatcatatcatattctctcaaaaacagtattatactcttttaacaaaagaataactccaagttgaaatgttaaagttttgcaacatttaatgtgaaaccaacaaggtcagcctgaaaaaaaagtagatacgaccaaataatcacttttagttcctaaaaattcatttttagttcctacaaaatatctaatttaaaaaaaaaactgtattctaatgggtgagttagctataaaacatagtctcaaacagtgacaaaataaatttagatgggattaattataaaatgtagcctcaaataactgaacaaactgtatttagacataattacttaaaatcacgttcaaatacagattaatgttttaatgctaatggtgctgaactgctctctctcacaggaaaatcattttataagcaaaaagatttgttttctgtttaaaacaggatgtaaatactaattcaacgaagagctgtgatagaggcgcagattaaaggagagagatgctgggatgaccctgctggagatcagatgcccatggaaactgactccggcatgggtacacattaggcaactctgaggttaggaataagttttgatataggctctgaagaagtagtaataagacctaaggtgactcgtagttacaatgtactgattattatgtattgattcaaaagctactaagaggcaaggccaaattcccactgtcttctcagggacatgaacataaaagagtcaccaggagtggaattattattcctgaatcctccttgatgagattctactgttcattttttaaagttacctagaattctagaataagttttaaaagtttcattttcaagttttgaggatgatttaaaaagataattggagagtaatgaaataatttaactttctacttgcaggattcctagaactcatttaaaaaaaaaaacagacttgatgactgatgaaagacagtatttcgggagggatagcttaagacatgtttttaaacaactctactgaaaaaaacacattttttccctggggctgcagttttatgtgattaaacaaatatgtttacacctatttaaaaggttaaattcaaaaaattcaacacatcaaaaaatatgcagtagaaaatacttatatataattactcatccaaattcaggatatatgtgctctcccttttcctatgtaataattacaaagtggttaattactaatatggtacaagtagggaaatagccatggtagtttccatgactaccctcaggacttgtcctgattcaaggcaaagaaagatccaggcacaagacagaacattcacaaaatctcctgctcctaatgctcatcttaacaattaataagacgcgtacaattacaaaccccgtctggcatataatataaaagacaagctaatatatatacttagaaaaagccttaaaggaaaatgaagaacatttctactttatgattttatttaaggctaaaattggaactctgaactttctatgttgatactcacagacttccctttgggtaagtttccttcgcaggcctgcttggaaagatcctgacgtccaatcaagagacagacagcttctggccagtctgaggcaggctgttcacgacagtgataaattgcatctctgatgggaagagcaattccaaagggaagagtttccaaatctcttaaagtgaatcctaatggttaaaggaagagagaaaaattttaatttagactcgccactgtcccaattatcctgactgaagttggcaacaatatctatcctgacaaataagttcattttattcatcttactaccagactaatgtcttgacatcaaggactagtataggaagtctctttgaaagaacttgtaaaaacctgaagaaaaaaagacaatctaatagaaaaatataaaggacaaaaagacatttcctagaaggggaaacataaatgggcaacatgcatatgaaaagatgctctacctaattagtgatcaggaaaatgcaaattaaagctactgagaaatataaatgtcaaagccaatcaatactaaatgttggcaactatgtagagcaataataattctttttattcttttttttttttttttttttgagatggagtctcgctctgtcgcccaggatggagtgcagtggcgcgatcttggctcactgcaagctcctcctcccgggttcacgccattctcctgcctcagcctcccgagtagctgggactacaggcgcccgccaccatgcccggctaattttttttgtaattttttttaagtagagacagggtttcaccgtattagccaggatggtctccatctcctgaccttgtgatccacaagagcagaagaagattctgatcatcatgacaggacaaaaaacataaactaggaaacagggacatacatggcatatatggtcaccctaccagctgcagaaagcataattggtgaattatttgcccaactgctccagatcctggtcagtagcccacacactagaattatagttgctgagcccatccccccttattccaagaatctctgattggctgccttggaagctttagctcttctcactgtcataccacctttggttctactgtccaaatgctgaccttctgttataactgcaggcagcctggtggtcaagcagatgtccccaagaacttcctggggttctctctgaactttgagccatttagaatcaccaggatgccttggtcactgtcaacatcaaaatgtgaatcttcttagacaccaccggtagttaccgtacctctagaggaactgagggttcttcacccacaaatgaagaccatctctaaagtgccccatcacattctagaaggatacagctgctggaagaaaataaagtgtcccaccaccactcccacagttcttaagctcatacacaccaacaaccactccaggaaccaactgaagacttcaaatatcatagtaccagagagggttgatgccaaacccacttctaaaactgtgttcactctcttggagttaccaaacaggcttcacaacctcaaagccatttcacaatctccccaaagtctcaatctccccacagtctccccagtcacaatctccccaaagtctgccttcccagactttgctggtgactgccatcactgacataacaacgtggctggaaccctgctgctgccaaaaccaccctccgactctctggccaagtcaaacccctcacaccactatgggagtagtgagaactctctgaaaggccactaacacttctgtaagccacaactaccaaaacaagtcctctgagcccatgccactcacagtcttgtcataccacacctaccagtgaacagtattgccttataagcatatagttctgactcaagcagcgtcaagcctagccttttcacaggataatttctaacagttgggtctacccatgagttacacgaaccactctccagattcaatgagcttctattacctctgttacaactatcactcttgtgagtacagactaagttaactcataagactgtttagaagatgcctttgctacaaagggcactcctcgaaagttcttcctaccctcccagacatttacgatgtgtgaagagaaatgccccaaccagtcacaatctccccaatgtttgaagtagtcagaggtatcacacagtaaccttgaactacttctcttaggtgccaataggactatgaactccatgaataaaatcagctggtactaaaaatggtaactgcttataagtcaaccaccaggtcaaagatggcttactcaaaaaatgtcacaagaaaaaaaacatcaaatcaaagtgaccagcctcactgcctagcaaccaacccactcactcattcacacagaaggcaaaattgaaaggtagctgggacgcccataggaagaaaacagttaggatgatgcaggggagactgatacaaggctgttattctaatcatcccataacagagacagagtcacagctagggaattattcaggaattaggaaaagttatttctggtaaacaaactcccacatactgggttaaaatttctttggaactttatttatcatgaccctaggagctctagtcatatatgcaaatggataaacaacaaagctataaaagcagagggttttaattttgcttttattttttaaataatagcaacaaggaactttagtaagaataacatagtaaaactagacctgtaaaagtcatcaaaagcaaacatgacaggaatagcataaagtaatttgtgaaagctagtattatcaaagcactgacagaagaaaaagaatgatgctaaaaaatacaaaacacttctttcaataccataccttatcaatggcttttccaacccgagaaacactgctgtggatgtctttgtggtcggaggccaatttttgaacagtatcctttattcttttacagcactgtgtcaaaacaagtcaaagtgtccctgataattcagcatcttggcctataaaaaaacaaaggaaggattggttactcacttaagcaaacccaaagatggcaagtttctaatgggccttttggaccatgaaagatggaagaaaagtgaagaaaaaccagtatctgctttgaagctgatggtcacattcatagatgtgatttttcaaatggatactcagaaagatataatttttttattttttggaaataagaaaattttactgtgaaaggaatcatttttatcattacaacaaccagcacaggctgtgaataatactgtcaaggcagtattatttttgagaaaatatgtctaagtgaataaactcacttattaaacccagttacactgttcaagtcattctcaaaacgttctggttgttactaaatttcctcaagagagatgatttagtgcaaatgcttcatattccatataaagaggtagaagaaaacaaacttccctgggtaccacgatgtgcagaaaggagttaacacagcaggtcatagactactacccttagaaagtcctgcttacaaagtcacctcttggctggcatatagaaacctgggagtttgggagtgttcccatcactccctaactcagtgttccccaacctttttggcactagggaccagtttcgtggaagacatttcttccacggacgagggctggggggaatggtttcaggatgaaactgttccacctcagatcaggcgttagttagattctcctaaggagcacgtgagccagatccctcgaatgtgcagttcacaacagggttcatgcccctatgagaatctaatgctgccgctgatctgacagtgggtggagctcaggcggcaatgctcgttcaccgctgcttgcctcctgctgtgcacggcctggttcctaacaggccacagaggggtactggtccatacccgggggtttggagacccctgccctagctgaaaagaatggctcattgtgcctaaactgttgtacagtgtgatttatggtgaacatctgctttccttctgggaatctagaatgttgatacatgctaggcagtgagtacctggctttctcctggcttggagaaagcttccaatagtcctctcccagtgaagtcacatggaatatgcttaattcctgcagccatggtttgtgagaagtgttaagtgttgcctaccagggaagctcattagaagctcagtgcccagggtttttattgggggctggtcaccagggcacccactgcctaactctggactgcctaactttggactttggacttctgccccatgagtcttttccctttggtgattttgctttacacccttttgctgtaataaattctagctaagagtatgattatatgctgaattgtgtgactccttttaatgaatcactggaacctaaaggtggttttgaagacccctgacacacatgagatcaaccaaaagttactacagtttacatcctttccctgagctacctccctccaaattttgttcctatagcaggaaaaaaaggaggagaagggagaaaaacagacagataaaacaaacccagttatggtatttgtcatttctctctctatctacgtattcccacctgtaagcaacaggcctggtttctgaaatcctaaccaacattatatagaagagcttcttgaattttaatttacatcagaatcacttaaagttaaaacaaagtagctggaccccatccccagagtttctcattcaataggtccgggatggaacctgagaatttaaacaaggagcccaagagtaaaacagccctaggatgcctgctcatttaaccaatatttattgagcactcactatatatgacaggtacagcagtgaaacaaaataaccaaaaatcccttcccaacaacttaacttctggcaagagacgtaacacacaaaataagcaaattatatactacgacaaaagatgatacatgctacctgggaaagaaaagcagggtaagagagatggggagtgtgtgtgggtggagcagccgcaacttcaaaacagtgctggcatggtaggcttcactgagtagatgacactggaggcaagacttgaaaaaagtgaaggaattaccatgtggctggctactttggggtaagcatgccaggctgcggggagaaaagccctactgcaaaaatacacctagactattcaaacaacaaagaggtcagcatgtcaaaagtggatttctggccaaggaaaatagaagaagaggtccaagagataatggtcctggtttggtaggatctctttggcattgtaaagacttatgcttttactttgactgaaagggaccactgcaaggttttgagcagagaaggcatgtaaactaattaaaaaaaaaacccacaaaaaacatttttttttttgagacagggtctcgctctgttgcccacactggagtgcagtggcacaatctgggctcactgcaacctctgcttcccgtgcttaagcaatcctcctacctcagcctcccaagtagcttggatgacaggcgcccaccaccacaccggataatttttgtattttttgcagagacagggcttcattatgttgcccaggctggtctcaaacttctgtgctgaagcaatcctcctgcctcggcctcccaaagtactcggattacaggcgtgagccaccatgcctggccgataaaacatttcaatatggtcagtctaactggcaacgggagtaccagaactgagcaggaaaataagaggctgtggcagcaatccagatgagaaatgacactggctcagtccaggatttcatgactggacatgagtgaagaaaaggactcacagatgtctccaagatttctagcctgggtcaactagaaagatggagttgtcttcagttaaaacaaaaacaatctcagcacttcaggaggccaaggcaggaggatcacttgagcacaggagtttgaaaccaaccttgggcaacagagtcagaccctgtctctacaaaacatacaaaaattagctgggcatggtggcacacgactgtggtcccagctacttgggaagctgaggtgcgaggatcacttcagcctgggacgtctcggctgcagggagctacagcactgcactccagcctgagtgacagagcgagacctcaactccccatcctgccaaaaaagaataaaggctaagcaggtatgaggggagaggagagagagaaagttcagtttggggcttgttaagtttgagacattgagtaggcaccgcagtgcataagtggaggagttggtgagatatacaaacctggagttcaacagcagtgttagtgctggagatacaaatttgtgagtcactgacattatatatatatatatatatatatatgatacttaatgcatgggactatatgaaatcaccaggggagtcagtacagacacagagaagtgataaaagaactgagtcttgagaactccaagtttatgaggctgggaagaaatagaactggaaaaggaggctaacaaagactactgaagcactaactgtgatggaggaggaaactcaagaaaagtataatgttggggaaaccaagagaagaaaatgtgtcaaggaaggaggagtaaccagctgtgttgatgtgctactaggtcaagtaagatggggactgagaattggccactggatttacaatgtggaagtaatcagtgacgatgacaagaatagtgtctctaaaattctatgaaaagaaatcctaaaaggttacagggaactgtgaagagggactatattaagtctggttcaatgacaactactgagataaatgaaaagataagaaaaaagctttccttatctctaaatacagttgcacaaagtttctatcaagtgtttccaacttccaataacacaattaggcttccaacttctaataacataatttaggctaaggcaagacttggtacttcaagaaaatttcaaaatctgtttaaaaggtgttccacagatttcttggaccaaaagcatctaattgcttcagcagctctgttctggccatttctgatctttctgtacctaaagcacacctaacctcaacagcctcatcttctctatgaacccatctgaccacagacttactccctcttctgaattcctggtaacttctgatctctcccctactcccccagcacttaattataacccattttaacaatttcatgtatatataccgtcatcagtctctactaaacataagcccccaagggaagaccaagtccttattataaattgtatactccagttttatattaatagtgcctgcaaatgtgcaagacatataagtatctgaattgatggtaaataaagtgaggaaaaaatagtttttgtttttgcttttgttagagccatattcaacaaatggtgctgagacaacaagatatccacatgcaaaagaatcacataatatataaaaactaattcaaatgagccaaatgcagtggctcaagcctgtaatacaagcactttgggagcccgaggtgggtggattgcttgagcccaggagtttgagactaacttgggcaacatggcagaactccatccctacaaagaatacaaaaattagcagggtgtggtggtgcacgcccacagtccaagcttctagggaggctgaggtgggaggactgcttgagcccagaaggtagaggctgcagtgaaccgtaagcatgtcactacactccagcctgggcaacagagtgagaccctgtctcaaaaaaataaaatcaaaaataaaaattaactcaaatggaataaagacctaaatgtaagagctgaaactatcaaattcttaaaagaaaacagatgcatttctgaccttgaattaggcaatggtttttcagctatgacaccacaagcacaagcaaccaaagaaaaaataattaaaatggacttcatcaaaattaaaaacttgtgttgcaaacactatcaataaagtgaaaagacaattcatagaaggggagcaaatatttgcaaatcacattctgataagggtttagtatccagaataatataaagaactcttaaagctcaacaataacaagacaaacaatgcaatttaaaaatgggcaaagcacaaggcacagttcacgcctgtaatcccagcactctgggaggccaaggcaggtgaaccacttgagcccaggagtttgagactagcctggacaacaaggcgagactctgtctctacaaaaaaaatacaaaaatgtggctgggcacagtggctcatgccagtagtcatagcaactagggaggccgaggcaagtggatcccttgagcccaggaggctgaggctgcagtgagctatgattgcgccactgcattccagcctggatgaaaaacaagaccctaactcaaaaaaaaaaggtcaaggatttgaatagacatttttcaaaagaagatatacaaatagccaacaggcacacaaaaagatgctcaatattattggtcattatgagatgaaaatcaaaactacaatgagatactacttcatgcccacaagattggctatcaggaaaacacaataataactgttggaaaggatgtggagaaattcaaagccttatccattgctagtggaatataaaatggtgcagacaccatagaaaacaatttggcagttcctcagaacgttaaacagttactatatgacccagaaattccactcctagttatatcctagttatatacccaaaagaacaacatgtccacacaaaaacctgaatcagaatgttcacagtagcattattcataagacaaaaactggtaagaaaccaaacctccaaagaatgaatggataaacaacggattatccagtcattaaaggaaatgaggtactgatacatactatgacatagatgaaccttgaaaatattacattaagtattcaataagccagacacaaaaggccacatattgtgtcatttcatttgcatggaaggtacagaatagacaaatctatagagacagacatagattaatggtatttggagtgggaggagacagggtgggaatggagagtgactgttaatgagtactggatttctttcagaaataaagaaaatgtttttaaaaagaagtcatacctcctatccatccagacacatttatttctacaaccagcagacaacaaggtaggaaaaacacaaaaaataaaaagggtgccaggtacgatggctcacgcctgtaattccagcactaaggaaggccgaggcaggcggatcacttgaggtcaggagtctgagaccagcctggccaatatggtgaaatcccatctctcctaaaaatacaaaaattagctgggcgtggtggtgagcacctgcaatcccagctactaaggaggctgaggcaagagaatagcttgaaccctggaggcagaggctgcagtaagccgagattgcgccactgcactgcagcctcggtgacagagcgagactcggtctcgaaaacaataataataaaaataaaaaaggatgaagccaagctggaggaaagaggtcacctagaatttaccactgaacttccacgcaccaaccttgaaatccaatgatattttcaaatcgtagtaacttacatatctggagtttggtgctatttgttacctccttttcttcctttaccatctacaaattcctctaatttttggttttcaattttatgaatgacagatacaagcagtttatggccaattaattaatactgagagttctcagaatgctccaaggaaaaataatttctgtaaggtatttggaaactcaagaaaagcagaatggaataatctgaaagagaaccctgggaaagccctgttaagagagaaagagttcactaatgcattttcaaatggactcagtggaaagcagccaaaggtttaaaacaggtttgaaaattgctataatgaccagactgacagtcaaccaaacttctataagtcctactgggagagttctaacgttcttttgatttctctgtatgaaaacacaacctgcttctaggagaacctttatgtgaaagaaactggattcagttcctagaagaaaagctggggaattactgtgacagccatctccaccataactacatccaggttggccactgcggtggtcacttgtcacccagaagaaagtcctgcactaactgtgtcttccaatgtagtaaacccagggaacccaggcccaatgcatgagcctgaaagaaacaactctgacgcaatgctcactcatcactggagggtcacaagtactttttaaagtcagttttatgattaaacaagtgtaagaattagcatgttcaatataagcaaagaacgaacatatgtagaccatctacgtgtgttgctttattaagttaaaattttcaataaaatagaacagcaccttttatcatataaacagattttaagcacgacactcaaaattttcaagttctgcccttgagcctcactgctttgccattttaggatgtatgcccactagtttcacagaaacaataaataagaaaaatgtttgtttccatagcatcctatacttccctatcagagtttcacactttgttgtaaatagttatttgtccattactcccacaaaattaactttagtaggaaatatgaccaatccccaacgtttagtatagtaactggcaaatactacacgttcagtaactagttaccaaaagaataaatatgaaaataattaattatgtattacataatctcaatttcaaacccagcattgaagactgtctggtactaccaacaccctctgaaattgccagcagtttcactcagcagttcactgacccctcactctctcacagaatgtttagcatctgctacacagtaacactgcagcctaagttctgcaaataccaagtaagttaggaaataatactgttcctgtctgtcaataacattattgcctaagtagaaaatcccaaagaatctacacacaaacacaatccaagaatagatgagagttcaacaaggtcacagtacccaagatcaacacaaacatacaaacacacatatgcacacatattttcaaataagacacattcacaaaagagtcccctggcatcagttataagttccttctctcttccaaataatgacctctcccaccaaccccaggaattaatgggcttgtgctctgactcaagtcacttttgagacagtttcttttttacaaaactatttccacatttgtcaaagatgcaatgaaacatctctaatatataatgtgaccctataaaagtatattctaagtcagatataggaaggtataacaaacgtacacattaaaagggtgactggtttgcacaaagctaaaaactataaaatccctactaataccttggttacaccttcaatacacttttagcattttgtacatacatttgttttactttcttccctactgatcacaagcctcaaaaaaaagcacgtctcgtgtccagctccgtgacaagatttacccactattttggctcaccttaatacaatctagacaaatatatcattaatattgacaagtacgtttctcatccctactcagtatctgcacttttaattttctgtctgccacttatttttatgatatggggggagggggttcaactctgcacaaacacactgttaaagatagcattgctaaaactaaacagctggttggtaggcagcacaccatgttgcagcctgaaatgtctgccatcaggagataataaaaagttctaatttggtctataaaaggcagtttaaaggtgtcaattacaccatgaaatacatgctgcccacgagtcaaacacatgagagatgagacccaccatacttgagagcactctataaaaaaatagggaggcacaatataaaaaagtattgttatggtgatgattttcaagaaggttgaaagtatcaccacctaagactggaatatttccacagaaataagattccgcagaaatcactaagacctggcttgacattttaatgaatatcctataggcagtaaaaatttaaaatatccaagtttataaatattacatgtatcgcatttgagctcttctgagttatgaaaagttaactccactttcataagatggacagagatcttaaatttagaattaagtggaaagcaaaatggaacacaagttttgatgcagataaatacaaagaaatccatttaggaaacaaacctaactgtacctaaatgaaaactcagacctcatagagatatactccagaattcattctagattagctatttaaataaaaacactaaaatcagaaagctaaaagagtattaggcatcactaagaaggctggtggggggggaaatctatgatataccactcttataaaagccttgatgccttaaaatacaaaatgaaaccaagaaaaaacagaaaaaaatgtaaaagggagaactatgacatttagagtcaattaacatttattgagtgctgaaggcctgtgtcagcaatgttcaagatacttttcccatgttaccaatttctacacagatttaagaaatttagaatgggaataaagtagataaaggataaaaagatctaagactgactctagaaaagtcactgacaaggtgaccatggatatccttgcgaagtactagaatagaaaaacttgaaacttgaaaaggtaaggttggaattttttaaaaataagggactatttcattttgtctgtagtaaaataaactgcggcccattgaaatttgggattcttgtgagctacttcagcacctaggacacagcggctgcttagaggaaagagaaaaggcacaaatagaacacattcatttttttctggaggaggtaaacactgaaaacaaaatttttccagtatattagtagctggtaaatctgcaaagtaaaagaaagtatggtatttggtgttcaactcctgacctttcagagaacagtagactgacagacacgtgttctgatccagagagattattaaagactgtgcatcaaattagaggcacagtgtgctgcaaaccaaacatgaggggaaaaaaacgaaataaagttaatatttagagtgaaattacatggtacagactaatagtgctcctggagcaaagaacagtatcaatgactatcatagagaagacaggaaaggcttcaaagtatatgaggcaagaattgcagagagaagaaaaaagatacaggcacaagattttaaacatatgtctgtgacagtcacattttagagaacctattcactcccttcaaattccaaatataaagacttaatctctaggcatctcatttatctctgaaatgaatggtggaaccacattaggtttcctgtagcattggaatctggatttcatatttaaaaatcaaactcaggccaggtgcagtggctcacgcctataatcccagcactctgggaggccgaggtgggtggatcatttgagttcaggagttcaagaccagcctggccaacatggtgaaaccccatctctactaaaactacaaaaattagccaggcggtagtggcgcatgcctgtaatcccagctattcaggaggctgaggcagaagaaacacttgaacccaggaggcagagattgtggtaagccgagacactgcaatccagtctgggcaacagaatgagaccccccctcccccaccccccaaaaaaacaaaaacaaaaacaaaaaaaaatcaaactcagatttccaccttcccctctcctaaacttcctattttctacctggttccataatgatctacccatcattcatgtttaaaaccttggattaacctttggtttttcctgcccttttctcctactctgccagactccatctgtgcaccaactcctggtcattccttccctcagaaatccctttcatgtgtccctttaaatttctaccaccagtacccaaagacaggtccctatttcatcaaatctaggttgacacttagccttagctaaccttcttgcctctagtcaaacctcactcccaactccaaaccaacctaaatactgctgacaactggtctctgatcgtgtccctgtcccctccctattcaaaatgtccccaccccaccccaaagtaattcaatatcttcccagtctactactttccctggtatccatggctttacaaaacctgattccaatttaattttaatgctcttatcgcctttcccctgcaatctggtccttcacctctcactcctctacacctttgttcttgccatcctcccctccaggcactccatatagctctttctgctatccatattcaatttctgctactaaaacttcccataggtaaaaagagtctctccttgtctcaaatcctacccctttttgtccacaccactcatgtagcatctagcctagatacataaccgtgcattacagggcactgcttttgtttgtgtgtttgttaaaaaatgccagtctcatctccctaactggacacaaagttcttagaggatgaaaatgcttgttctttgtaactcctagaagattttgcttagttctacctataaatggtgattaataactactgatgaggtgatctaaagttcagttgaaataatgcccatctactcccatgcagttctttctaagggctctctctcttcactggtgtctgtactaaccagaagcactgttacacactgtgtgccatggtcttgttttttccccctttcaaatatgagtctggtctctccaactaacttctaagttccttaaagactcttataccttttaagcattctttacaatgttaagcagaccactggacacagagtggtatttaacataaaccagtaataaagacacctaaatattacccaaaatgtctcaattaaacagtgcttgggcccggcgtggtggctcacgcctataatcccagcactttgggaggccaaggcaggcagattacgaggtcaagagatcgagaccatcctggccaacatggtaaaatctcgtctctactacaaaaaaaaaaaaaaaaaaagtcaggcctggtggcatgcgcctgtaatcgcagctactcggggggctgaggcaggggaatcgcttgaacttgggaggcagaggttgcagtgagccaagatcatgccactgcactccagcctgggtgacagagcgagactcagcctcaaaaaaaaaaaagcttaacaccacttaaggcacagactttataaataacacgtctaccctgttttacaaatttcaaagccagttcacgtctattatttatttcactctcataactctgtgatgtcagtttactgaaggaaaaactggctaagcaagattgtaggatcaggccgggcgtggtggctcatgcctgtaatcccagcactttgggaggctgagacgggtggattacttgagcccaggagttcaagatccccctagccaacatagtgaaactccgtcactactaaaaatacaaaaattagccatgcattgtgcacacctgtaatcccagttacttgggagcacaagaatcgcttgaaccctggaggcagaggttgcagtgagctgagatcacacaccactgcactccagcctaggtgacagagtgagactctgtctccaaaaaaaaaaaagattgtagaaccagtaaattggcagtgcaaggattcaaacccagacctcctgggcccagggtcaaaattttaggtactattccacaaatacagattcaacttctcaattagcctccaagttcctggaggaccagggccatgaataatttcttttaaaagattctctcctcaactcctcccaaatgtcttcatgtatcaataagatgaattaaacctatatgaattctgcagatacaacaaactcatcataaataacacacagcctgacactacattgtgcccccataacagacgaaatcaccatccaggcctccatcttaagtggagaaagacttggtaatataagcctatggcctctccaagcgacattcccaaacaaccattttgagctcagccacacaatcaccacacccatataaggtgaaagcatactgtatttctcaaaatcctcgagtcctgccagacagtctagtctttgttctctgaagggttgagttaacatctaatctaaagagaatggccagaagtgtctgctactctcagagctttcaaggaaacgtccagttagagagcatcatctcctggaagtaccacgggtctccaagtacacatagctcagagccagggccctccataattttctccctaaactgcatttttggatcatttttaaagactttggaagccttacagatgaagaagcagggccctaaataaaaataagttagttttaatattccaagtgaacagtttgctaaaacaccattttcatcatcctaaagactaagagactaagacatgaaaacaacagaaacttctctattagctctagtatgacagtatcacagaagtgttggcaagtttctccttaccaatgttattatccagagttagaaactactttagaaataaaataactttaggaaaattactttactatgtcaagcattaaagtaatttcaaaaaagttctagaggaacatgaaccaagttgtattctctagtctatagattaagtcatactaacaactcactacttgaattatatgagcattatagttaggaggccaggcaaaagctgagaaggcgaggctagtcaggaaaacatctcagagaatgttactgatataacatgtagctgttgcactgtaatagacatatattactctgtctgggtttaagtgttcctttctagaactgtctctttacctgatgaacagtgtattataaggccatatacctcctgagggggtgagcacagctcaaggtggccagaagacctcactccctggtcccagttactgattcagggaaaggatccataacggaataataaaggtactccctggagtatctccaacaaaatggccatgttcctgtcttttgagctccattggtcatctctaccccatgtgaagaaaactaccctgaaaatgaagccaacagttgacagaagagaacaagatcagtcctgatgacatgcctggtgcccctggagccagcctagccctaacctcagcctatttatacatcaacaaattccattttaatgaaaactattatgtcacctgccagtctaaatgaatatggtgccaaataaaaaagaattaattatctccagagtacgtctggaaaaagaatggctaacaaagttaaatctacttctaaacccaactggaaacaccaatatactgactttttattcttaccacctaaaatggcctaaataacttgagaaccagtccgttcttctcttagaatgtttgaacaatgtccacccaaacttttatttatgacctactgatatactattttccagactagatgttaaaaacagatatcaaattgtattcaaaacaaagtcactattctctcaagagtgtcttgttagtatttagcaaaagtctgggtaacaaatgggcaacctggctatgaggcctactccatgcacaccaaagaataaggctaaaaaggtaaacaagctacaagtctaccaagccccgatataatacatttactttcattcaaaacaatatattcaacactggtcggctctgaaaaagcacagatcattcatatatacaaataagcatacttttcaacacatgtgtttaatatacacaacccaaattctagattggaagattatacctaacatgcgaccctcaacctctggtttctgtgtactgatgcaatatcataccacagcaatgagttaaaaacgtgacctccacaagtttctttttttgtttttcatgttttacttgcctacttaccttctcatttgttaccttcacatttttaaaaagacagcagttctccaactggtaaccaaagtttcaacagtttctttgattcaccgaagagataagggtaggagttatggtttacatgagttttactactagaagtcacaacatacacacacaccaaaggagttttaggtgctaatacagtatatgttgatcactcccacagatgaagacatctttaccaacttgcaaagtgagataacactaagccttaatcatagtaaatggaaatacatatccgatgcgttaaagaaaaaaggaaaagtgacaaatcgtcatttcactggattcttttaaaattttttctggaggtcgggcgcagtggctcacgcctgtaatccctgcagtttgggaggccgaggcgtgtggactgcttgaggtcaggtgttcaagaccagcctgacccacatgttgaaaccccgtctctactaaaaatacaaaaattagccaggcgtggtggcaggtggtgcctgtaatcccagctactcaggaggctgaggcaggagaattgcctgaagccaggaggcggaggttgcagtgagctaagatcgcaccactgcactccagcctgggtgacagagggaggctgtctcaaaaaacaacaaaaaaattttttttctggagactggcatttatgtctgtgaagtgggcaaccaggtggtccaggaacaagagtagaaagatttttcaatgggtgtcttttttatcatttgagtttataccatttgaatgtactattcactgggttatctttttcattgtttgaatggataccatttgaatgtatgacttactaaaaattaataaataaattttaaatttagaaaattccttgaaagtcactttcagaaaccacattagaactccgttagtctaaaaataatcagaaaagaatactgcatgtcctttactcttacaaaaactgcaattttcccaagtatacttttaaatgtgtcctgaaaccattaccaactgtttctgcctaattttctttcacaaagtatgagtgcagaataccagcaaaacatgataaatagttcttttctgtttttcccttccaccacagaggtgctaatgggaaacaatataaatttgccaataggaaaaaaatgctaaaaggcatatactcacaaatcaaatcactaaaagttaaccatacagtagttaaccctgttaagccagggttatccaaagcaccgctcccataccactgatgcgaatggtaattttagctagtatgtaaactaatattttaattgttatgaatttattttaacatgtagtttattatacctaatacctacataccacatgtaggactacacaaatatcactgcctaagataaatctacttaagtaaaatcgtgaatccatctgaaaaataagagtgcacatgtgtatgagtgaagttttagaagcaccagtgcactatacaaattagatcgaggcacactgggaatgaccaccagcctacattaaccacaatgaacttagaccaaacttcgtgctcacagggaaactctcactgaaaggctggcacaactaaatgacagaagctgtgatctctattcctcttaccttggacacctcactgcaggctctggatcactccccaccctcctatctaccaccctaaggtttctaattccaaaggcatgaagagaagtctagagtcagtctccagggagaggaatgtcttggcctcggcagagctcttcagtattctccctggttcttattgcctcttcatatttctattacacctatgttgtccctgaaccaccaatattccctaactgtctatggcaccaagtcgaagcctgcacttccctctcagagccttatattccattattgttctctgctgcaggcctgataccagtccaaccccatttaaaagaaaaaaaaaaagatattcctgttgtcaggctgatggatttggccagaggtggattaaatggcagagcacaaaccaattcaccaggtatgagagaccagcccatactatcctcatttccccaagtgtatctgcattaacaaacttgcattttaaaaaagattaacgagagaaattttatgtaaaagaatttcaagctacttaaaggtgatttagaccacctgagaaattttagggctcactgcaggactatctcccagccagcaatcaggcagtatttacaatctggaataagggtgctgagactagaaaagggttgtcaatgggcttactaactaaactcttatttatgtatgatcagtttccatcacaaactatcctaacagctcatttagtatatagctgtctgctcacaacttcagagatgaaaaaaaaattttaacataaaacattcatcctcagaaactgaaccaatccctttaggttggctaaaggatgcttctgcaacagtcattcaccagtatgatgcaatgatgtgttctatatagtcctcaaaaattctgttttattcataccagattcttgcaagtattaccacaagtaatctcagagaatgaggtccaaagtcctgacagaggggtcccaattagagcctctcaggttatcagaatcatttgcccagacaggtatattcagaagcccaaaaatcttccctttaaacttgaaaatagagttccaaactcagttttcagtaaaatacctttgagaagggcatatttaagtttcaatgtaatatctaccacatcacctgccgagaactttaatttagaaatcatctgttttcaaaaataccatagcccagatgccaaagcatgatgtttacctttacacaaaaaaacaccaaaagaagaaagattttatttgggaaactagacctggcacttgtggtatttattttctttcatgttttataactacctttagtcacttaatcctattattgaagaattaaaggaaatcaaagagataccaatataagactagcaatttggtagacaagagggaaaaaattaggaggctgaaaaaggaacacacaaactcaccaactcagactgtttttaacagcatagcatactgtgtggccaatacccctcaaaccataaattctgagaaaagttccctagtacccagtggagagtcaaaaacaaattcctgcctcagcaatttctcaccatcattttatccatctgagcctggccctaaattttctaaaacaaagctcacaatcacatcccccttcaacttacatcctctctcatggaagaaaggtactttctgttccatcattttcctctcaaactctgcctatgacctggtccctaaaaacgaaatgttccttccacctctccaagtctaggcccttcattctcttcctccactggttccttggcagggccgggagcacagagggaatacctcccaccgctgtactggatttcccacaccgcggttcacatcgaatttttcttcttaacccccagtaatctggcttgtcttagcaattctatgaaactgcaagcacagagggttactgactcccaatagccaaataaaagctgaccaatctctccttttctaagtcctcgcccttttcgatttctgctggctctatctagccttggctctccactcgccaaggaaaattcaagactgtggttagactctagtctttcttctgtgcaatctaagtgatcccctccactgtcctcctagaaatgacatcagaaaacaatcttagacctatgcatctccagccaccagtaaataggaaagccctcgattctatcttcattaagcccttcaaccttacttcacatgtccaaaaccaaattcaaagtcttcccaggattcctgtcccattccaccttcacttccctgtatctaccaactatatcatcatcgccacgtcagtcaaatttcccttcacaggcagccaccaaggtctgctcgtttttccatactagtattgcaactcctatgagaattaatacggtttttccatattaaaatctcatccactatgactgcaggtttgcttccttcctggagttcaaaaatgactgcagtgtccagaatgagaagctgctgtaagactcctttcccatggaccagcacccatcctcaactgaaacgcagtctgggaaagtgtgaaaaaatgaaggagaaggagagagacactcagctaacgccactgccctcatctcacctgccacaaataatctgcatcttcccccagctaccaaaccgtccttcacataaatttctgttcagcccacaagctgaaaagcctcctcagcctcttattaaagacccactaaataagtcctttacttcttgatcaaaaggaatcatcgctgtgacttctaaactgtaagaaaaccaaacctttaaaagtacctgtcctcagggcttggggcagtaaaaaaaaaaaacaatctaggtgaaacgtcttctataggaaaatttattttttttgaacgaacttaaccaggcaaagcaagtaactagcaacatgtgcaccatttacttgggcaaatgtcgcccgttcctcctcggtgtcatcaaaaggtacactgggagaacagaagggttgaattgagctggtttccaaggaaccatgtcagagccgctgcggagttaagagctgcgtccacacagcagccaaatcatgaagttgcaggagcggctgttgttaacccacagctaagaataacgctcgactttccaaaataaaacgaagaaacgaagtcccctggccaatgattcggggcggcacagaggggaaacggagcttcctgcactgccctcatcactcagaacctggggtcccaggcgattcagtcaccgcccgcagaacagcgccgcgggcaccacgtgaaactcccggggccggctgggggcgggggacgaggggcgcccactcgggggtcggcagtttgcaggtgcgatgggcggccccctcacccacgtttatccggactggagcccgccgctcccggccgggtttccgggtggttcgcgctccttctgaattggcagcgaggtcgcggcaggttcgaggtaaatcggacgaagaggggaaaaagtctcaggggtctgggggcctccgcgcctcaggggaggcaagggccgggccagaggcgcgagggtgggtgagggattcccgccgcggggccgggaccggggctcgggcagtgggccctgccccgcgcgcccacgcgggccgccctaccgtggctctgcaggatctcgtgcttgagaccgccggtgtagtcgatgagctcctccaggccgcgctcgcacagctgcccgtagcccgagaacttgtgcagcaccttctccagctcgcgctccaccgtcacgcactgatccatgccggaggcggcggcgctcggctcctcggcgcccaggtgtccgcagccgttcggcccgggccccgccgaggccgcgtcctgctcctcgttccccaagcgggcggcgcgggaggctgaggcggccgaggcggcgggcgcactagccgcggcgccgggggagccccgcgcagccggagcccgcctgccccatggcgccctagccccctggcgagtcgccgctgctcccgttcgctcgctgcactcggccccgcgtccccaggccccgctcgcgacgttcgggtgcctgcgacggcgcggccgattgtttttgttttcacgggaaccgaccgatgacctggttctcccgggcggcaccaagtgccgccgactggggggagggggatggccacccgggcgaggaaaggaggcggagcgggccgtaccaagtacaccctcggggtggggggtgcgacccggcgagaacgggcggaggaacgcgacgggcgcccacacgcgccgccactctaatggtgtgcgccgtaccacacggaaggcgtgcgagggagagggcgagggtggagcgaggccccaattggcctgaggagctaaatagggaactttggagacagccccagcgctcggagagcgcaacaactacgcgctccataaacaaggaggcggaaaccggccctcaccactccgcccagaagcggggaatcccaaccaatgggcgcggggagtggtaagaagccaatccctggccgaggcgtaagccttcagccaatccgggctgaggggccaaaccaacgggctcgctgttggagggggtgacttggagagcgtaccgagaaacgagtagtttatggaaagccttgggggaaaactagacaaaaatacaaagggctgttttccataggacgtagccctgatcccaatttatttcgtctcctcatcgatcttaagggaaaggggtaccgtcattccgaacttttgggcgacggatccatctcccgggatgaaaaaccaagccaggccgcccgggggctggttctgcgtcggcggggggtccctaatgggaattaaaggcgggggtgattgggcccgggtgaggggagccgcttgctgctcgcgaaaggcccgcgccggctgtcagcgctgccccgggcttgcgacacccaggaggtcatgtccccatcccccgcggaccgtggccctttggccccttggcctggaacctctcctgacggtggcctcgccccagagccatgtgccgggcagcttagccgggtggaaagaacacgcgctggagagccgggcagcctggcccttgctccctaggaagccttatgctatcggatcggatcggctttaccccctcgggtaaatccttcccatcgcttgctatggcgtctgcagccttggcctagacctccttgatcagcatcggctgcactacctttgcatttcttcaggagcccagctagttcgtgcctcagggcctctgcacttgccctttccttggcccagaaaactcttcctcctacctttttcatcctgaagttcttctcagctcacttgtccccttacagagtcctcccctggctgaccacactaatgtacttcctccccaccgttaataccataacacattttattatttccacaccacttaaactctgaaatgatctgatgttttatttttctgtctgcaccacttacataaaaccatgacggcaggccccctgcttgtctaaattttttgcctagaacagcccctggcatgaggtggtaggcaattctttttcttaaattaacgtgataacgtttttgagccttaacttccgtataactgagaaataattggaattaatacttaactaaattgttagataaaggagaatatatgtaaatacccataataggctcatgataaccacatgataaaggtggtagtagtcattattagggcagccccaactggtattatttcagatctcccttctccccaccccatttttcttccctcttggcagatgtctctgattcttcactgagattaaaaaaaaaaaaaaaaatctagctccagcaacttctatcactcttttccaagtattgctgtgtaccacccattttgtgaacattctcatgtacccaaaggaccaggagtcccttctccctttccaagacagccgttggggcctgcgggctgcctctcacccctgtccagatcttccccctctttctctgcagtaggttcttcctttctactttcagcccaaatgggtttgacctacctgggggaggaaacttaatttaaccctcctcaagcactcatttctttcactgccaaactgcctagacaaatctatgtttattcctcccttttcttcaaggatctccttgataagctcagtcacccttttctcagtctttttttttcttctccttcaaagggttgttatagtatgaaatattccatttaaggcactcaacaaaatgcctggcacaaggtaagagccatgataatccactgatcacaaataatcaatgactcctcattacctacagcttcagatcctctctcaaggacatggtctgccctgtgtagcaacacagcacaaacccctatccaggcatgaagcactttctcaccctcagtgtgacttgagtacagcccattcatactttgccttcttctgggacacttttctttattctgtttttcgaatcctccctttcttcaagtaacacgacaagtcttactttaactagtgacaccttctagaacctaggcctgcactcttcaataccataatcaccagccacaagcaggttttttttttgtttgtgtttttttttttttgagatggagtcttactctgtcaccaaggctggagtgcagtggtgggatctcggctgactgcaacctctgcctcccgggttcaagtgattctcctacctcagcctcctgagcagctaggactacaggcacacaccaccacgcccagctaatttttgtatttttggtagagacagggtttcaccatattggcctggctggtctcaaactcctggcctcgtgatccacccgcctcagcctcccaaagtgctgggattataggcgtgagccaccgcacccgacccacgtgtagctatttaaattgaaatataagctagataatttaaaatttagttccccaattgtgctaaccacatatcaaataataaccacatgtagctggtggctactgtattaatcagcgcaaaataaatatttccatcactgtagaaaagttttgttggacagtgctgatctagaccatgaccacagtaaagttaccagccctacctttaactgctgtaagacctctgtgtaagtcatttcatgccttagtgcatactgcccccatatttttagttaacttttccaacatgtgcctttttgactcaactagactatcagttttcagatctgggctgacttctttttatctcccatgatttaatcagcatgaaaaaaagtgtttgttaaaggaaaaagaatacgcagattagaggagaagaggcttcagagttagctgggagagaaaaatagtacttgtaagggcagagatttatgttgcttcttcactttgtattggccctttctacacagtgcctaattgccttaagcctaaactgtgaattgtcaaagaagcacctctagaaacaacagggaaagaaatttagttttcagagcaactgcaaattagtttgtttttttttgttttttttttgagccagcctctcgatctgtcgcccaggctggagtgcagtggcgcgatctcggctcactgcaagctccgcctcctgggttcacgccattctcctgcctcagcctcccgagtagctgggactacaggcgcccgccaccacacccagctaatttttttttgtatttttactagagacggggtttcactgtgttagccaggatgatctcgatctcctgaccccgtgatccacgcgcctcggcctcccaaagtgctgggattacaggcgtgagccaccgcgcgccgcgcaaattagttttctataattgcattttcaccacacaataaggaagaacacacacacacacacacacacacaaaatcccactttagtatcaagtggactcctgcccccacatgctgttcagcctggagaagctttaattgatactcattctggactttgctcttgtcttcccctccactccagatttgactctgtaaaatgtaagtaaacatcaaaaaaagacgggaaaaagaaaaccttttgtctttcagccaaaatacatatttattgtaggaaaattagaaaatacaaacaagtaaacagaaataaaagtcccatgaaagcccaagacccagaaaaagaaaatcagttttaacattcggggtgaatttccacagatttttttcttttttgtgcatacacataaactcatatgcacatttttatgaaagaacgctctcattgtatttactattttgtaaacagcttttgttgtcctcttaacattcctccaacaacaaaaacagtttttagaactgcttttgacatctttttaaaatgcttaatagctgttacactagcttatagcttattcaacatatctcatacatattttcactttgaattattcttagaagactgaaaccagagagagacaagatagaaaaaggaaaaatttcatctcttaaatttgagaaattatatttttaaaaaccttctgcttttatgcaaaacacactttcagataagggtaagaaggactacatttataattctgttaataaaaatgaatcagcgaggttggcaaagaactaactaatttcctgactactctagctcacaactaatataaaagtaaaagtaaactgacaaaatgtgttattaaaagaaattctgaattgcaaaaaatagcatttcttctcatttaaacaaatcaatttttatcttgttttgttttgttttgtgttttaagagttagtgtctcgctgtgtcacccaggccagactgcagtggtgcaattatggctcactgtagtctcaaactcctgggctcaagcgattttcctgcttcagcctcccaagtagttgagattacaggcatgagttacccactgcgcctggcacatttttatcattttcaagtaaaatatatatatctatctgagacatttctgggaattgctgctatgaccagttgaagaaatgggtgaaagcacaactattagcaaaaagtcttaatctgaatattttctacatcttttatgtcacctgtgtggtttggggcccgtttgctggctggattaatgatacttgctcgccattatgactgactcttagggattggatatgcagtattgacagtattgcacttctgtgtccaccatctccgtctttcagctccactgtttgtagaagatagcctctgctcagcggcatagccctcctcactgtggccttcaccactcatgaagtccagggcagttctagtctggttgactaccagttaagttaccccctaatagacttccatgaggacctcattgacttccttgagtatagtttgtaggcactgccctcgtacctgggtgcttagcctatagggggttatttataacttttgaaacctgctctctcaggttttattgtctgagtcttttcctttctggaatctggatgtttttcttaggtttgtttcctgctcactgttggtgtgctttaccagctgtagcaggaagagtgctagcactgtaatcttgtaattcattcaacccctctcagcctcagatgctttatctataaaatgagaagcttggaatagatgacctttaagttccttccagttctaaaattacagagatgccagggcttattaagtaacatgtgaggtgcaacacaaccaaacaggaatagacagaggcatctttcctgttttcgaaagcttggagtctgaatcattacttcctcattatggaaacgtgatgaggtttgtttttttgttttggtttggatttttgatttttgattttggttttaataaatagctacaatttattgagtgcttataacacgctaggcattctgctttaaatgtgggattatctcagtcctcaaagcaaccttttaaagtaaataatgccgggtgtggtggctcatgcctgtaatctcagcactctgggaggccgaggctggcagatcacctgaggttgggagtttgagaccagcttgaccaacgtggagaaaccctgtctctactaaaaatacaaaattagccaggcatggtggcgcatgcctgtaatcccagctactcgggagcctggggcgggagaattgcttgaaccccggaggcagaggttgcggtgagccgaaatcgtgccatttcactctaggttggacaacgagagcaaaactctgtctcaaaataaataaataaataaataaataaataaataataaaatttaaaaataaatagtatttggattattatccctgtgttaacagatgaagaaattgaggcacagaggggattagtaatttatccaagattacacagctgataaagtggtagagctggaatttgaattcaaatctttctgactctataacttgtaagtcattgtacttcaaaaggcgaaattatgctccatgattacttgttaagcatgctatgtccagtagaataaaggaagctttaaccaaacttcattgttttgttttgttttgttttcaataacaaagtctactccacctaccttgcaacattgttgagagaatatatattaatgttgcaaggtaggtgaagtaaacattgttaaatatgtatttttaaattacacatatatttaaaaatatacacatatttttatatatatgatttttttaagtgctcataaaccatgaagccccacagaagtgcagggtgctattatttcctcttatgatttcactttctgtctttcatttcttagcatatgaattgtacttcttttttcaactttttttagtagttgccctaaagttgcaatatacatttacaactaatccaagtccactttcaaatagcactgtaccacttcatgggtagtgcaaatactttataataatgaaatatccctaattattccctccagtataactgctgtcattctttgcatttatatataaactataatcattcaatacatcattgctatcattttgaataaactatcatctgttagatcaacaagaaaaagttaagttttttactttattttcaactattctttctctattgctcttcctttctccatgtagatcagaatttctgacctacatcattttccttctctctgaagaacttcttttaacatttcttgcaaggcaggtctactggcaacaaattccctcaattttcatttgtctgagagagtgcttatttctccttcgtttttgaaggataattccacaggatacagaattctacgttggagggttttttctcaacagttgaaatacttcattctactcccttcttgcttgcatagtttctgagaagtcctgatataattcttacctttgttcttctataggtaaggtacttttctcctctggctcttccaagaattttttctttatcattgaatgctctggcatatttcaaaataactttttcctttctccttccagaagcatggattttttttctctgatattcactgtgagaacctaccaaagctctaagaggtaaaacccacacaagtgtgagaagcttccatgacagcctcgccccactgccccatcctagggtttttaactctcagacttgtccactgtgagtctcagcatttcttcaattacagtttaggttttcctcatgagtactgcttcactcagagatttctgtttctgagatgatgctccagcatgttgcaattctctgtatctgcttatctgaccccccagcttaggaggcagcagtttgccctgtgacctcacttctgtgaagaatctaagaatactggcctcagcaatatggtggaaaacacctctacaaaaaatgagccaggcaaggtgatgtgcgcctatagtcccagctatgcaggaggctgaggcaggaggataacttgagcccaggaggtcgaggctgtagtaagccatgattgtgcccccgcactcagcttaggcaaaaagacaccctgtctcaaaacaaaatctaagaagagtttgttcagtttttgcttgtggttagaatggagtgatgacttccaaactccttacataaactggaaactggaagtcttcctatgtatttgattcaacctgtttatatatcttatgcatctgtgcagggtaaggtttgggttgtaaattgataaagtacacgattcatggcttttgacaacctggaggagactctaggcggtaaactaaagcaagtgtttaaaaatggccttttgaggccaggcactgtggctcacacctgtaatcccagcagtttgggaggccaaggtgggcagattgcttgaaccgaggagttcaagaccagcctgggcaccacggcgaaacgccatctctacaaaaaatataaaaaattagcagggcatggtggcatgtgcctgtagtcccagctacttgggaggctgaggtagaaggatagcttgagcccaggaggtagaggttgcagtcagcctaaatcacaacactgcattccagcctaggcaacagagccacaccctgtttcaaaaaataaaataaaataaaaatggccttttgagacttctggttccaccaagatagagtagtcccatttttcctaggccctctcagaaaaacctggatataacacaaaaaacaagcataggaagactttgaaagttggaaagaagtcagactgcctagggatcccaagacttgaggaatgacatgtggtaaattccctagtttcctcatttcctcctaaatgtcggacaaggcactacagaattctgcagccctgcaccatgaataggcacagacaaaacaaagacccatggaaagcctgttttcctgagtcaaagaatagaaaaaagtgtggcccaacaatgaaaaacctcatcagcttcttccctagtccaaccaaacactgatggaacaactgcattccccaaacctcaacccccagcacagtttcagcagagccaaccaggaagttgatattccactctaccccttaacctatggaagtgggaggcagctctccagttccctgtgggtgactttggtaggtctgactgggagctgaccttttattccctaccttatagaagcagacaatgctccagttcccccagcagattgagcaaggagacaagcttacatccccaatcagaggcatcaaggtggtcgaagttggtgccacactttcactgggatgttgtcagtggagcaataggagagctgaacttccagcccaccatttgcaataagaccatgtgagtcagtacttcagttttgccaagttactgtcagtggggcccagagggaaactaaacatgcctgtgaagaagaagaaggaagaaggaagaagaagaagaagaattattaaataggatacaaatccaaactcttataatatgctatccaaaatatccaggatacaataaaaaatcattcatccaagaaccagaaaaatcacaacacggatgagaaaagcaatcaacggctgtcaaatgatgagataaatcaagtgttcaaattatctaacaatgatattaaaatagcatcataaaatgcttcaacaatcattcaaattctcttgaaacaaaaatttaaaacccagcaaaaaaaaagagaatttattaaagaattaaatgaaaattatagaacagaaaacaagtacaagtaaaattttaaaacttgctgtatgggctcgatagtagattgaagataccataggatagaatcagtgattgaggacagacagatagaacttacccaatctgaacaatagagataggggaaataatgaacagggtctcaaggatctgcatgatatttaaaaggaaaaaaaaattcaaagaatagctgaaaattccccttacttggcaaaagagatgaaacttcagattcaggaaactgaacaaatcccaagtaggataaactgaaagaaatctatgatgctaagacatgtgataattaagcttctgaaggttgaagataaagaaaaaatattgatactgaaaacagccagagagaaatggtgcattattgataggggagaaccaattcaagtgacagcagatttttaacctgaaaccatggagaccagagggaaatggcataacattcttcaagtactgaactaaaagaattgtctacctagaatccaatgtccagtgaaaatgtccttcagtaatgaaagggaaatggagacatctcagatgaaggaaaggtaagagaatttgtcaccagcagacctaccaaaaagaatggctaaagaaatttcctaaacagaaaggaaattataaaagaaggaaacttggaacacgaaggaaaaccacagcaaaaaaatatgggtatatacaataaactttcctcctcttgagtttttaaaatttctaaattgatagtggaagcaaaaattatagcattgtttgatgtagttctaaatgcatgtagagaaaatatttaagactattataaacagggtgataatgtaaagggaggtaaggtttctatatttaaactggtaaaaagatgacaccagtagactctgatgaatatatataatgtaaaacctagagcaaccactaaaaagatatacaaaggggtgcaataaaaacgttgtagataaaggggaaggggtgttattgtttaatgggtagagagtttctgtttggggtgatgaaaagattctggagatgaatagtggtgattgaacaaataacccacaggctcgcaggatacaggaaatcagataaatgaaaacaaagagaacacacagaaacaaaaaaatggcatacataagccctaacatgtaattacattaaatgtaaatgtacatttgcaaatataacaattaaaaatgagattggcagagtggattaaaagccaggtgctgtggtgcatacctgtaatcccagctactcaggaggctgaggcaggaggatcacttcagcccaggagtttgagaccagcctgggcagcatagcaagacccttactcaaaagaaaaagaaaaatgtcccaactctatgatgtctgcaataagttcatttcaaacataatgatacagacaggttaaatgtaaaaagatatacaaacataatcaaaagaaaacataaatggctatattaataccacctaaagaagacttcagagcaaagaaaattaccagtgacagaattggacattatatagtgataagagggtcaagaagacatggcaattcaaaatatataagcactagacaacagaacagcaagatatgtgaaataaaaaactgatagaactggaaggagaaatagatcaattcaaaataatagttggagacttcaacacccatctatcaatgattgatagaacaactagacaaaatcagcagggatttgaaaaaactcagcatcaccaccaacagacatgatttaatcaacattatagaatactccacccaataacaccaagaatacacattctttttcagtgcccatgaaacatataccaacatagatcatatcctgagccatagaacaaaactcaacaaattataaaaaattgaaatttgttcaatttgttcaattgaaattgaagttatgttctgtgagcacaatggaattgaaccagaaatacataatacaaaagtattatggggctcaggacagttcagaaggagaggagccctgggagaaggctgagctcagatggttggggcagttgggggaaagaagtgagctggctctggagggccaggctactccatatggcaccctgctgggcagaggcagctccatgccagggcacaggacttggtgaggggaacaggagctggacctcagtcccattggccccctggctgggtgccctcttacaggggcccaactgtacatggtgaccctggatgttggcctgggaacctgtgatcttctactacatctggggctgacagaggactcgggggctgagaaggagacatggtctcacgatttggagtagagagaaggcttgaccagaagggactggctgtgcagcaggatagctggaggcctattggctgggcatcctgtctactgggtcctgggccggtcttggcagcaaagtcagggcagatagcaccagcaagccacaaccgtcctgctccacagagcgctagaacagccactcatcagttacagcaggactataacgatgaccaagaagagaagacaaaacagaagagggtaggtagaccagaaagagtgttcagaaagaagcttgaaagaggagaggagagacactcctgagtagtagcaccaacctaccagctagatttgtaacctccaactactactttctggcctcagttttgtcacctgactaagagggttggaataaaacgaatttaagtctcttttacctttgactaggactgacccaggctggcctttcaccagctcctgtccccatttccaagggaagctgggtggggggtagagggtgtggatgacttagtgtggtccatcctcagaccaaaaacccagctaggggcccacacattactgtctgaaacaccatgctcaggtgtgaacaaagatgcttggttactgtggacttttagttccaaggagggctgtgtctttcttaactcaatggaagaatcaaattaggagcctggctgggcatggtgactcacacctgtaatccagcactttgggaggctgagacaagaggatcacttgaaatcaggagttcaagaccagcctgggcaacacagcgagaccccatctcttaaaaaaaaaataggagcccacatcttcagattcccagggctgagattctgggaaactcagccaaactccagagctgatgcaagtagcaaaggaccttttttttggtcactggagcctggaggacagacaagggcaagaggcagagaattccagcctttacaggtcacagagaaagtggaggaggaggaggtagctgatgcctccacacccaggagggagggggaaatgatgagcaagatttttcaccctttcagtaaaacaaaaaaaattatttctcctatttccttctctgagattaatgataaactgtctatcccctaaaagaaaatgataaagactctaattttacttggaggcttagaaatgccatttctacgcaaaacagggagcccataatcagacttgagcggggcagagctttgatagaaaatgttttcctctctccctctatttcttcccctccttccccttgcaaaccaagatgcccgacagctaagaacaatgctcaataaaatgaaataatattttagtcaaaataggccaagactgctcccagccaactgtaaattagcattttgagggcaaatatgcagacaatttgagataatgaagcctgattattcaatccaatgaatgttaactagggagcagaggctccactgccttatctcactcccttcgatttatttttttaatcgtttcacatttgaactctttatttgtttctgttttatgcgccccctcccttcctctgtcacacacacacacacacacacacacacacacacacacacacacacacacacacacagagtctccctcccttctctcctccattcctgcccaggctgcagaaggggaccgttgcaggggccatcagtctttccacccagcctggccttcgggatggggtcagcacgcctcatggagcccctactgtgtgcatggtcctttgtagagttgcagggatttgggggtcaatgtgcactaaacagatgacacacaccctgcttcttagaacaggcctgggtgcaggagctggagaatggcaggtttataaaggaacatgccaggtacatgtggggctcagggaagtgggggtggaaggacattgcctttcatgtccttcaatccaccctccatgaaaggtcaatgtggagcacgccctgtccccaggagtcatggaaaactttcttaaattatcctttgtcccaggcaggactcactgcataatttgcaggacccagtggaaaatgaaatgcaggggaacttgcccaaaaatcattgagaatttcaagatagtcatggcagagcattaggacaccaagcaggggaccttctgagctcggggcctgggcaactgcgcacgccacacacccatgcagctggcctgcctccagcagctaaggggcagcctcaggccagtgggaggtaacataatgaggccttctgaaggagggttgaagcccttctcaagtgaagagagaggtttctgagacgctggggagggtcccagctgactggggctagcccctggggttgcgggttgccataggcaggagccccaatgcctgaacagctgtcagcatggtggtttccccttggaggtacccatccttcagcctagagatgatgtttacttggtggcggaaagaacagctcccaactgggcgaggctccccgctgttacggtgctcacctggcctcaacctcctccttgggtcctggccctgctttttccctcacgagtgtggcctcccagtccctgccctgtccccatgagctcctgcctgggtccagcccctgcagctgcccttccctcggggcccccttaccactcctttcagtgtgtgtagcaggaagtccccgcctgagcatggcctcccaccttgtctgctctgctcctcagcttgccctctccccaccagacctcctgcttgtcgagtgccctgtccatcactctcatcttcccgctgcctctgctcatgctgggccctcacctggggggtcttcagcccccttccacctcctatctcctctccacccatttcttcacacccagccaaagaaggcagctctgccttttaccggatgtgctcttgagtgggtgatttcacctccttgagctttagtttccctgtgggtaaatgggattgtagtggggcctgtctcgtgaggtgagtgagaagaccaaccaagctggtgtaagtaaagccccgaccccgggctggcccacctgaatgtgcatacctgttagcttgcactctggggagcctctgggaagcttcagaatgctacagccagttggaacagctgccctcctagaacttccgtagcctttggaatcctggtcacgcagtgtagcctgcattcttacactgtttcctccacctgatagaagtttcccaagagtagtgtggtgagcacttaggacgtgctccctcagcctcctgtgccaccctccttttgtctggagaggctggaaaattaagagctgcatctcccagattcccttgcagctaggcttctggaagtgaattgggtgatactgatcagttagactcctgaaactcagaaggtggacatgagactctttcctgccctgggtttctaatggctatcaagatagtagaaacacaattgcctttttctgcaccagattcccattgtccatcctctagcttctgggtgtcaagagtcaaaaactgttgttttggtttcagtaatggcttgattctggtccttcctacccttccttccttctttccttccttccttccttctttcctccctctctccctccctttctttctctttctttcttcctttcctttctttctctctccctctttctctttctttctttccccttccttccttctttccttcctttccttcctgtcccttccttcccttcccttttcttccctcccctcccttccccttccttccttccttctttccttccttccttttccttccttccttccttttccttttcctttcttcttttcttttttctttcaagatagagtctcgctctgttgcccaggctggagtgcagtggtgcaatcatgactcactgcagcctcaacctcctgggttcaagcgatcctcccacctcagcttcctaagtagctgggactataggtgccaccacgcccagctaatttttacgttttttgtagagagggggtctcagccttctgcttcagattactagtataagccactgtgtccagctgattctgggtttcttgatctctgtattgcagctacagtggtttcaaactcaattcaaggggtggtctcagaggttgtagtgccactgggagttagttcagaattctggaattccttcctggatgttcaggttagaacctaccattctggcttttccaaaaattttgaaagtatctaattctctgttaagtctctctttggtgggtcagtgcagtggatcatgcctggaatcccagtattttgggaggctgaggtaggaggatcacttgagcccagaagtttgagaccagcctgggcaatataggaagacctcccatttctacaaaaaataagtttaaaaaattagctggggccaggcatggtggctcatgcctgtaatcccagcactttgggaggcccaggtgggcagattgccaggtcaagagattgagaccatcctggccaacatggtgaaaccccgtctctactaaaaatacaaaaattagctgggtatggtggcacctgcctgtagtcccagctactcgggaggccgaggcaggagaatcatttgagccctggaggcggaggttgcagtgagccaagatcgagccattgtattccagcctggtgacagagcgagactctgtctcaaaaaaaaaaaaaaaaaaaaaaaaattagctgggtgtggtggtgtgtgcctgtagtctcagcttcttgggaggctgaggtgggaggatagcttgagcccaggagattgaggctgcagtgagctatgattgtgccactgcactctagcctgtctcaaaaaaaaaaaaaaaaaaaacaaattagctgggtttggtggtgtgtgcctgtagtcccagcttcttgggaggctgaggtgggaggatggcttgagtgcaggagattgaggctgcagtgagctgtgatcatgccactgcactctagcctgtctcaaaaaaaaaaaaaatctctctttggttaaaaatgcccagatgggctttctacattaaatcctgacaggcacaagaataaactaagccatctctttctcctgcacccccactgcacagcacctagtgtaggtctccctcttcctaagaaagccgcatgtcccataccagctgacccggcaccatggctggcctctgagctgcccgagcacatgctggacatttgcctctttgtgcatcgttcatttcctgccgttgccctgctctgtcctgtaagcaggaagctgactcctgcaaattacatttcccttgtccacatgcacagtgccttgtccactggtttcttgttgggttcaaccaatgcaaagcactggtgagaaaccggagggtgagagacggggaaggccagagtatttcctgtcctctctctgcttccagtggcatctattttgtggagccagcttctgccaggcaacacctgcaccacggcctcccagctcccagccattggcccctccacagttaaagctctgccctggcaccccagctcctggagtcatgtaaatactatctccctgctctgactgtctagatctatgggtagtagcagcttcctgaaattgctaatcttcgagttgcctcaccctcccctgttttcagcttttccaacactgtcgtaactgggttctcaaatgaaatcacctctctagtgagctacctggtgagctgggttttcctgacagtgtggttcctcctatctgctacaagtggggttcggggccttgagccacgtcttccctccttgtggacacagtctgtctcccctgcggcctccctggccattttgtcctggcccagcctgaagaaacatctgggcaaaatccttcggggtccctttccccagctgaggagtgggggggcgcaggggaggagccagggcgaacggcagctttcgccaacacctcactgttctcttctcgacatgtttactcacaggctgtctgggaagtgagaatcctccctaatggatgtttcacccaattaaataattaactccaagtgttgctaagcatcctcgcctctcaccttccagtcctggaggcgtcctcatgccaggctgcggctgctgctgagacaaggagcctagtgggaggagccaggagtgggggacagtgcccctgatgcttctgtacaggatgagggagataaatgcacctgagagggaaggtaaggagggctgttcagataggaggctgaggggaggctgagactcacaggaagtggcattagaaccttctggagcctttctattgaatattaagtccttgaaggtttccctctcccccaattcttcccatacgccacagcagggtccttgttccttcaaagaaggggaaaggaagggacacaggcttcttcctaatgggtagtcttgcgttatgaggagttacagagctgagctgctctactaaccagacagtcacataaggaaccccgaggggagaggctaaatacattcatactgtggaatatcactcaaccgttaaaaagaacaagatacattttcctgtatagataggaaaagatctgtaagatactataaagtgaaaaaatgcagataccagtacatgcagtttaatttaagtaaaaataatgtgcacatgtatgcatatacttgtctacctgtggaaggaggactggaactagggacaccaaactattccgaggggtgatatatagaacaaagctcctttcatgaaaaattgaactcacatttctgcagtgtaatcacacattctatctggatttattgtttaattgttttctattgtcaaacatgtctaagttattgacattagaacagagaaactccaacagagaaagggagcacagctacattttttttcttaaagattatatactatttctttacatggatgtcttgattgatttagttattgattcatattacaatggaaggctgaatcaacttatacggctttgaattaattgtataccttctattgatgagtgaataaatagttttttaacattcaccacaaaacatataaacattaacaattttgtgatattttacataaaacgtgcaagaaattctaaatttgaaattagtatttattttatagaacatattatgaaatactttttaaattagtaatcagaaaaaagatgattaaatagtaaaaacaatcatttgtatttttaccagatatcatcacttttaaaagtttggtttatattcttccagatagaacaatatactaaaataatataaataggttattatgtcaacaaacatttatatatatttttacagctggttacccccatgcaaaaacgtgccatatgtaatttttctatctaatatatttgaaaatgtatgttatttaaaagttttcctattgtaaacaatactataatgaatattattaaagacagtcttaagttagcaaagactgaaaggacatgttctctagtttagagtgtatgacattcaatcaagacctagaagacttatgccatcccccaagaatgtactaaaaatcatctgggattatagaaggaattcagggaaccctatctgcaagattatttacatgccagatccagtaatttatgatcttcttggtgtctgtaaagtcataaaagtcacaggattacaccatagtcatttgcttgaaattgcattcaagatatctgcattccattccttagatgctttccaaaataataaaatacctggcaggattctgtgtggaatctcagtcttcctatgtgggatgatcacatgtagcatccttagtgccaaacctaataaaacaagcttattgtttttggttttggcttttttttttttttttttttttttggagcatggttgaaaaaacttatgatacccagaacaggtttaataaatttttctaaactggatattgattatcaaagccaattatatgcctctaatatattgatttggagaatttagaaaatcaaatatttcaaatatatcagaaatctacatactaataaatttaaatgaaaaaatttctattaactaatgtatgtcagcagcttttattgacaaactcattttatttttccaaaggcatacaaagtagtttctataataaacctggcaaaaatagatatctagctagcattagcccaataatacaaataaaatcaaatcttgaaagaaatggaactttttaccattccagatagtataataaatgtaatagtataataaattcgcatagctctataacgcagatttggctaaatatgactctataaaatgacatttaaaagaacagtgttgtatacagcatatggatgacatagtttcttacaattttatagtaaaataataattacctgaataaggtaacatcaatcacattcatttaaaatagttgatttataaactagcttgattttaaaacaaataaaagaaactatctactaaggtaacaatgagtatcaattagagtgtcacttcacaaactttaatgttcatacatatgatggcatcttgttaaaacagagcctctgtttcagtagttctgcaccgacctgagaagctatgcttctcacaaacttcaagatgagattgatgttgttcttctatgaactatactttgagtaacaccagattatgagattattaataattcaaaaaataagcttattttttaggaaaaagtataaaaaaatcaggcattcaaactccacaaaaatactttttaagccatattacaaatagaagctttaaaatacatttcttttctctgcatggtttatgaatcttcatttataggactggctaacattgacacaaagttcacagtgggtattatatccatatatctacataagatgttcagcttctctcattctcagcaggtatggtctcattaacacctgtgattttaaaagcctgagtttctcccagcaagatgtagttttattaatatgtgttatatttatatatctctcactttgctatgttataatgtggaaccaaacctatagctattgctctagtatctgtttacttcataaatattgactgctagaggtgtgaatcctactagggtcttttgcataattatatgagggtaagcagtaaacaaaaatgactgaagaataaatgaaaataataacttagcttaaatgtaaagtaagatgacaagaataccatgaaataagagtcacagaaagaatgtttgctgctgttatttaaatataaatgttattatttttgaagaaataaatgtgtatacatctatctctttcagaagaattgtgaattgtttacaaatatattttctgaaatatcttttttttcttagtactgaggtctgatggtaaatgtttagtaactagctttgtataataaaaagccagatttatggtgttttcagattttcatggtgtaaaaattcccagtggccaatttcaaactactgacatgagatctcggaacatagcattaggaaaagatgcagaaatgggcttttttagaagccagtgcataatacttccaacacaacagtgacttagcagactgagcgtcactttactttaatgattaatcacaataattgtcaactgacattttttatttaatgacttataacatggttccaattataaaatgtggaaaatataagtaaaataaagacaaaattaacaataaatctaacacccccaaaatgattgttacacatatgtatatatcctttgagagcttttattaaaatatttatacttgtatttgttacaaaattgaaaatgtgttttatttcactttggcattctacccaaactgacaatatactataattttctacaattattacttattcctttaaaagtacatacaaaactgaatgaaactctatgctcccaatatactaaaatcaaatgattttattctctatagtttatagtttatattctataaaatctatagaatgattttattctctaaatatacatatttagaatgttttgaaaattattggtcaatgaacattctgacgcagaaatccttgtaaatattacctctgcttctttagggtaaatacctaaaagaggaattattgagccaaaaagtgcaattactttgagggtttctgataagtgtccctaaattgcactcaggaaaatttgtgtaagtttaaactcttaagtggagttgctggagaccctctttcacctgattcataaaacaatcttaattagaaagaagaaacaatccaaatgtctttgaggttcaagtacaccacatactatcgcatttaatttttatagtctttaattttattagttcaatttttcatatttgaattgcctgttagcattctttttcttttaatttatgtaggactatttacataataatgccatcaatcatttttatatgtgtgtcaagtttatcttctattgaataatttatcttcataattttgttcataatatttattgaaattagaatgcataaatattaaacttaaaattatgttatatagtataccatgcatgattataaatattatgtcaaatgtataaagtggtttttgctgtcagtttctgatttctccacccgatataattattttatattacctctaatacaacagattcaattctggataatttggggaacaacataagaacagtagtaatcaaaactaaataaaataactacatgcagtttacaaaaaaagttcacatcctatgaatatatttaaattatacttcacttaaatgtatcatttcactatgcattttctattgatttcataatcatattcctttattccatttttccccctctgctggcagaaagtttctattttctgttggcatttagagtatcctaacatttacaacatgcattcatgatgtattaaactataacatgaattaatatttgcctcaatttacagcaaaatgaagaccttctaaaattgtaactccatttatttttcccttccaacttccatgctatttttataatacattttagtatatgctatgactcccaaaaacattgttattgctattattatgctacattgtaaatattcatttaaatttacccactggaatacaactttgtgtttcttattacttcctgaatctataaactaccacttaataccatttcatttttgtttcaaaggtaaccatgagtgtgggttctgtcttagtgaattacttcagttttcagtgatctaaaaaggtttttgtattatcttcacttgtgaagttttaactgtatatgggattgaagattagaaattattttctttaggccgggcgcggtggctcacgcctgtaatcccagcactttgggaggctgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggaaggagaatggcgtgaacccgggaggcggagcttgcagtgagccgagatcccgccactgcactccagcctgggtgatagagcgagactccgtctcaaaaaaaaaaaaaaaaaaaaaaaaaaaaaaaaaaaaaaagaaattattttctttcagtgcatagaggttataattctattgtcttttcacttacattgtttcatttagcaagttaagagtctaaaggtgttcttttaaaggaaacgtgtttttcccctgactgtccatgatatttttctcttttactctatgtttctgcaattcctctctgtgtcatcaggttttgaattgctttctgtgtttttctgctttggattcatgtttccctttcaattaatagtttaattcatttagaagcatatcttccttgttcttgctctactttcttgagcccgtaattatatgtaagacttttcattaacctttgcactctacaatattttctatccttttctttactatgtttgattctacatattttattctaacatacctgctagatcattaatttccttatcaactgctctcaaacctatcttttgtgttttttatattgtttccttttcacatctgaaatgccaattttaagcattccaattatttaataaaatgtttatattttgttttttatcttcagaataattctactacctgggataattctactagtgatgcacaatttttgttccttagctcagctagttcagattcttgtctcacaaccaggaagaattagacaagtggacatcaaagagtgagtggagtagaatttattaagtgaaaggaaagctctcaggaaaaaagagaggatgtgggggttggttctcctacccaaagacaggaaagttccccaatatggctgagcccagggttttttgtgggctgaatagggagtgtgtgctgattggtttgtgagtatgcagaaaaggttaaagcaaagacaccactcaaaggtgggcatgacaacatagaaaaccaattaggcggctgggtgcagtggctcatgcctgtaatcccagcattttgagaggccaaggatagtgggtcacctgaggtcaggagttcgaggccaccctggcaaacacggtgaaacttcatctctactaaaaatacaaaaaattagctaggcatgttggcacgtgcctgtaatcccagctactcggaaggctgaggcatgagaaacgcttgtacccgggaagtggaggttgcagtgagccgaggtcccaccaccgcactccaacctgggccacacagcgagtcactatctgaaaagaaaaaaaaaaaataggtaaaataggtgaaaaagggggatcaatcagaggaaagcacacaaaacaggaaggtgggtcctcaatccaatccaaagatttacccagcacagtttccagcttgaatgttggatttcacggggaactcatccctatctgccttgggatttgtctgcctcctgtctctatcaatcactagctggccttttctgttattttgctctttttccttgttttctttcattttgttttgcctccttctgtgctaggttatcttttattttatgctggatttatatttgaaaaatttattttgttcacttgcaatactcattacagatacaaagaatggcattgttttatatttttataatttatttaatgcctgacttaatataagacatgctgatttattagatctacttctgctttcggtatgttgtgatatcatacattatgtagtctctggaaaactctacttactttacacatgagagagaaagagagagagaatgaaaaaatcaaataagatcttaatattgttatattatctcaggacctcatccctttgcctcttgagagtgggatgttaatggcttcacattgctcctgattcactattttttgtttgtgccattaagtttgtcaaaactattgaaaacagtagagacctcacttatacagccattgacatttattcctctttttgtaacattatgaatgctaatctcaaaagcacaaagtttgaaaaatcgttgcttttatctttaaattacctgggtcttcaatctttcatccctttggacaagtggaaaattccatacttgtagtttttgctggtaaagtatctgaaactaccctgtggtaggcaccctctgagataaaccctaataattcccgcctcctagtattcacagccttaggtcatcccatctttaccttaagtgtgacgtagactggcttcaaaataattctgagaaactatttcactttcaaaattataggctatgaaaagactgtgatttacatcttgggtactctctctcagatggtctcttgaatggctcactctgtggatagccagctttcatgatgtgaggcagtctcagatggtctcttgaatggctcactctgcagatagccagctttcatgatgtgaggcagagtcttgtggagtaatccacagggtggtggtgttgaggtccaccaaaaagcacatgagtgagtttagaagaaggtccctccaccacctcctttgaaatgaatcttcagataagatcacaaccccaactggcaactgcacagcaaattcaggagagcctttgagccaaaggtgcccaaaagccatgcctgaattcctgatcctcagaaattgagataataaatgcttgtttctttaagatacaaagacttgtgctaataagctatgcagtagtagatagttaacacagtcttctctttcctggtttatcacatttgtgccaaatattctctttgctcaaactcaagcccctacttctaaaaatacaaaacattgcatctcttctctgaatctttcttgaggcaggttcttaaatttctatacctccatatgcacacaaaacacatattcctcctgacatctttctatctttcagaaccgttgctggtgaaaagagtgaaggtcctctgcgtacttttttcctgaattctcatggacctctctgccttttccaaataagggcaatctcctttccttgagtcattgttttcccacaaatcttctacttgactgaagtgttcagggcacataggatgacttcaatatgcctgaatttacaaaagacctttatcttgttttttatttttgattctattacagtatctgaggaaaggagtcaagagattgcctttctgtgttatatgaattgagagaaagttctgttacacacacataaattaataatttaatttttcacctcaaatcttttcttaaaaccaactaactataattttctaattacagaacaacttcttacatcagaaaatggctctacatttctactcagaactctctcagtttaggactaatcttactaactcattaaaagcttactaattcattattaaaatgctctggtttccctttttataagttgttcattacagtccatgtccaaatggaatggacctttctttgtaattctttacacactgtcttaggccagttgggctgctataacaaaaatggcatatactggatggtttataagaaacacatatttatttctcacagttctgaaggatgagaagtcaaagactgaggcactggcagattcagtgtctgggagcacccatttctcatagatgacatcttcttactgcacacttacatggtgaaagggtctagttaattctctgtgttctcttttataggggcactaatcacagtcatgaggatttgacccttatgacctaatatccacccaaagtcttcacctcctattatcatcacactgggggttcaaatttcagaatatgaatttggtggcgggggcacaaatgtgttatgggggacagaccataacacatatatctgtaattgttttattttttcagaaagtgatcgtattatttctgtgacatgttatgccagaaaataatactacctttacgcttgaatcacaatgtagctatcaaatataccttttcctataaaactccattacatagcatttaatatttaaaagtgatatttgaggcaaattattgcctcacagcttaatcctttcattccacattcaaagcatctcccatgattgtcctcatacaacaacaatctgtctgtgcacaagtggattaattcttatctattttatactttaaacacttacacttctaagtgttctctacatacttccgattagactgcaattacttctgcaccaacctaatacaaaataacttgtttttttttaattttgatcccacaggccttaatttgtatcaatcacttttaataaaagtgaggttaagtaatattttttgagtctctacaatttatttagtggcatatacactgcagatctcattctcttatctttcacattagtgatgcagttatatattagaacaggaccttattaagataataatgaagatatttttcactgctccagtggtcacgattggattttcatcattcagatacctaagaacagtggtccacagcctttttggcaccagggaccagctttgtggaagacaatttttccacagatggggcacggagtacagtttggggatgaaactgttccacctcagatcaacaggaattatattctcataaggagcacccaacctagatacctcacatgcatggttcacaatagggttcatgctcctgtgagactctgatgccaccactgatctaagaggagacagagctcaggcagtaatgcttgctccccactgctcacctccggctttgcggccccattcctaacaggccatggactggtacaggtccctggcccaggggttggggaccgctgcctaagaacataaatatggaaatatttttgctcaaatgcacctaaccttcagatggctaaaaaccttttagcacccggggtgtaggattgagagtggagattactggctgagagaaacagcaaaaaacattcctcccattgaaattaaatcactctacaattgggtttaattgctggacctacctggtaactaacaaaaatactaaacataattgattgcctcatcatttgaaaacaagaggtcactgaatcaaataaatggtaggaaaatttagaaccaataaaacaaaacattttggataaaagttatttctctcttagacctgttgccatgagagtcccataaatgaaccagatttatagttagcagactttctcagtcacttataaataatgaccactgacacataaaatgcattcacaagtagatgcttagattaccacaaaggccttaagacctaaaacatcaataatgtaatgagctttgttttttgctacagacaaacaaaaaatacaccctgcaattttataaaaaattcaggattaaagatttatgtacgcttatgactcaaatgtaaccattattgtaagaatgcatggtaagcatgacattgtttcactagtcttgctacatcttaaaattaattcgttcattcatctgtccatccagaaaggatgttactatgatatacagcttctaaatggcccccaaccaatccccaaatcttgtcattgtggaatcccttcctcttgagcatggactagaccatgtaactcacttcaaatgaatgcaatatgaaaaaagagatgttacttccaagactgattataaagggattgtgactttttctctactaggccctattttactctctctcttttttctttttctctccctttctctctttctgtctgtctctctctctgttcatctgtctctcactctttctctctgtcaaaaccctgattctaaggaaaacaggaaggtatgttttagtgaattctcataattttattttggcccagcatccattttgaatataaatctaactttctcatactagaagcaggactcagtcacacttgacagtttccagttctttaaccacatccaccctcagttcccaaatgtgattggtccacatatttgcctgatacaactgctccctggtgaccacttctacttccctatgggacagctagacatagcctacctgactgaccccactgaccctcagacctcacatggactgtacagatatgtcacagtgactacctgtcagtcacagcactacgtcctggaactctaaaacttatgtttgcttgctttaaacccaccacttagaactccctgtgggtaacctatttagataaggtcctggatccaataaaggcattggctgatagggttctctctctctctctctctctctctctctctctctctctctctctctctctctctctcctctctctctctctctctccctccctccctccacactccctgatctcttcgagtggcctccagcatgcagtgtaaatctcaagacctctaagtaataaaatttttattttcatcttgtgtcttgccaaatcgttgaaagaatactctctatcttaaggatcctaaattaaaatacatgctataaacagccctacagagagaggcacatgtgccaaaaagcttatctttctggctaactgccagtaacaaccggagggcagccaacagccaaacaagtgaccttataagagaattccacccccagtggagactttaaataatcacaaccctggcaaagaccttaactgtagctttatgagaattctgaatcacaggtgcacagctaaatagtgcctggattcttaattcagacaaattgtgatataacaaatgcttgttgaataagttcttaagattgggggttattttttatgaaacaatacataaataaagcagttaagtattaatacatagactctataatcaaatgacctgtgatgaatttctggctccataattcttagcttctttatcttagtcaatttatacattttttatatatcaatgtccttgtttataaagcaggtataataatagtacctctcacatcaagttctttcaagtttaaaacccaaatgtacatacagagatcttagagcagtgcctgattcacagtaggcacttaaattttagctactgaagctcatttatttgaacaataatattaagactataaaaagttactaatacactttgcgaaattgagcaggtgacataatcaccttgggtctcggtattctttcattcattcaaaaatatttaataagcaccaattctgcatcaacctgcgtatatatttataataagagggagagaaagcaacaggaataatagtgctgccactaagtgaaagaggaagactgcaggagaaacagatttcagggagaatatacggggcagtcaaataccaagagtgaagttgtatgagctgtcaatgcttgtgcagttaatatgttatcattatctaaggagcattatctaaggagcagtcattctcaaacatttatgagcatctgatatagggcccaagaagttgcatttcaacaaaatgacaaataatactacagctgctgctccaggaatcacactacagtccattaatgtggaatatgttaaaacaataaaaaaagtgagtttgattattattatcatttataataatcggggaaaaaatgcttgtccccctaaatgtaaaaccgttcttggtttaattgagaaataattgctatggttgctgtggaatttagtaaattttataagtataaaatataaccttccaatcaacacatttttcctacataaatttaataaacattgcattgcacgtggaaattaataagtggaaatcttagttacactgtcagttccaaaataaacagacttagcttaaacatttgtttcaggtttaagttactagcgacatagaagttatccctatctatttaatgttgtgcaatgttaattaaaattgtatttaaaaattttttttcaaaggtttattcctactatgtattgactttgtattggaggccgtattaaatttccatatttgctcttacatttttaatatctttcttaggattttctacataaatagtcatttgtaaacaaatgtgttacgctcctttatttccaatcagtatatttttaaacgttttttcttgcttaaatatattagctacggtctctagtagaatgttaattggaagtactgaaggcaaatgtattttcgttcttcaaaaattaggaaggaataatcaattttctaccattatgtatgatccttactgtggaatttttatagatagcctttataaagctatttatatttttctgaaaatatttataacgaataaatttttaattttgtcaaaagctttttctgcacttcttaagatgaccatagatttttttaaattatagcaatgtggagaaaataccttaattgattttgaatgctaaaccaatatttcattcctggaataaaatcttttttatgttgccagatttgatcgttaaacttctataaaaaaatctttgcattatgtttaaggggtactcctctgtatttttaaagttttgacataatatggtctacaatgatgaattcctaaaatgagttttaggtattttccactaattttttggaaaaattttgtgtaaaagtattattttttcttgaaatattttatataatttaccaatgaaggtaattagcccaggatttttcttttttggaagatttttatttattaatttaatttatttaacagacatggtgttattctggttttatgtttcttcagttatactgtagtttatattatttaaagcctttgcacatttcatcaagaatgtcaaatttgacaaagatttattgacactttttcctttttattgttgtaatacttgtagtagagggtagcaaacttttcttctgtaagaggccagattggaaatattttaggcttctcagttagtgtagtctctgacataactcttcaaatctgttgtaatgtgaaagtagccatagagaacacaaaaataaacggatgtggctatgttctagtacaattttttttttcacaaaaacaggctataggcaatacttggttttgagaacttaatatgctgattctaatttagagatatctagatgtataaataggatcaactacaatgtgccctgttgtattacagatattgtcaatttgtgttttttcttttttcctcatccgattgtctagtggcttttccttttcatttatctatccaaagagcaaaattttggtttgatacattttctctatctatttttttggatataactttcttttctaaaagtttgggtgaatatttaaggcatgcgttttaaaccttccttcttttctaatacaagcactcaagatttataatttttctaagcatatagaaggaatttgtaccccacacgttttaataagatatttaaaaatctttttcagtttgaaatattttctaaatatccttctgacttcctctttgattagttagttatgtaaaagtgtgtttcttatttttcaaattgttctgaaattttccagatatatttttgttattggtttctatttaaattcctggtaatgagaaaccaaactctatataacttcaaatctttgatatttcctgagacttttaaaagaatcactcaacatatgttccatctcattaaatgatccatgtatgcttgaaaaaaatgtttatctattgcaccaccataattcagcctggacgacagagcaaaattctgtctccaaaaaaaaaaaaaacaaacccttgatcttatcctttttgagtatagtttttataaatatctgttaggttataaagttgtttaaatcagttttgtctttatttttgtctattatatcaattactgagaaatagatgttaaaaatctctaaatatatttatgagtttctgcatcatggattctgaatatctttattggttttgtcttcattggcattgtcatatcttttaaacaaatttactatttttaaattatgaagcactactttaagacggtgagtggcagcactcaccgtcttaaagtgtattttgtcggatattaatgtgaagacattagctttctataagtggtgtttgcatagtgcatcttaaattttaattttaactataaagtgaatattttatgatcagcatataattgtcttatcatcctgataagctctcattttaattggattgtttggtatctttatattttgtgtgatttgttatatgttttctattatgcctaccatattgttatttgacttccactgttttctggttcataacttttctaaaaggaagtcagtaataattcataatgctgttttctttatttaatgtcatatttttctagctgcttatacgattttttcaacataccttaaatgttccattatattatatgtgcttgaggttctctaaacttattatgtctataaattaatatcttttagcatatttggaaatttttgcctttttaagtcttctaaaaaaaagtcatcaaatatgttgttattccacaaatatctcttctctttctctaggatatcaagtacactgctcttaaattgatatgataaacctcttaaacccttaaaatgatatgataaacttcttgatatagtcccacagatcacaaagattcatcatttttctccctaatggtccctctatgctcttaaatcagatatttctattaatttgtctttacatttgctgactcttgtttctatcatgtttattatgacaatcagttcattcagtatttgtttttaattttagaaattttgttttttaaatataatttgcttttggtttaaaaaatcttattttggctaaattatatattttcatttattatgaacatgttttcatttatgtcatttatcattactatagtagctactttataattttttctgttaagccaatatttaattcatctcaatgtatattgcagttgattgcccctattttttgcaatgtaggtctgctatggtctagatatttatgattcccaaaactcatatgttgcaattctaaccccagggtgatagtattaggaggtgggaccttggcatgtgattaggtcatgataatggagccctaaagaatgggattgctctgcctgtaaaggagacctcagggagatttcttgctccttcacccagtgaagtcgcagaaataaaatttagctctgaaccaaaagcaggccttctccagatactgattctgctggtatgatgacattggacttcctagcctttagatatgtgagaaagacatttcttttgtttataagctacccagttgatggtcttttgctatagcaacacaaatggactaagatagggttatatgtgtttttaaaatcacacatagcctaactatgaaagaatgaaaaaatatatattcagtaaacaaaaacagccagaatggccataatgatatcagacaaaaaagactttaagccaaaacatgtcacaagagacaagaagaacattatataatgataaatgggccaattcacaagaaagatataactattataaatatacatgcatccaacatcagagcacaaaaatatataaagcaaacattgataaaactaaaaaaagaaatagcaagacaacagtagtagcatatttcaatattccattcttaataatggataaaacaactagacagaaaaacaaaaaagtaacatttaacttgaacaaaactctagatcaaattaaccaaagacacatatagagaacatgccacccaacaacagcagaatacacattcttttcaaatgcacatagaacattatttagaatatatcacatttggcaacaaaatatgttttaacacatttaagaagatagtaatcataccaagtaaattttctaatacatatggaatgaaactagagattgatagcagaagaaagactggaagattcacaaatacgttgcaattgacaacacattcttgaacaaccagagtcaaaaataaatccaatgggaaattaaaaaacatcttgagaccaactaaaactgaaacacaattcaccaaaacttatgagatgcagcaaaagtagtagtaagagaaatgtttatggtaataaatctctatgttaaaaacgaagagagttatcaaaccagtaacctaactttacacctcaaggacccagaaaaacaaaataagtccaagacaaatgaagaaggaaatattaaagcttagtatagcaataaataaaatagagacaaataaaatgataaaaaaatgaaaattagttttttttaaaagaccaacaaaattgacaaacctttggctagactaaaaaaaatagataaggctcaaatgaataaaagcagagttgaaagagaagacataattgatgccacagaaataaaaaatgacagtaagagactgctatgaaaaattatatgccaacaaattgagtaaccgaaaaagaaaatggaataaaattctgaagcaaaaaacctaccatttgtaatagcattaaaacctgaaatataagaaaccagatttatcaaaatatgtgcaagatatttacattaaaaactacacaatattgctcatagatattaaagaagaccaaagtaaatagagaccatgctccttggttgaaacagaatattcttaatattccaattctccccaaaatgatctatagagctaaggcaatcccaatcaaaatctaagctggctttaaaatagaaactgaaaagccattaagaagttcttgtgagtgtggctggttggtctagggctatgattctcacttagggtgcaaaaggtcctgggttcaaatcccagaggagcccaacttttagttcaaaagttcttgtgaaaacaaaaataatctagccaaaaatattcttgaaagaggaagaaatttggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagcggagcttgcagtgagccgagattgcgccattgcagtccgcagtccggcctgggcaacagagcgagactccgtctcaaaaaaaaaaaaaaaaaaaaaaagaaagaggaagaaatttgaagatatacacagtctgcagccagacacaaaaaaattacatattggatttttcctttttatgaaatgtccagaaaagagaaatatataaagaatacataggcctgtgatttcctggtctgggagtagaaaggatactgactgtaaataggcattaaggtatttgtttaaagtgaagaaagtactctaaaactggattgtagttatcattgtgtaacaaatatttgtgaaaacaattgagctgtttgcttataataggtgaattttatagtatttacattatacatttataaaactttttaaagtatttttaataaagctgtgtcattaaaaagaccaataatctgccattcctaacatgtttagtaaaaaaacatgaaacacgcagcataaggattttaaaaagatacttttttgccaggttaattattttattttaaaagcgaagactatttttttcaaattaagttagagaatcacccaacattataattctctgggaaaatgtgaagttgtgacttataagtaaaaaaacctgaagaccatgactccagaaaaagaaaatctaatgcaaagaaattctccttactccaaattttgagtcccacacattttaaagattttttttcaaatccttttatattaactaatttatgatacttaatgggtcccagattatataaaaattcttattctatttgattccaaaatctgatggagcacagaaaacaaccaccacaatatcgatgagaagaaaacacaacaagatgttatttaggaatatcgggggaaactttattacaaagctgggaaattgaattcattttatattaagaatttaataagctcttctgaagatgaattcatttcatgaacatttcagcttataaatataaatacaattattctgtgaatggtacagagtgaaaaatttaatgattgtcttgatagtgatttaaaaattatataaaagtatataaacatctctatatatacgtataccacacaagcgttgagttgattttactgtgaggcatccacattaacatttaaaattcaaaaaacaattttttcaggcatataaatggtttaacatttgtttccggaaattctaacaagtgaaacttgacaagaaaacaaaaataagtgttgtgattattgaaagaaaatcaacatatacttctatttgctggtgatatgattattctattgaaaagaactgttcacgtttaaatgaatagcattaatgtgatacgcacaaaatagtaagcttatggcacagaacttttttgagaggccaatgtagaaaacaaattgttattaccctgatgatatttttataagagaaaacccactaatgtgttgattgaacagaatttctatcaaaatctcaatatacattttgatttaataattcaaaaaatatttacaaatactcaattagaggagataaaaatagattattcactgaatgaatgactttgatgcaactttctaacgattcagggaaatttaaagttagattcctcccccacatttactgaaaactaaatttatttcatagcaagtatatatatatatgtggtaagagaattattacaaatatagaatattatatgtaaatatgtataaaagtttggctggagaagaactgcctagttgtgacactaaaagtggagacaatttaggaacctatttaaatatgtaacaattaatattaaaaagcaaataattttttaaaaattataataaatgcaaataaaaagcattactatttcataaagagctcttacaagtcaataaaaatttaaccggtagaaaaatggataaaagttcactgaaagtaatctctaaaataaataatttgaataattaataagcatctaaagaagcattgcacatcaatacattgtcaaattaatacattttttaaaatgacaagctgtcacatttttctgttcaataatcaaaactaaaaatatgttgcaatatccagcagtgactacaatgaactgatataggcactatcctacatatttttaagaaataaaaactcgcaaattttctggatgtctacttgctaacttttaaaaacatttagcaaatggaatgtgcatttgttttactaaactattcctttcaatgaattaatcctaaataaataataaaagtatgacacagttacagggatctttataagttatgtttataggagcaaaaattagaactatacaagatgctaaccctctattaaagagtcatatttcctccatacaatggagaactgtgagcccattaaaacctgataatgtcatgatctctaatacatagtcaagtgtaaaaataggtagcaaatcaaaattatcttctctcaatgtacatctgtgcaagtctgtatatgctcacatgtgtgtgcataaatcagtatttcatattaatataaaatatctaggtgaaccacatgttgaccgtggctttgcattgggtttatttttatttttgtgtgtgttgttacaatagaatttgtataacaagaaagaaaaaagtaaatatgttaaagttaaaatatctacaaagtacaagaaatatgaattaaggaaaagtagagaaatggaatcctgagtcttataaagaataacaagaataatatctattgtgacccaaacttaaaaatttccctcttttgaccaatttctcaccctgtgtgttattagtcttcttttgatatctacctctaatttatgttggattaactgaggtaaagacacagacacatttctctgtgtcatttgtattctggcacctctctctatttggctcaacattagactgtcattttcattttctcaggtaattagtgataaccgtgtaccaaatattaaatatataattcatgacaattacagaacaatttcctggggatacaaaatatctgaaatataatttaccctctctgagtgttgccagttgaataaaagagtttaaagttattatgttgccttggctatgtccttatttctgtcttgcaatgcaattcacttttggattcttgcctgtattcctccaacagatcaagcaacacctaactaatagcgtaagaatctggccctctaattcaattcttgtacattttctggaaattaaacttgagaaattgacttctattgtagacttgatcttagattactgtccatgatctctggagtttttactcttgccactgggatcctaaatttgtccccttcctagtctatcagaaaagtacacccagcacattggggaataataacaattaattaaagacagaggataaagcctattgagacataatacttcctctatattaatgacttgggaaatgtatttttatgtaatcaacagaagcattgagtctctattacctaaattatctttatttgattagagacattactaagaaccttaagctttgtaataattgaacccaatattttcaatatgtgaaaagtgactttagtccttgaatattatttatttttgttatggctacacaaatgtatgcccaaactgtattctaacagatattgtggtaattatttgataacaattacaaattgaatggttttcatttaggaattttaaagccagttggagtgaaaatgtcctcatcttctctgggacaggtaaggaagtaaccagtaagtttgaaaaatatttggaaagttacatttaatttcgtaatcagtgtattatttcctttatgtttagcaaaatttgttggttcttgtaataagtttggggtcttcccccaactgcataaagatacataaattgggatttttgctgactcaagaaaccttagccaaatttcattgatatttcttcaccattcctctattaacaaagtttaaaaaaagataagaaatatgaactcaaagtatacttttatgattactattttttaaaatcacctatttttgtgactgctttattgaaacactgaatcacttcatgtatctgcctagtgactcaaaaagtgttattacaattcactttaaatgaaagtgccactcacaatcttgataattaatgcaggtaaccggctgtgtgagaaagttaacatcagccttaacctcatgcactgaactgtttttcacatgtcagataggcatttcattttgaggaaagccatgtttttgttccttttgtggttggaatttataattaattatacaacatggagatgctgtattttaattataaaacattttaatgtggaacacatgagacctaggatacagaatgtagcaatcaagttgtacaacaaataatcaaacctctaattatgaaagctacagtggttcctgaaatctaaaagcaaaagtcacaggatggtttatttaacaatagaatttattatattttatatcttcttcaaagcttactttgtttttcctcttataggaaatcctttttacctacatagaaaagttacgttattggaatttacatccctcctccataagaaaaaagacatcttctcttccaaatgtccaccatgctaattttatctctttcttattatatttaactttaaaaatcttgatcattataattgctgtgggtcgtatattcactgtgaatattctgtgagagatgacagttttattcttaataacctgcatattaagaatcgccatgcctttttcatggttagtgttcaatccacatgttaaaagaatgaaaaatgcattactgaattatcttatattacccttttttgcagaatcattctttgtagtgttagtgaaatatgccgaatattaaaataggaaccaaactttttataaaatgctgcctctgctgtctcacaatgcctaatgctacctctaaacgatagttattattcttttctgtcatataaagaaacatagtcatgccaattggttttttgccactatatatccagtgggaatcacacagagaatcaattcattacaatgataaattacaccattaaatagtatattatgccagaataatctagaaggtcatgaaagaaagattaagagatgacaagagaatctacaatgtgtaagaaagtgcatgatacatgaaaaaataggttttggtttgatatctaccaaatatgttaaatgaatatataaccctgtaaaaattgaaaaattacatacttgtaaaatcagaataaaacttgagatactcatcttttgtataacttacatgaaattgtaccaagtgatgactttttaaatacagttctagttatttcatatttctactcaagtaatgtggtttgctccataggagttatttgaaaataaacctcttttcaaatgctcaaatctattattgttctgtcagttgtgcaactcataaatactctttcctattctcttcaaaacacagaagtaatattaaaatcagtgggaaatattcttagacaagtcattgatacaaaatattaaacatatataaaaagtaaactttaatattcaccatgtatgttattattttatattcaattttataatttgttaacacacaaaagtattatgtcctgaccatatcacactatcaccgcgggaggaagggtgagtgggtagaaatacctgttattggtttttaagtagatcatagccaaagctagagtagcacctggacaagtcacatccacatttatggtatctccttcctattgaaagaagagtttatgcatgtaaaagagttctaaattattataaaattcctctgaataataactatgcttaaaattaacacatttaccaatgtcagtatgaacactagtattttccaattaacttcccagcttccagacttttgatctattactttgctgtgtacttactttgatttgataacttggtgatttatgtttctccctatgcattcctgtttgaaagcgcctacgtcctccaaccatgtactgatagagctgctcaggcacattgagatcagacatacctatcaaattgctgccatgctggaaaagacaataacagacgagtgaaaagaaattttatgaaggaagatccacaacacatacccataacaaatataaaaatgaactaacttcaaagcaggttattttgggttttgttttttttatttccaatttaaagcaaacattaatcatgagttaataaatattaataattctcataaaagttttaatacatgaatgttcaactttaagtactgtcttaaaatacataagagctttagagttagtgacatttaacaataaagaaaaatattagttatataattgaaactggaactgtaaatacctgaatactgtcattattgtacttaagaacttttccaacaataactatgataataatagtaatttattaaatgcatgctctgtgtcaggcactattctgtgtgtttaacatgaatgaacagccatatcaaatagctactattaaaaccctattttataaataaggaaagtgtggcacagagggattaagcccaaggttatacagctattatagttaagttgcagggctatatataaaacacggccatctggctcaacaatccatgaagctgattaagcaatacacaataatgtagttaaatgacttgactcactagttaggaccagaattcaagttgcaattccctgtgtgattcttttcttttttttttttttttttgagacggagtctcgccttcttgcccaggctggagtgcagtggcacgatctcgactctctgcaagctccgcctcctgggttcacaccattctcctgcctcagcatcctgagtagctgggactacaagcacccaccaccatgcccagctaatttttttgtatttttagtagagacggggtttcaccgtgttagccaggatggtctggatctcctgacctcgtgatccgcccatctcagcctcccaaagtgctgggattacaggcatgagccaccacacccagctgattattttccattataccaccagcctctttagctcacgtgccaatgtgaattcaaggccctaacagatggtcaaccacaaggtggattttcagaacacacatgaaaaaaattccttccactataactttttttttttttaagatggagtctcactcttgttgcccaggctggagtgcaatggtgtgatctcgattcaccacaacctccgcctcctgggttcaagcgattgtcctgcctcagcctcccgagtagctgggattacaggcatgcgccaccacacctggctaattttgtatttttagtagagatggggtttctccatgttggtcaggttggtcttgaacccccaatctcaggtgatccgatcacctcggccttataactttctttatatcatttagtttgaccataagaatgtattggtggtttttcaaggggaaccacatttcaagtgaaacaatcatttaatgaaacatttctggtaattctgtacacatctcttggatggagttaaagatgggtcaatctgatactgcattttgtcacaaggaagatgctactgggacaacattctgggatacacagtgaacatcactatggcaaaagggggttagggtttgtttcaagcagctactatagactcttaaggctcccgatcatatacgttttcactattctctgttttcagtcatagtgggctgtcacttattcattctatgtcttgaacgctttaaaaaaaaaaaactttattcccttcagtttgttcatgaacactgcaagctggaggaaaagaaatcttaaagtcccactcttgaccacagtttctctcaatttgcaaatctggtactttgaaaaatatccaaaaagacaatagagctgggcagcagattaagtcatagtaagggacaatattcaggtttaggtgtcaacgttatttgtctcaacatgtagatgtcctaactgaagcatgggaaggcataggctatgcttacccccaagcagaccatgcccagggccaagccagcagctaaggagtatgactctctgtcagtgcagtattccatttcaggaccaggaggccgtcctgtaaaaacaaaagcaacacagttcaaactagcttctcaaaatctcatctcataaaaatcttagagttaactttctagcaagttgcactggagatacgaatgggatataactattcagaaagttatgacactataataaatggtgtccacaactgtaggtttacctaccaaaaaaaaagggcccaaaatagttctttttaaattgccaatttaagtctttataagcaatgatattcaaatactgtgaaactttgagtcttaccaaaaaaattaccaagtagtagaaaaaaattttaaagggaaaaaggtaagagtattcaaaaaaaaagttttatttttttgttaaaacatctgggccgggtgtgctggctcatgcctgtaatcccagcattttgggaggccgaggcaggtggatcacttgacgtcaggagttggagaccagatggccaacatggtgaaaccctgtctctactaaaaatacaaaaactagccagggtgccaggtgcctgtaatatcagctactggggaggctgaggcaggaaaatcgcttgaacctgggaggcagaggttgcagtgagccaaaatcaggtcgctgcactccagcctgggtgacagagtgagacaccatctcagcaacaacaacaacgaaatatcttacattttgttttcattactttcaaatccacacatcacatgtggtgaaacatgttcgaatgatgataatgaataaggaggtcacttacttatgttgttaagctgttaaatattatgtttagacatttatttcgagtgtatataataatgagccctactatggtagaatttctgtgtactgatcctagaagtctgactggatacaaaattcacacttttaaaagcaccctataactctaacactaccttgttgaaaacgataaaatgtactatgtattaaaacccttccctctgaaaaaatgttcacattcctgaaattttatccctataggaaaaaaatgcaatttaaaaaaaaagaaaaaaggctggacgtgctggcccttgcctgtaatcccagcactttgggaggccaaggcaggaggatcacttgaggtcaacgagttcgagaccagcctgtccgacatggagaaatcccatctctactaaaactacaaaaattagccaggcatgctgacagacacccgtaatcccagctacttggtaggctgaggcaggagaattgcttgaacctgggaggcagaggctgcagtgaaccgagatcgccccactccactccagcctgggtgacagagcgagactctgtctctaaataaataaataaataataaaaattaaagaaaaaaatcacacaaaggtaatcagtgtaatgtttatatataacaacaaaggattattagaaacaatctaaaaagttctaaaagttaaaaaaaggcattttacagaccatcgactcaatgaatattacacaaaatttgttttaaaacccatttataacaatgatctataaaaacaatttttaggcggggcacagtggttcatgcctgcaatcccagcactttgggaggctgagacaggcagatcacaaggtcaggagatccagactatcctggctaacaccatgaaaccctgtctctactaaaaatacacaataattagccaggcgtagtggcgggcgcctgtagtcccagctactcggaaggctgaggcaggagaatgacgtgaacccgggaggcggagcttgcaatgagccaagattgcaccactgtactccaggctgggcagcagagcaagactctctcaaaaaaaaaaaatttttttaatgtacattctgacagtaattatataaaaaggcatatacatatgaattaaagatgaaatcttctatatacagtgtgaaagaggtatgccgcagctgtgagactgtgcaatgacaccattagacatcatcatgatatagccaaagaagggtagactactttgcagatgaacatgctttaacaaccagtgttgaatattttcagaataagcgtttttcagatctctgacttatgctaccatgtattgtgatagccaaaacatttcaactttgggaataatttcatttatcattatagtagactaaattatgggtcccaatcttcactggttctctcctaggtttctatcaacaccacgagagaaacacaccctccagcctgggtcccagaatgaggcaggtgaggcagaacggcagcagaacagccggctacacatctacagcctaaagcagagctgcctgggccaatgctatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacaggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatcaacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaaagtccaacaatgatagactggattaagaaaatgtggcacatatacaccatggaatactatgcagccataaaaaatgatgagttcatgtcctttgtagggacatggatgaaattggaaaccatcattctcagtaaactatcgcaaggacaaaaaaccaaacaccgcatattctcactcataggtgggaattgaacaatgagatcgcatggacacaggaaggggaatatcacactctggggactgtggtggggaggggggaggggggagggatagcattgggagatatacctaatgctagatgacgagttagtgggtgcagcgcaccagcatggcacatgtatgcatatgtaactaacctgcacaatgtgcacatgtaccctaaaacttaaagtataattaaaaaaaaaaaatttcaaaaaaaaaaaattttgtctataaaacaggtaacaatttgaatgaagaaaacaaaaatttaatgaatggcataaaaataaatttcaagaaaatgaaaggtgtgtatgatgacttaattaaaagaatgtaaaggaaaaaaaaaaaaaaagattttccagagtagctacttgtctctgccatagaattgttagatagtttactgtaggtggactgtaaataaatgtttgcttagttctaacatttgactgatattgggttgatcctttgagacttggtatattgtggatatgcctaaagtttctttttctaccaaagatgtgttgtaatctatgtcattacagaagtaggagagggaaggaaactaccattaaaatcagtacttaggagcccaggcactgttctagatgtttgcatatattaatatgatttcatttcatctttacagtaacctagaagaaagatatttaaataatgactttccagatcaaaaaatgagttttgatggcttttctcagttttcataattggcagaactgatttccgaatcctttaagttgatcagttgacaggaatgcatttatgatttttatcttttcttttggggttacctttcagtttgactttgaaggatcactttcccctgtcattgcgcccaaaaaagcaaggccttctgagactggatctgatgatgtaagcattattatttcttgctaatataaattaatttatggatattcatactattcttccacttctgtggtattcctatcaattcctctatctttccaacacctttcactttatttattttaatactgaatagcaattattttgaagagtaggatctgttacattttctatggtctttaatgattatccaaaaattaatgtatgtattactgcatgatttcagtttgggtttgtagacattttattatcaactgatcacctgaaatgacagcatttaccttttttatgcagtgttttttaaattaaggttctcaatcgtatcaggttccatggtatattccttttttttttttttttttttgagacggagtatcgctcttgttgcccgggatggagtgcagtggcacgatctgagctcactgcaatctccgcctcccaggttcaagcagttctgtctcagcctcctgaatagctgggattacaggcgcccgccaccatgcctggctaatttttgtagttttggtagagacagggtttcaccatgttggccaggctggtctcgaactcctgacctcaagtgaccttcctgaccttggcgtcccaaagtgctgggattacaggcatgagccactgcacctggcctccatggtattattcttaagtggtccaaatatgtttttttaaattgtggtgtaatttacaaaaatgaaatacatcttgagtttacagtttgatcagttttaatatatgcacactcatgtaacctacactcctataaagacacagaatatttttataactccgtaaaatttccccgtgcggtttttttttttttttttgagacggagtcttgccttattgcccaggctggagtgcagtggcacgatgtcggctcttcacctcctgggttgaagctattctcctgcctcaacctcctgaatagctgggattataggcatgcgccaccacgcctggccaatttttgtatttttagtagagatagggtttcaccatgttggtcaggctggtcttgaactcctgacctcgtgatctgcccacctcggcctcccaaagttctgggattacaggcatgagccactgggcctggcccctcttgctgtttttaatcagctttattctcttcttctagcaatcactgatctgaattctgtcaccatatcttagttatgcctgttctagaacttgatgtaaataaaataatatagtatgtaatctttggtataagatttattcagcataatgcttttgagattcattcatgttgttacagatacccgtagtttgtgcttttttattgctgagtagtatgaatataccatagtttgtttatccatccttcttctgctggtagatatctaggctatttccattttttttttaagtcttatgaataaagcaagctactgccaaaattcactggcaagtctttgtggatatatattttctttttttggggggggggaggacagagtcttgctgtgtcatccaggctggaatgcagtggcacgatctcggctcactgcaacctctgactcctgagttcaggcagttctcatgcctcagcctccccagtagctagaattacaggtatgcgccaccatgcctggctaatttttgtattttcagtagagactggattttgccatgttggccagcctggtctcaaactcctggcctcaataatccacccatgttggcctcccaaagtgctgagattacaggtgtgagccaccatgcctggcccgtggacatacattttcatttctttttttttttttttttttaagagacagggtgtcactcttttgcctacgctggactgcagtgatgctatcgtggttgactgtaatctcgaactcctaggctcaagccatcctcctacctcagcctccaagtggctaggactaccggtatgctccatcatgcctggctaatttttaagtaagaccagttgtctaccaaaaaaatttgaaaattagccaggcatgatggcacataacctgtagtcctagctacttggaggctgagtttggaggatgttaaacactctttcatgtgctcattagctgcttatgtatctttttgtgaagtttctgttcaaatctttatcaacttgtaaattagattttaaaaaatatgtaagctggtgaagttcttacatgttctagacatgaattcttgaccatattttcccttagaatgtggctttaacagtgtctttgatgagcagaattttttattttagttatccaatatatcagttttttattttattttattttatttttgagatggagtctcgctctgttgcccaggctggagtgcagtggcatgatctcagctcactgcaagctccgcctcccaggttcatgccattctcctgcctaagcctccccaatagctgggactaacaggtgcccgccaccacacccagctaatttttttgtattttttttagaagagatggggttccaccgtgttagccaggatggtctcgatctcctgacctcgtgatccacccgcctcggcatcccaaagtgctgggattacaggcatgagccagtgcacccggcccagttttttcttttatggttagttctttctgtatctagtccaataatttttaatttagaataacacactgtattaagccttataaaaacaccagtaaattccaagatctggaaatagcataaaccacattctctgaaccaaatgcagtaaatcacaagtagaaccaaaatagactgaacatttggaaaatgtagtccaatcagtctgaatataaaaatcagttgattattagattatattagtagccctggcatcttatacatgtggaaagatgaatacaccagatgaatgcaggtggaccttccttcttaccaaaacacagttcagtgtagtggccactaacttgccatctacttttcctataaaacctagcctgagataatcttaaattttctctctcaatctctacctaaatagtataattcttctcccaatgtctttcctaaaagggcatgaaaagattttttttaatggtttttaaaggtggcttgccttaacgtttataactggcttgctattttatagttacttcattcttagcattgtcttttttttaacatactcttagatcaacttaatgtgaaaatgaaacttgaattgttttaagtgaattaattttcttatgatattataaggaggtattatttttaaaaattaatattctttttattcttctcaggactgggaatatttactaaattcagactaccaccagagtgttgagtctcatcttttgaacagatctttatgtctgagtccttcagaagcttcacagatgaaggatgaggatttttcacagaatctcagtctggattcttctacacttctctttactcacatacctgcaattttttttgttcttcaccttgtgtatgaggagcttaagttgaatactctaatgggagaaggaatttgttcactcgttgaacttctcgttcagttggcaaggtaaatttgtttgtaggttagaaactgccaggaagtcctgagatgactgtcttttccatgatatcatatagggaccttgtaaatacgtttctgaaatctgccttctcagaaaactaggacatctctgtaaaccacagagttgtttgaagatactggttttgtaagggcctgtgagccatgcagggatttttagtctttgtcctgagattagtggaaggtcacgaaaaaatggagatgacctgctcagattttcattttgacaggatgactgactgactatactgtggtgggagttctagaataacatctgctgttttgtaatatccacattcaaatagtgctttatagttgacaaaatcatagtttacatataaagtctcaaacaaggtaagtttcctattttagtgatgaggaaacttgcctaaatttgtttcctgggatatgagtgtttgatagttgtggactcattttgctatgctatccttgttgcagtctgaggttgtccctgtctttgaggcactcatagtagatccacaataagatagttctaataatacgtttcaacacctttcaagagctttgaagcaccttgtgtatggctcagaattctagggtcatacttgtgtgttgtttgacctttatgacctttggtgataaagaagttgaatttgaattgaaatgtcagcctctgagttaagacatagtacattttctaatttctgttgtcttttttgagatcttgaaattcaatcctgagacatggcagttttaatcaatggtaaatatctcttaggatgtcattactatcatcaaaattattttgtaattaaataatttccaaaccataatcatggctgtctgaaataagtaatgtgtatgatgttttacattttatcaggttttttttttttttacatattttatcttatttactctttaaaacttcagagtaagtgagctgatattgccccatttcctagaagaaaatactgaggtttatagacatgacttatggaagatcacacagctaatgaatagcagaggaggaactagatcatggtgcttttactgtagttttacttccacaaaatttagcaaaaagaggttgggttccatttgtcacactgggcactttaaagtccaaaaatacaatagagagactctagatttggttatctttctcataagtaagtttttaaatttaaagattcaactaattaatccttccaattctgttgggagaaagtgctgtaataccttcttttttgcatgcccttactgttttagggacttaaaattggggccttatgtagatcattactatagagactacccaacgcttgtcagaactactggacaagtgtgcacaattgatccaggtaagtagtcgtgcttttaaatattttctaaacagtgtagtgatatttccttgtatctttctcaatgaatagcagaggatgtatttcttaccattagcttctaagtcaggggcaatgcctttccaccaggcagattttagttcgtagtgcttgttttctgacacgtagtaagccataatatcttcagtgtatagggaaaattttacccatccctaaggttctgacttgcaaaagtcagagaaagagcttccagtgtcaaggatgctttttttttttgagacggagtcttgctctgtcacccaggctggggtgcagtggcgcgatctcggctcactgcaaactctgcctcctgggttcacgccattctcctgcctcagcctcctgagtagctgggactacaggtgcccgccaccacgcctggctaatttttctgtatttttattagagacgaggtttaatcgtgttacataggatggtcttgatctcctgacctcatgatccacccacctcggcctcccaaagtgctgggattacggcgtgagccactgcgccaggccaccaacttagacttgtagagtacagttagtaccactaaccatatgctacttaaattcaattaaaataaaacatatatttcctcagtgtactagccgcattttgagaactcagtagccacatggggctagtgctaccatattggacagtgcagatacagacacagaacatttccatcactactgtactgtcctagaccctgagctaaaggtactgaaatttggggcccagttgttggaacagagctgaatcctggatgtttcttttgtttttttcacctttagggttagggcaaaatttttggttagattcttcttcttctttttttttttttttttttttttttgagacagggtctcactctgtcacccagacgggagtgcagtggtacgatcttggctcactgcatcctctgccttccaggctcaagcgattctcctgcctcagcctcccaagtgcctgggattgcctggggttataggtgtgtgccaccacgcctggctaatttttgtatttttagtagtgatggggtttcaccatgttggccaggctggccttgaactcctgacctcaagtgatccacctgactcagcctcccaaggggctgggattacaggtgttagccaccacatccagcctttggttagattctttatatgccttgggaacaagaatttgctaaatttccatccagggtgggataaaatagaagtcatttaaattctacatttaataacatagttccttatgtgctgtggcagaaaacatgaagcattttggagaatatggaaaaacgttattccttttttttttttttttttttttttgagacagagtctcgctctgtctcttaggcatgatctgggctcactgcaacctccacctcccgggttcaagtgattcttctgcctcagtctcccaagtaggtgggactacgggtgcgcaccaccaggcccagctaatttttttcgtatttttagtagagacggggtttcaccatattggccaggctgttctttaactcctgacctcgtgatccacctgcttgggcctcccaaagtactggggttacaggcgtgagccactgcacccagctggaaaaatattattctagttgtttcaaaatgacaagtaactgttgatcatcttccgtttaaaataaaataatgttgtcttaatgtattttcgtgtctttttgaatatttatctaattttaaaggtcaaacaggatttatgcatcatccatcattttttacgtctgagccaccaagtatttatcagtgggtgagttcttgtctgaagggcgaaggaatgccgccttatccttacctccctggaatctgtgaaagaagcagacttgtagtcttggtatgtatgtggagtgttactacctatctcctttttcttttaaaatttagttttaaaaagtacacctaatattaagtttttctttctgtgtatagttctgtgaatttcagtacatgtatagattcatgtaattactacaatgaggatatagaacatttacatcaccctcaaaaatttctctcatgattttgagactcatccaagttgtttcctgtatcgacagttcattgcattctatggctaattagtagtttattgcatgaatgtgccatagttggtttttcattcaagataattgggttgatttcagttgttagcaattgtaaatatagatgctgtcagcattcatgcttagcgttttatgtgaacataagttttgctttctctaggacaggtacctaggagtaggattgatgggtcatacagttaagtttatattttgtttttaaagaaactgtcatctgttttccagagtggctcttccattttacatttttaccagcaatatttaagagatcatttacctgcattcttgttggtatttggtattgtcactcttttttatttttgtctttctgagagatgtgtagttatacctcattgtggttttaatttgcattttcctaatggctaatgatgttttcagcgttctaggtatgaggttttgtcagatatgtggtttgcagatattttcttgtggtttctaccttgtcttgtctcgtcattctctaaatacatcaaagaacaaaagtgtttaattttgatgaagctagtttatctgtatttttctttaatggatattgctttcagtgtcatgtctaataattctttgtttaacttcaggttttgaagattttctcctgggtttctttgcatgttttacatttagatctctaatccattttgttaatcttttataacatgtcaggttttaagtcaaggtttttattatttcatttggatatccagttctttcagcactgttttttgaaaagactatccttcctctattgcatttgcacttttgtcaaaagttaatttggccacattcttgtgtgtctgtttctggactttctattctgtttcattgatctttgtggctgtctacgctgtcattactgtagctttatagtaagtctttaaaattgattagcgttactcctcccttcattactcttcttgccttttcatattgattttatttttatttttatttttgagacagagtctcactctgttgcctaggctagagtgcagtggagtgatctcagctcactgcaacctccaccttctgggttcaggcgattctcctgcctcagcctcccaaatagctgggattacaggatcccaccaccacgcccggctaattttttgtatttttagtagagacgggatttcaccatattggccaggctggtcttgaactttcaacctcaagtgatccgcctggctcagcctcccaaagtgctgggattaccggtgtgagccaccgcgcccgtcccctactgattttataatccgcttgtctatagctacaaagaaaaatcttgctgaaatttttttcaaagaaacacttctttatttatttttattattttttatttacctctagctgcaaatctcatgatttatttatttttagaaattagtttgttattactggttaatacatgtccaagatcaaaccttcatatagaaccatagggctgtaacggtgaatgaggtaagtttcttggcatacctgttcctcagtccccccatcctggagcagcctgctcataggccccttgtgggccttttcaggtggggtcttcccaggcttgcaggagaaccatatgcttttgtcccttctctcaaatgttggcagactgcaaatgtcttttcctcctgcccttctttttctttactttacgttttgctccgcttcatggtgagaagtgcttcagagtccccccatggctccaaaacagacatacagaatgaagattctgtttaaaaaacacagatttttttaatgatagcaaaatatatataacataatatttgtcattgaaattgttattattattatttcttgagatggagtcactctgttgcccaggctggagtgcagtggcacgatctcggctcactgcaacctccgccacctaggttcaagcgattctcctgcctcagcctcccgagtagctgggattacaggcatgagtcaccaagtctggctaatttttgtatttttagtagagatggggttcaccatgttggccaggctggtcttgaactcctgacatcaagtgatctgcccaccttggcctcccaaagtgcaggggttacaggcgtgagccactgcgcccggcctgaagttatttttgagtgtacaatccagtggcattgaatacgttcacattgttatgttgccatcaccactgtccgtacccaagacttcttcatcatccccaacataaactctgtacctattagagtgactccccattccccttccttccaggccctggtaattccgttctctttcttatgaatttgtctcttgtaagtacctcatattatgggaatcaagcaatatttatctctgtgtctggcttatttcacttagcataatgtttccaatgttcacccatattgtagcatgtatcaaaattacattgttttaaaggcagtattctatatagtattccattgtatggatataccacaatttatcatttcacctgatgatggacatttgggttgtttccaccttttgactgtggaatagtgctgctgtgaaccatgggtatgcaaatatctgttcaagtctctgctttcagttctttttaatatatacctggtggtggaattgttgggtcatatggtaggtaattcgatgtttaactttttgagaaactgctaaactcattttcatagtggctataccattttacatccttatcagcaatgcaagaggaagggttccaatttctccacagtcttgccaacacatattattattttctatttgtttttttaaaaattatagccatcctagtatttatgaagtgatatctcattgttttgatttgcctccttaatgattagtgatattgagcatattttcatgtgtttattggccatttacgtatcttctttgaagaaatatctatgcagatcttttgtgtatttgaaaattggatttttatttttgagtttaggcatttttatgctctagatattaatgtgtcagatacatgatttgcaaatattttctcccattctataggtttttctgtgaatgtcttttcagtaaaactggcatgagtgctcagtttacctctctggcctttcatcttagttttatcctcttggtattcctttataacttgtcagctcagagatctatttataaaaatatgaatttatttttatttataaaaatattctgaaaaatatcaacagaagcccttattgataggtttttggtttcgtcattataagttttattggactttttttattttttattttttttatttgagacaaggtcttactctgtcacccaggctggtgtgcagtggtgcaatcatggctcactgcagcctcaacctcccggggctcaagcagtccttccacctcagcctcctgagtagctgggaccacaggtgcacaccatcacacccggctaatttttgtatttttagtagagatggggttttgccatgttgcccaggttggtcttgaactcctgaccgcaagtgataaattttttttatgtgatgttagctaatgagacatttgtagtaaccttctagcttatggtggctctttttctattgactcacttgtatatgcggagatggcattgtctgtgtaccatttgttgaaatgagggaaaggaaggaagtgagataacatttattgggagcctgttgtcttcaaggaacttcatgtatgttttctcatttaatacagagatcttatgtacttttgtgtttgtgttatatgttgaatattttaactcttttgagagactttttccttggtcttatctttttcttttcctcctcaaagcaaataccactacagctctgtactactagatacttcttagatagtgagagagcactattcgatacctgttggaatgactgaaaataacttttggtgaggatatggagcaaccgaaactctcatacattactggtgggactgcaaaagtggcacagcactttggaaaactgtttggcagtttcttgtgaagttaaacatacacttatataagacaaattccaactgcttggtatttacttaagagaaatgaaaacatatgcctacataaagacccgcatgtatgtgaatgtctttggggccaggcgcggtggcataatctcagcactttgggagaccgaggagggcggatcacgaggtcaggagatcgagaccaacctggccaacatggtgaaaccctgtctctactaaaaatacaaaaattagctgggcgtggtggcgcatgcctgtaatcccagccactctggaggctgaggtgggagaatcgcttgaacccaggaggtggaggttgcagtgagccaagattgtgccactgcactccagcctggcgacatagcgagactccgtctcaaaaaaaataaacaaataaaaaataaagcagctttggtcatagtgaccacaaactggaaccaaatgttcatcagtttttgagtaggtaaacaaagtttggtatgtctgtataatggaatactactcagcatgaaaaggaagaaactagtgatccttggagagacgtgaatgaatctcaaagacgtatgctaagttaaagaagtagcacgaaaaagactacatatcatatgattcattcacatgatattgtaggatagacaaaactgtagagcaagaaaacagatgaattgtttccagtgctgggtgtaggaggaaaggattgactacaaaaggaacgagggaactttttggtatgatgaaagtatactatatgtgagtgtggtagtggttatgtgatataacatttgtcgaaactcacagagctgtacacctaaaatggacgaattattctatgttataattattttctagttacacttcaattatgtagctaggtgtggtggctcatacctataatcccagcagtttgggaggctgaggcagaaggattgctcgaggtcatgagtttgagcccagcctgggcaacacagcgagactctgtctttacaaaaaataaaaataatataaaagaattagctgggcatggtggtgtgtgcttgtagtcctagctactctggagactgaagcaggaagattgcttgagccaaggagtttgaggctgcagtgagctgtgattgtgtcactgcactccatcctgggtgacaaagtgagatgctgtctctggaaagagaaaaataatgttaattttcttcttttgcagagtattgcactgtacatacttggtgatgagagctcggtttctgatgaatcctcacagtatttaaccagaataactgtaggtaagttggtgcaatgttgcctctggaaacaaatttttgtagatgtcagtatcagaattgaaaaaagaattgaatttttcttgtttgctttggcggccatgtcttacctttttagtactgttctggtctgttgcggtctgttgtccacaactaattttcaggtatcaggattacttaaaatctaataaatcttgtattttcagtgcgggtaaaaaggactattttagcctgaaggaaattattgtaccattgactcttgaacaacatgagtttgagttgtgtgggtccacttacaatgaaattcttttcagccaaatgcagatagaaaatgcagtattctctgatgtgaaatccatatgcaggttctgcagggccaattgcaggacttgagcatgcagggatttgggtacacatcgggtgtcctaaccaatcccctgagtattctgagggccttgactgtacttttcagcctgccacagtattgcttattttattatttttttagatgttgtttgctaatggattcttattttcaaatgtcttctacatgttacatgttttctttaccaggatgactatcaaaattaagtttcattttgttgccttttagccccccagaagttgcaagcagaacaagtggaaaacaggtgacttttatttagactgtgcttttatgtcagacacttaaaacaatattatttactgttctgcttaattactttatgttttattctcttataggtttagtttcaggcattctacgtctgtttctagtctagctgaaagattggttggctggatgactaatgtaggtgagagcttctttgttacctgctaactaggccgtgcttcctccagactagctagaagtggaaggcatgaggagagaggggctctggctttgtgaaaaggcctcacaagattgagattatggttcatcaagccatattcttttttctcgacaatctcacaactttcatataataatatgtgggataccagctttttatcttggtgcataaggaatctttatttgccattacattggaacatttgaggctatggctatgtaagctggtctctgagaatggagaactctaatcaccctacatatacacctgaaatcattgtgatactcagatatcagaaatgggtggttttggcaaagtctaaaagcaataatataaacatttcagggtatacttttgaaggataaatgcacttttgaagggatttcaggcaccaagatgaacattgaactgggaagaggaagaggaaggaaaagcgttctatattccctattccccaaacctatgctcctaggttttaaattaagtaaaataccaaagaaattttttttcacaaagaactgaaaaacaaaattaaaaattactgccacgaagacatgattttaaaaatgaggatattatatgggatgtatgttaaaaagtaaagttttaatgaatattaaaagatgtttttgaagtcttatctaaagtatgttctaaatgaagtttctgacaggtttttttttttttttttttgcattttaccttaaaaatgacaataactgttgcgtagtatacatacaggatacctatgctgaaaaatattggattagttctatccatttgtatattgcataatatttaataagtgttattctcatataaggaaacattttttgcctcaatagttaatcgactttttatattataaataatgcatagtattataaaatttagaaaatcatgataagaaaaacatgatttaattaacctgaggataaaaaaatttaaatatgaaatatggtatacttacaaaataatatgtcaaacgtatatgtttagtttagagaatggtactaaagtgagtattgatgtactggtcacccacccctagaaatagaacattacccgcatagtagaaggcccttacatatctgttcttggatggtcccctcctgtcacacaccccaatgttatagtgaaccactgccctacctacatttgtgttaccttactcttgtttttctttatagttttacatctttataaattgctaggttttatgtagttttgaaaatatatagatgtaaatatatgttcctttttcttcactcaactttgttttttaaagattcatccatgtcgactcacgtagcagtagcagtgggtcattcattttctctgatatagagattactttgtttgaacatatcacaatttaattacccattctgttaatgatagacaatcggacttacccctttctccatctctttttttttttccatagcaaaccagtattgctaatgaatatttttatacctgtgtcttggtgtacctgggtgtaagtttctatatggctgttgatggatcaaatgggtggactgacctatacataccaactgttttccaaagtggttgtaccagtttacactaccattggctatggataagaattattgttgctcgggccgggcacggtggctcatgcctgtaatcccagcactttgggaggccaaggcgggtggatcacgaggtcaggagatcaagaccatcctggctaacacggtgaaaccctgtctctactaaaaaaaaactacaaaaaaaattagccgggcatggtggtgggcgcctgtagtcccagctactcgggaagctgaggcaggagaatggcgtgaacccgggaggaggagcttgcagtgagccgagattacaccactgcagtccatcctgggtgacagagcaagactccatttcaaaaaaaaaaaaaaaagaataaaaagaattattatcgctctacatagttgccaacacttggtattgattggctttgacatttacatttctcagtggctttaatttgcattttcctgatcactaattaggtagagcatcttttcatatgcatattgcccatttatgtttccccttctaggaaatgtctttttgtcttttatatttttctattagattgtctttttttcttcaggtttttacaagttctttcaaagagacttcctatactagtccctgatgttaagacattagtctggtagtaagaggaataaaatgaatttatttgtcaggatagatattgttgccaacttcagctaggataattgggacagtggcaagtctaaattaaaatgtttctctcttcctttaaccattaggattcactttaagagatttggaaactcttccctttggaattgctcttcccatcagagatgcaatttatcactgtcgtgagcagcctgcctcagactggccagaagctgtctgtctcttgattggacgtcaggatctttccaagcaggcctgcgaaggaaacttacccaaagggaagtctgtgagtatcaacatagaaagttcagagttccaattttagccttaaataaaatcataaagtagaaatgttcttcattttcctttaaggctttttctaagtatatatattagcttgtcttttatattatatgccagacggggtttgtaattgtatgcgtcttattaattgttaagttgagcataggagcaggagattttgtgaatgttctgtcttgtgcctggatctttctttgccttgaatcaggacaagtcctgagtgtagtcatggaaactaccatggctatttccctacttgtaccatattagtaattaaccacttcgtaattattacataggaaaagggagagcacatatatcctgaatttggatgagtaattatatataaatattttctactgcatatttttcgatgtgttgaattttttgaatttaaccttttaaataggtgtaaacatatttatttaatcacataaaactgcagccccagggaaaaaatgtgtttttttagtagagttgtttaaaaagatgtcttaagctatccctcccgaaatactgtctttcatcaatcatcaagtctgtttttttttttaaatgagttctaggaatcctgcaagtagaaagtaaaattatttcattactctccaattatctttttatatcatcctctcttaaaacttgaaaatgaaacttttaaaacttattctagaattctaggtaactttaaaaaatgaacagtagaatctcatcaaggaggattcaggaataataattccactcctggtgactcttttatgttcatgtccctgagaagacagtgggaatttggtcttacctcttagtagcttttgaatcaatacataataatcagtgcattgtaactatgagtcaccttaggtcttattactacttcttcagagcctatatcaaaacttattcctaacctcagagttgcctaatgtgtacccatgccggagtcagtttccatgggcatctgatctccagcacggtcatcccagcacgtctctcctttaatctgcgcctcaatcacagctcttcgttgaattagtatttacatcctgttttaaacagaaaacaaatctttttgcttataaaatgattttcctgtgagagagagcagttcagcaccattagcattaaaatattaatctgtatttgaatgtcattttaagtaattatgtctaaatacagtttgttcagttgaggctacattttataactaatcccatctaaatttattttgtcactgtttgagactatgttttatagctaactcacccattagaatatagtttttttttttaaattagatattttataggagctaaaaatgaatttttaggaactaaaagtgattatttggtcgtatctacttttttttcaggctgaccttgttggtttcacattaaatgttgcaaaactttaacatttcaacttggagttattcttttgttaaaagagtataatactgtttttgagagaatatgatatgattccacgcaattcacatctgtgttgcagttagatttaattatttggactgggaagccccatattaaagcacatgctgggcttagaacatgatgacaatcaaggaatttaccctcttacttgttttgctgtagttcagtacttttccttctaagaaatttttattggaaacacattttttaaaaatagtgaaaactggctgggtgtggtggcacatgcctgtaatctcagcactttggggtggccaaggcggaggactgcttgagcccaggagtttgagaccagcctaggcaacatagtgagacctcatctctacttaaacaattttttaaaaaatttagccaggtgtggtggtatgtgcctgtagtcctagctatttgggaggctgaggtgggtggatctccttgaggtcaggagttcaagaccagcctggtcaacagggcaagactctgtctctacaaaaaataaaaaaaattatctgggtgggcggtgcacatatgtagtcccagctactcgggaggctaaggttgaaagcctgcttgagcccaagaggtggaggttgcagggagccaggatcacaccactgcactccagcctgagtgacagagtaagaccctgtctcaaaaaaaaaacaaaaaaaaacttactaatggaatccaaccatgatcctgtctatttaaagtagtaaagtaaaaggtatttcattgtgtgacttcccccaacccttggggtatatcctttcaggcttttttccttctccttctattaatgaacagacaatatttaaattagcattattagcagtgactagtattcatattctacttgcaataatttttttttaagaaatgatcaggatgtagttagatttttttttatagtttattcagaatatttctctgttcgtatccagccccttgactgttgccctaaatttaaactctccccgtcatttccaaatatttccaagtaggcaatgtagtacttttgtttgtttgtttgtttggtttgtttggttgtttgagacagaatctcactctgtcacccaggctggagtacagtggcacgatttcggctcactgcaacctctgcctcccgcattcaagtgattctccagcctcagcctccccagtagctgggactacaggtgtgcaccactgcgtctggctaggtaatttttgtatttttagtagagaccgggtttcaccatgttggccaggctggtctggaacccctggcctcgggtgatccacccacctcggcctcccaaagtgctgggattacagagtgtgagccaccacacccagccagcaatatagtactttttagaaagatttgtagattagagtcccagtatacattgcggccccaacccaggcctgctttggaaaacatattttctctgtgctagtatagtcatgacacatcagcctatatatcctcatgttcagcaaatgcacgttaactgcttttgaaattattattataataaatctgttactcaggtgctctcatcagatgttccttcaggtacagaaactgaggagaaagatgatggcatgaatgacatgaatcacgaggtcatgtcattaatatggagtgaagatttaagggtgcaggatgtgcgaaggcttcttcagagtgcgcatcctgtccgtgtcaacgtagtgcagtacccagagctcagtgaccacgagttcatcgaggaaaaggaaaacaggtgaaagaaaacacgtgtactatctcttgtcacgtttcattgttacatttgtgtcttgtttatatttgtttttccttcaagtttttagcatttaaaaccctaaagagatttaaaagatactttcaagtgaaaatatgccctgtgttttaagttttcatccaacttcaacaaaccacgtgtgttagcaaaatgtctttggcttttgaggacgtaattgttgtatttcataccgtcctcctcttgaaatacatataacagtttactctttagaaaaggtgaatgtaaaactattttgcctgatagttaccttaagaatttacaaacaaagaaaacactggacttgtttttctgtgtcttgatcaggaatagattttgaggttagtggggtttttagtgtagtttaaacttatatcagtattttttttttggatatgatagataatactccaaataaaaatagataagcctttcttctgccactcccctgcacaggatacatcccctgatacattgtaagactcacatgcctgtgacattccagagctattctcttgggacacttctattttaaaattctctcctgttcttttatctgcttgtctctatcatctatcattcatctgtcactgttttctagttctctttactttttttatggtactgttttgaggggaaccgtcacccacacttagccacaggctgctgaagatctgaattagttgtgatttccctattaactgtttcctctccacaagtacccagttattagtcacctgtgaataaaaagatggagtgacagaagttgagtttagagcataggatttatgagcatggcctctagagccaggcatggccatgctgtgctgggtgactggttaaattactttacctcttgttgcctcagttgcttcatctgtaaaaataggcatacttcatgggatggtgctgtgtatcaagtgaattatttttacatagcacttagaatactgctcaatacatagtaaagctcagtgcagtcagccattattagtagtagagttcattgattctaagatgcaagttttttcactttttaatatctctgaaatcagatgtgtatttcagtgaacaggtgtcatagtttaactggcagtgctttctctttcttagtttctcatgaaataatgatacatcttatgagtggcatcttatattcaggggatataatattgttctcattataattttgttacttgtgcaaagttgaagtgaattatgtgtaagatttcctctaaaaaaattctatgggttgcaacagactcttggctttgaattttcctgatcccaaattaatgtggcggtcatgttcccagagaatctttaagacagcaaaatttttctctccagttagctagaaaagcagttatgtgtgtccagttaaggagggagtatgcttatgaatagctttgtctgcagagaaaatgttcgtcagttgtcagcctctgaagggatatttctgtgtcttcagatataacttgtataagcgtttcttagttataaatgccttacttccaaaatttctgttagttttttttaagtggatatatggaatgttaagctattttaacagaggaacaagttgaagagtggtatattaatttcacagtagagccgacagaaaccattttaaccttgaacatacctgatacataatggtattagtcctataaacctagccatcatgtaagtgaaaccaatctgtatttcccttggagacaccatgaaatccattcacctctaacatagggaccttgtttcttttcttgtgtacaggccacagaaatggtacttctgaggctgtattggcaaaagggatgggaggaggatcccacatgtactgaggacagctagactgaaattaacacagtgataaaaaccccaaaagtactgtattttcctttgagaaggttagcatccatcggagtggaattttaaatttcttttgtttttttgaatgcctagagagagtcggcttggtttataggccaggtggttttcattcaatgtaaatatgaaacaaaacagaggaaatatgtctctccctaagagtgtaataggaacaagaatattaaaatgaaaataatcatgtttgggtagttcactcacatctgtgtatgaatttactttgagacaacttcatcttacacagtacaccttcttttgaaatacttacagatgatatttcaattgcgctttgctttaaacattttcacatgttggtttttactttaattacagattactccaattgtgtcagcaaactatggctcttcctgtaggacgaggaatgtttacctttttttcgtaccatcctgttccaacagagccattgcctattcctaaattgaatctgactggtatgttaaattctgggctcaatgagaaaggaaagtgattaagtacatgcattaagtgtagttctttaaattagttaaaacaaaagaaatgctccctctatccccagtgattttaaattttcctaatagctgctatagtggttatcaaagctcaaataccatgtcaaactaaaccttgagagaagcagaatatagttcgttactcatttttgctttttaatgaggtgatttcaagatatacaaagtcacttggagaagttcagaaagatataattgataatgatgagactattgaattttaaataatcttgagtataatatgtaaaaatatttagttttaaaatgtcttatgtcatagtttaaacagatgatcattgtataaatcaagaaatgtcctaagcaaaaagagaaaaaatggtcacttgcagtactcccactcttctgcatcactccttttaacattttaatatatatgtttactaagtttatttccacatatttataattttatatttgtttaattatcagaaaatttaaatctattttagatattttttaaaatttacagtgaacatccttttatatctagcaaataaatgtatgtgtttataattatgtgtatgtattgtatacacgtgtttttaatcgatacattcatttttatttgcttcagagtatttcattcagtggatataccatagtttatagaagcagcctggtattgttggaaattacagttttttggtattataaacattgttggggcgtattcgtcctatgtatttaggctaaatgcttagaagtagaactcttaggacagcaagatgaatggttttaaggaacatgtcaaattgcctttctggttggtgcaagtttttatttctgctatgtataactgtagttatagtcttgattacaatgagttttttagtgtatgtccgcctaatgctgatttgaatgtgttctaaaggtgacaattacatagttgaaattatcattgaaactctattatagtatatatggttttgtgaaacctatacaaaatgtatgtgtaatgtatgttgtagtagtgtatagtatatgtagtagtatataatgtataatttaatatatgataaatagtacataatatatgcaaacataattgtacagtattttaaattgcatactttaaaaaatccagagttccactcagatttgtgaacagcttgtgctttgagcagcatgcaggaaatgagattgactaagtgaagaacacattcccatctccatatcatgcttattctgagccctaatctcactgagggacatagtgagcagagttgcttttaatatttaaattgtctcagaggtaaagcacctatggcaaaattttaacaattattgattcttgatggaaggcatggtatatagatgttcattttagtagtctttccaactgtttatatgaaagatttcatataatgagtgcgggttaaaaaggaaatctaatgcaaaattggcaaatgttaaaatgtattcaatctgggtgatttagcactcaagcgatacttgggtgggtttaaaaaatatatacatgcatctttttttctgaatacatttaattgaatttgcatgatttaaaatgtgtttatgacattaatccaacattttattcttttagtcattctggtaggccaaaaagaaaggttatcctcttaatttaggaaagaatattttcttaaatagttgcttaacccacactgatgtggcctgttgtacttttgtatgttgttattctcattgaagaaaatttaccttaccctttgcattttattttctctcgtgtataaatattatgtcttttgcatatgatgaatgaaagtttcagaaagttcactcagttttttcatattgatatgtctgccttttttgagaaagtgcaagtgtaacttatgaacttattactcattgtggtgctaacactagcagttgagttagcttttaggtacaaaaagcatatagtaaagacaaataagtcttactttgtgctttgtgtgtgtatgtgtacatgctacaaataagacactctgcatctacttaaaatttattttacataacatcttagaactctttaaaaatggtacttttaaagctgcagtgaaatggataactttatgcagtaattaaaatatttatgttaattattttatctgtgacttaagacagtattcaaaatatatttaaaaagattcagtgtttgctgtgtataatgtagatcaaaaagaaaagaatcaagaaaaaattcgtagggaacatatagcattgtgaacatataatttacattgttcttaaatggaccataaaagtaaatctagtgaatgcccttttgaagttcactgggtgactcaagtctataaaaggatgctttttacaaaactatctctaagcattttaaacaatagcatataattagatatctatatctgtatgtatatagagagagagaaaaaaaagagagaagggggcatatataggtaagagctgtagcagatttattaaggttcttgtgtctttttttttttttttttttttgagatgcagtctctgtctgctgcccaggtgggagtgcagtggcatgatcttggctcactgcaacctctgcctcccaggttcaaatgattctcatgcctcagcctcccaagtagctgggataggcacgcaccaccaggcctggcttttgtcttttcttaagatgtcatttttccttaatgtccaggggaaaatataggatagaacatttgaaattaacatcaatgtcatcagatgttgggatttataacttgtatagtttaacagtgatgttagtcttcattttggtttctaagctctctactgtttgaaagaaagatttcaaagcagtgattatcccagtcatctctgtataatgttaaattggtatcagttatctcattatatagcctcatacattttagcaaaaaggacaatgaactgtttagacagtgatggtttttccagttccattaagtttgactcacatgtacaaaagttttaagtggtcatagagacctaacattccaggcattatggggttaatggttttgaatgtagaaaatgtaagtaatcttagtctcaaagatctaaatttaacaatcttggttttgtgaatttttattctctcagtgttcttcgtttggctggatagggcgtgcccctcctcggaacacaacagtagaccttaatagtggaaacatcgatgtgcctcccaacatgacaagctgggccagctttcataatggtgtggctgctggcctgaagatagctcctgcctcccagatcgactcagcttggattgtttacaataagcccaagcatgctgagttagccaatgagtatgctggctttctcgtggctctgggtttgaatgggtaccttaccaagctggcgactttcaatatccatgactacttgaccaaggtgagacctgtgctcccagtgcctggctttgtgccttgcctggctattgtagtagctcctaattgctctatttgctcttctttcttcattcttgtacttctaagtccatttgtctcatagtacgtggaataatctttctaaagcataaatcagagtatgtcacttctctggtcaaagccatttaattaatgatctcccattgcttttttttttttgagtaaggcagggtagaatttaatgagtgacaggaaagctctcaacagcgagaggggacccgaaggtgggttgccagccacgaggctgagtctagaggtttttatgggcttgaaatgggggaagtgcatgctgattggtctgtgggtatgcttgaaaaagcaccatttagaaataggcacgatagtgtagaggaccaactggggaagggcaggtatatgtaaagtaggtgaaggataaggaccaatcaggagagagcatgccaaacaggaatgagagctctctagtccatggatttatccagaacttgtagcttggttttcaggctttcgactgtccttggcttgaaggttgagtttcatctgagaatttacctgcctcctaccgccatcaatccccgctctgaagaggtatatctaactgctgttcggataggggtgatgactgttctgcttcatgctgacagagggtgttgttttgggaaacagcagtcaggtctctcttagaggcctatctaagtgtcccctggtaaaagagagccatcaaccgaggttccatttgcatgaccacttggagtttgatggcctctaggcgagaaaaaacaaattttacaaggaggttaagtacacatggaccaaatatgagtattacaatgagaacacaaagaggaactaaaagggggaaaatccatgcccatatattagggacacctagaaaggacaggaagaaaacctctgaaaatggactgttctattccaggattttgcaaaatagggttgtcatgggcatgtccccctagattattagatatgttataattaggcattgcaatgcttttaattagatttctgatccataggctgcagaatccagtaatgcctgataatccctttagttagctgagggtcttggggagaaggaaggagaaaatggatccaattctctcctcgcccagtgtcctggtcccttctgacaagaccaggcataggtacttcactgaagtctgacggagttgagccttggactttgaaactttatgtcctctgtcagttagaaaattaagaagagccttattgcttttctgagaaatttcctcagttggggcacagagtagagtgtaatctacatattaagactaacttgagtttgaaagaactcagagagatctttttgagattgcctgcccaaacaggtgggggctgtcttggaatccctgtggtaacaccatccaggttagctgggtagtctggttggagggatccctgaatgcaaacaagttttgggagttggggtataatggtatgcagaaaaaaagcatcttttaattccaagaatgcaaaccatttagttccttcaggtatctaagttaacaaagtatagggattgggaaccactgggtaaattggttaattacaccagttactcattaaggaggtggagatcctggaccagtctccattccctgttgggtttctttctgtacttccaatattaggatattacaaggactgtcgcagggtttaacaaggccctgcatccttaggttattaatgatggcttctagttgtttcctagcttctggttttaggggatattgtctttaattagggaaggagatgagatccctgagatggatttggactggtgagactgttgtagctcagccagtattttcctgaattgcccaaacatctggattaatatcagtctccaccagagggaggcaaagagtctgtcctggagccataaggatggtggttcccatgtgagctaaaatatccctacctcagaggagtcgggctttcaggtatgattaaaaaggcataggtaaacgaaaggtctccctaggtacagctaagggattgagaaaaatatcgagtcagaggctttcctgagacgcccctcacagttgtgctaagggaggaggggaggcccagaatggagaggagaacaggaatggctgctctggtgttgagtaggaagtctgtcctctgagtcctttgacctccagactcacccgggactcctggatggtaatgcagcctgggctgtcagagctggggaggagagccctgggacccatcagtcctgctggaccatttgagaagccggctctgaaccttgggacgtatgtttctggaggcagtttgtcttccagtagtctcccttacagattggacagggccgtgggggctgcttctgatttcgggggcagactctcttttagtgctcccacactgataacagtcggtcatagaatgagaagctccctgggatcgagaggtttatatgcctgtatggcagctattagtgcctctgcctttttctcgttccttttctccctttttcttgggcttcctcatggtcccgattataaaagaccaaggtggtgactttcaggattttctttagagtactgtctggtgcaatagctaactttttgcagcattcttccaatatttggggctgcttgggttataaacttgtctttcaaaattaactatccttttatagagtcaggagagagatgtgtgtttaattaaagcctctctcagttttttccaggaaaacagaagggttctcttcagacccttggtttatggttgataacttaatgtaattgagagatttgcctctagttttcagatcttccactgtgcatccctaaaaatgttttctcggccactttcctagagcagtgtctgagtcccattgaggattattggtggatgctgcctgcttggctgtcagaaagggctccctaatttcttcccccttttggtaggtgccataataagataaacatttcatctccaaatgtctcagtgacctgtaaagccgcctgcttctctgaagctctaagagtctagttgagaagtaacatgatacccttccatgaaagctcagacatttgattaaggttctgaaaggcttcaatatacctatccaggtcgacacaattgtcctagatttctttttatctgcctcaaatcttgtaaagaaaaggggacttgtactttgataggaccatattcactatgcatttcctgtaaaggaagaagtgatgctggagcgcatccaggtcgaactcttctaacaggatgaggttcaaaagggggcctggataagggggacgagatgatccaagaggagctgggacctgggctggtgcaggggcctctgtctcctcttctaaggaggcagactgttttttcccttctgtctggattaagtctggctggatatcactgctataagtgcaaggtctattatacattgctgacagagcttgcggttattctgcagggcaaaaaaggcctatacatatggaattttggaccattttccttctctgtggttgaagagatctagctataggatagtattatagttgttattttccccagctgactaggtctccccatcttccaacttctagctgggccaagccttgctactgataaataccaggtattttttcttcagagtctgaggatcaaaggagtcccaatgtctcgcacttgagaggagtgcaggctacccatttagaaagagagaggggagaaaaaggcatccttagtctttccctctgctgtgctagagtccaaggcgtctctcaggcttgccttggtcgtggatgtgcgcgcagccaccattcatgaccagggggggatcaagccagcaggagtagttgcgttcacttgcactcagccttgaccctccttgtcaactgcctttgatttctctgaattctatatgagctcaagactaagatgaatccgggggggtccctgcatattatttgtctataattctcatctggctggcagtttatttagcttcatcaagcataacccagcatcctgccctgaaaagaagcaatttctcaaagagacacataactaagtaacatttctcagaagagcagtaggaaaaacatgataggaaagattggaagtctttgtccgacacctgaacaggctgttggggactgggggccggtgtagggtccttcggatgtacccttggccagatacctttagttgccccaggaccttattctgatcccacacgatggctgaacttctgtgaagggaaactggtttagaacaaggccaaaattcccaacaccagagggcaaagggggatcgaccattgctcttaatatacattctaggagctggtgtgatcctgttcacttctccagccctaggtggtaccactgttcttcgttttttttttttttttttttttttttttgatgtggagtctcaccctgtcacctaggctggagtgcagtggtgtgatctcgtctcactgcaacctctacctcccaggttcaagcaattctcctgcctcagccttctgagtagctgggattacaggtgcacactaccacacctgcgtaatttttgtatttttgatggaaacagggtttcaccatgttggccaggctggtcttgaactcctgatctcaggtgatctgcccgcttcagcctcccaaagtgctgggattataggcgtgagcctctgcacccagccccactcttcttgctcccccacactctaaccatacagattggctattttagctctctggcaaactaaactctttcacttcacagcgttattttttttttaaggaatctttatttatataaatatataaaattcacataccatacaattcactgtttaaagtgtgtggtacagtggtttttagtacattcacagagttgtgcatccatcaccactgttaattttagaacatcttttcaccccataaaggaaccttgtacccactagtggtgactccccattcctctacctcacccccccaccttcacttcacttcctgccaaccactaatctactttccgtgtctatgggtttgccttttctggacctttcatatgaacggagtcatacaaaatatggtattttaggatgggcttctttcacttagcctgataattttagggttcatccatgttgtaccatctatcagcaatacattcctttttattgttgaataaatgttttattttatgaatgtacattttattcataagttgatgaacatttgggttatttgtactttttagctattacgaataatactgctatgaacatttgtatacatgtttttgtgcggatgtatgttttcattactcaagagtaatgaagtaatggtaagtagtggtacatacttaggagtggaattgctgggttatatggtaactctgttaaactttttgaggaactgtaaactgttttccataatgactgcaccattatacaaccccatcagcaatacatgagagttccaatctctccatatttttgccaacacttgttatattgtgttgagtccagcctcattcttttgaatgtgtccttccacttgtcccagcactgttttttgaagactgccctttacctgttgaattgtcttggcacccttgtggtcagttgatgttaatgtgagggttcatttctgaatcgcctcagagccatttatttacatgctgttttatcacctgaaacagtcttcctcaccttctaaacttgagtgtcctctttcctgccactgttcctggctaatttgttttcatccttcaggtcctaatataaatttctttgtataatctttagagatttcatccctaataatcctctagtccctcccaatctaaattaagctattttaaaatactctttcataatactttgtactttcttattgtactactttttaataatatatttgtttatgttttttaatttaacactttttttcctattaagtcattaggtccatgagagcaaggaccatgtttgtttagtttactgctgtattctcagtgcctctcaccttgcctgtcaacataaaagtacttcttgaaagtggcaggcagtattttattttaaactatgtatttgttttgtttctatcttagggccatgaaatgacaagcattggactgctacttggtgtttctgctgcaaaactaggcaccatggatatgtctattactcggcttcttagcattcgcattcctgctctcttacccccaacgtccacagagctggatgttcctcacaatgtccaagtggctgcagtggttggcattggccttgtatatcaagggacagctcacagacatactgcagaagtcctgttggctgagataggtatgggattaatagtgctgaatcttcataggcatgtactctccactccacattaacccaattaaatagtaaaattataaaaattaaggaaagacaatggtagcttttgtgagcaaagaatgatctagtactaattaaaaaaaacaacaaaactctaagtaatgttatccaaggctaatgtaactgcaggttattaacctccatgtttatttgctagctcattactgaattccagtggtcacatttaatgaggtacctgtggttttaatcagctatgagtatgctgtttatccggctttaccagcagtgtctagcagtggcctgcacttaaaactcagagtagattgttttggtccctgagagacactaaactaaacacatcacagtgtttactgtgttggataacagcacttccaatagaagtcaagtaatggactcctgctttcctcctttacatgctggtgggtatgttggtgatgaacctggaaatggtaaggtccacacactcactttagtgaacattgtctctgttttttattgggtccaaactttttggaaatcttaatgtgttgtcatctttttctgccaaatggaaatgctattggcattattaatatgctcaacaatttagttacatacttatatgtcctattcaagatcttttctatatggatttgtgaatatattgttaaagatgtattattctttagtatcattgtatcagatagctattgccacagtgatgctacatacatacaggcatagcattggcccaggcagctctgctttaggctgtagatgtgtagccggctgttctgctgccgttctgcctcacctgcctcattctgggacccaggctggagggtgtgtttctctcgtggtgttgatagaaacctaggagagaaccagtgaagattgggacccataatttagtctactataatgataaatgaaattattcccaaagttgaaatgttttggctatcacaatacatggtagcataagtcagagatctgaaaaacgcttattctgaaaatattcaacactggttgttaaagcatgttcatctgcaaagtagtctacccttctttggctatatcatgatgatgtctaatggtgtcattgcacagtctcacagctgcggcatacctctttcacactgtatatagaagatttcatctttaattcatatgtatatgcctttttatataattactgtcagaatgtacattaaaaaaattttttttttttgagagagtcttgctctgctgcccagcctggagtacagtggtgcaatcttggctcattgcaagctccgcctcccgggttcacgtcattctcctgcctcagccttccgagtagctgggactacaggcgcccgccactacgcctggctaattattgtgtatttttagtagagacagggtttcatggtgttagccaggatagtctggatctcctgaccttgtgatctgcctgtctcagcctcccaaagtgctgggattgcaggcatgaaccactgtgccccgcctaaaaattgtttttatagatcattgttataaatgggttttaaaacaaattttgtgtaatattcattgagtcgatggtctgtaaaatgcctttttttaacttttagaactttttagattgtttctaataatcctttgttgttatatataaacattacactgattacctttgtgtgatttttttctttaatttttattatttatttatttatttagagacagagtctcgctctgtcacccaggctggagtggagtggggcgatctcggttcactgcagcctctgcctcccaggttcaagcaattctcctgcctcagcctaccaagtagctgggattacgggtgtctgtcagcatgcctggctaatttttgtagttttagtagagatgggatttctccatgtcggacaggctggtctcgaactcgttgacctcaagtgatcctcctgccttggcctcccaaagtgctgggattacaggcaagggccagcacgtccagccttttttctttttttttaaattgcatttttttcctatagggataaaatttcaggaatgtgaacattttttcagagggaagggttttaatacatagtacattttatcgttttcaacaaggtagtgttagagttatagggtgcttttaaaagtatgaattttgtatccagtcagacttctaggatcagtacacagaaattctaccatagtagggctcattattatatacactcgaaataaatgtctaaacataatatttaacagcttaacaacataagtaagtgacctccttattcattatcatcattcgaacatgtttcaccacatgtgatgtgtggatttgaaagtaatgaaaacaaaatgtaagatatttcgttgttgttgttgctgagatggtgtctcactctgtcacccaggctggagtgcagcgacctgattttggctcactgcaacctctgcctcccaggttcaagcgattttcctgcctcagcctccccagtagctgatattacaggcacctggcaccctggctagtttttgtatttttagtagagacagggtttcaccatgttggccatctggtctccaactcctgacgtcaagtgatccacctgcctcggcctcccaaaatgctgggattacaggcatgagccagcacacccggcccagatgttttaacaaaaaaataaaactttttttttgaatactctttcctttttccctttaaaatttttttctactacttggtaatttttttggtaagactcaaagtttcacagtatttgaatatcattgcttataaagacttaaattggcaatttaaaaagaactattttgggccctttttttttggtaggtaaacctacagttgtggacaccatttattatagtgtcataactttctgaatggagttatattccattcgtatgtccagtgcaacttgctagaaagttaactctaagatttttatgagatgagattttgagaagctagtttgaactgtgttgcttttgtttttacaggacggcctcctggtcctgaaatggaatactgcactgacagagagtcatactccttagctgctggcttggccctgggcatggtctgcttgggggtaagcatagcctatgccttcccatgcttcagttaggacatctacatgttgagacaaataacgttgacacctaaacctgaatattgtcccttactatgacttaatctgctgcccagctctattgtctttttggatatttttcaaagtaccagatttgcaaattgagagaaactgtggtcaagagtgggactttaagatttcttttcctccagcttgcagtgttcatgaacaaactgaagggaataaagttttttttttttaaagcgttcaagacatagaatgaataagtgacagcccactatgactgaaaacagagaatagtgaaaacgtatatgatcgggagccttaagagtctatagtagctgcttgaaacaaaccctaacccccttttgccatagtgatgttcactgtgtatcccagaatgttgtcccagtagcatcttccttgtgacaaaatgcagtatcagattgacccatctttaactccatccaagagatgtgtacagaattaccagaaatgtttcattaaatgattgtttcacttgaaatgtggttccccttgaaaaaccaccaatacattcttatggtcaaactaaatgatataaagaaagttataaggccgaggtgatcggatcacctgagattgggggttcaagaccaacctgaccaacatggagaaaccccatctctactaaaaatacaaaattagccaggtgtggtggcgcatgcctgtaatcccagctactcgggaggctgaggcaggacaatcgcttgaacccaggaggcggaggttgtggtgaatcgagatcacaccattgcactccagcctgggcaacaagagtgagactccatcttaaaaaaaaaaaaagttatagtggaaggaatttttttcatgtgtgttctgaaaatccaccttgtggttgaccatctgttagggccttgaattcacattggcacgtgagctaaagaggctggtggtataatggaaaataatcagctgggtgtggtggctcatgcctgtaatcccagcactttgggaggctgagatgggcggatcacgaggtcaggagatccagaccatcctggctaacacggtgaaaccccgtctctactaaaaatacaaaaaaattagctgggcatggtggtgggtgcttgtagtcccagctactcaggatgctgaggcaggagaatggtgtgaacccaggaggcggagcttgcagagagtcgagatcgtgccactgcactccagcctgggcaagaaggcgagactccgtctcaaaaaaaaaaaaaaaaaaagaaaagaatcacacagggaattgcaacttgaattctggtcctaactagtgagtcaagtcatttaactacattattgtgtattgcttaatcagcttcatggattgttgagccagatggccgtgttttatatatagccctgcaacttaactataatagctgtataaccttgggcttaatccctctgtgccacactttccttatttataaaatagggttttaatagtagctatttgatatggctgttcattcatgttaaacacacagaatagtgcctgacacagagcatgcatttaataaattactattattatcatagttattgttggaaaagttcttaagtacaataatgacagtattcaggtatttacagttccagtttcaattatataactaatatttttctttattgttaaatgtcactaactctaaagctcttatgtattttaagacagtacttaaagttgaacattcatgtattaaaacttttatgagaattattaatatttattaactcatgattaatgtttgctttaaattggaaataaaaaaaacaaaacccaaaataacctgctttgaagttagttcatttttatatttgttatgggtatgtgttgtggatcttccttcataaaatttcttttcactcgtctgttattgtcttttccagcatggcagcaatttgataggtatgtctgatctcaatgtgcctgagcagctctatcagtacatggttggaggacgtaggcgctttcaaacaggaatgcatagggagaaacataaatcaccaagttatcaaatcaaagtaagtacacagcaaagtaatagatcaaaagtctggaagctgggaagttaattggaaaatactagtgttcatactgacattggtaaatgtgttaattttaagcatagttattattcagaggaattttataataatttagaactcttttacatgcataaactcttctttcaataggaaggagataccataaatgtggatgtgacttgtccaggtgctactctagctttggctatgatctacttaaaaaccaataacaggtatttctacccactcacccttcctcccgcggtgatagtgtgatatcctccctgaccttggttgtaaaattcagttatctcatgtgtttctttcccctgtgctggattaagctgattttttgttctttcaagtactgtaagtttttgaaagaaaacttgcagtatttgaagttataaagattttacctggaaataatgtatttggctattttaatggtatttgacaatatagttttcaatttctgttcatttctgttttgtagttgatgtcagtaacacccaaacaatgcccatgtttgttttcattaatttagcatattgctgtgaggactggttaagccagaaatacttatcatttagtgtgatcttggttaccatgtaaaacaatggtttttgcctacttcaggagcttttgtaattaccaaaccgtctaccttcctaacttgctatattaatgctgacgcttgaaagtaagatctttggcatttatgcttacactttgcatgaggaataagttgagtacaagacgttatgtcatgtcttaagtctattaattaaaaacaaattctaagattcaaggagttttcagtgttccacatttctccctttagaaaaagtaaatgtgtgcagaattaacaaagtgtttaaaaatagatatttattactttactatttggatgaatgtgtagggcagtgcttccttggcactggggatatttcattgagcaaaactaaaaatatcttccctcatggagtttatgttatagtaagacatacatgtacatctataataactattacattagaaggtgtgaagtattgtgaaaaatatgtagagctgtagtggagcgggaagaaatgttttgaaatagagcttgagattcttgattgtcttgccctctacttgaacagtgtgccttactgttttcctccaccaccagatctattgcagattggctccgagcccctgacaccatgtatttgttggactttgtgaagccagaatttctcttgcttagggtatgctttgtcttcatttgtgttaacatgagaagtctatttgtggttcttaaacttagcttgtaagccgggcacagtggctcacgcctgtaatcccagcacttcagaaggttgaggcaggaggattgcttgagtccaggagtttgagaccagcctgggcaacacaggctgttctccatgactgaatgaatggcaaacataaatgtctttacaagagagccttttatttttaatttgtcatgcatatctaattggcagtgttcatttgaaatttcacaaataggactttgggaatcccaagaaaggtaaccacgttgatatttaatacttggagtgacatttcactgtctcacattattattcaaaacttcctaaaaagcaacaagtgattaggacttttttactgctttgttttacatttttggattactatcagggatgtgataatactgttaaggttgaatctaaagaaagtaacaattcacttaattgtctaaaattttccctctaattcttttttttctgatgtttaaacgtagcatatagaagcttttaaattatgtgtagatagagctatgattctttcctttgtgatttttttcttttccagagtacattttaaaaagtacccgcacaagccctctaaactttggtgatattcaactcaattttagtttttctttgttaaaatttaaatctttattttaatgagtagtttaatgagtaagacggttcccaacttaggttttttaacttaaccatagtgtgaaagcggtactcattcagaagaaactacttccaattttaattttaatttttttcttgtactcctggcagtatgatgctctcatggtgttgggtaatggcagcaagctgcagctcccagtcagccatgcagtcatgagggtaaatgacccatactctacagtttactatgctgacagagaatttcactcaattataggctaatttgagtgttcggagcatgtttaaggtaggctaggccaagctgtgttgtttggcaggcaaggtgtattaaatgtattttctttttctttttttttttttatgagatggagtctcactctgttgcccaggctggagtgcagtgacaccatcttggctcactgcaacctttgcctcctgggttcaagctattcttgttcctcagcctcctgagtagctaggactacaggcgtgtgtcaccatgcctggctaatttttgtatttttagtagagatggggtttcaccatgttggccaggctggtctcaaactcctggccttcagtgatctgcccgccttggtctcccaaagtgctgggattatagacatgagccactgagcctggcctaagtgtattttcagcttaaggtattttcaacttacaataggtttatcagtacataaccttactgcatttgcatatacttatttttcaaaattctcaacagttgggaactgattcttaaattgttctgtttattattatcattgttataaaatgtatgaactttacttgctctaattaattttatctctgttgcatttttaagacacttgctcgatgcctgattttgtgggatgatattttaccaaattccaagtgggttgacagcaatgttcctcaagtaagtacatataataaatattatatctttagtagcataaaattatgatttcttatgggatttttcaaaattctgtaaaatattttttcttatgaaggcaatattgatcattaggatacctcttaaagacctaagaacttccattttaagattctgtgctgcacagaccaccgccttctcttttagcctcaggtccctagaaattgtagtttttaaaaattaaatatgaatatcggtgttgcgtgggagttaaaaaatgaaaggaaaaaactaaatatgtttgccagaatactctaaaaaagtgttgatatttttgtcataattaagtgcacatttctaagatgctattttacttcgtgacaattttagatctcctaataactcttttaattactttatatcatatttattcgataagccaagtatactagttaaaaatgaacagatttttttggtaaaaactgaaaaccgaatattgtaactagccactgcccttagacaactgtccatgtctagtggtctcagtttctttatgtagattgtttctttcagtattttcagaggaaaaatctcaaagattgaaagaagttaatatgaacacccacatcaccaatagactctataataatattttactgtataaacatgtttcatcacttatctatccacttatctattcctctatctaatccaacattttttgatgaatttcaatgttagttccaaacagtaatacactccatcccaaaattgtaccatatatattaactggaattggtatttacattttttccttttaagataaaatttatatatcgtgaaatgcacaaatgttaagtatcctattggataagatttgactaacacatagacctgtggaaaccagcctctatcccttgtgccccttccctctttgtgcattcacctgtacccccaggtaaccaatatgtattttgtttatctcccaaaatatgttaatttccagatgtagaactttatattaatgaagccacatatggcatatacccttttgtataagacttctttcagcgttttcaagatattgagtatattaatagttcatcctttttattattaggtggtacagattgagtatttcttatctgaaatgcttgggaccagaagcgtttttggattttggaatactcgaaattatacttactggttgagcatccctcatctgaaactctgacatctgaaatacttcaatgagcatttcctttgggcatcatgttaatgttcaaaaaggtttggattttgagcattttggattttggattttcggattagggatcctcaacttgtgtattccatttgcaatcctattaggtggggctggaattactgaggcatagggtagatggtatatttagttttattagaaatgataaatcttttcccaaagcggctgtaccatttgacacattgaccaacagtgtttgagagtgttggctgttgcccatctaaccgataattaatggtgttagttttttaagttttagtgctgctgatgaatacgtaatgatatctgactgttgtttaaatttgcatttctctgctgactgttaatgttgagaactttttcattggtttattggtcctccgtctatctttttttgtgaagtgtctgtgcatgtcttttgcttattttttaaaaaaatttgtatttttattactgcgttgctggagtttttttaatgcattctagaaacccgttctttgtcagatttctttttttttttttttgagatggagtcttgctctgtcgcccaggctggagtgcagtggtgtgatctcggctcactgcaagctccgcctcccaggttcacgccattctcctgcctcagcctcccgagtagctgggactacaggcacccgccaccatgccctgctaattttttgtatttttagtagagacggggtttcactgtgttagccaagatggtctcgatttcctgacctcgtgatctgcccgcctcggcctcccgaagtgctgggattacaggcgtgagccaccacgcctggcctgtcagatttcttttgcaaatatccctcccaatctgtggcttgcatattcattttcttagtaataattttaatgagcagaagatattagaatgttaaataatgtctgatttgtcagttttttcttatggttattctctattcctatgaaaaaaaccatttgtctaaccccatcatgaagataatcttttctgcttttctctaaaagcttccaaagttttagttttgtgtatacttacataattcatttcaaagtaattttgtatatgatatgaggtacatgttgaggttgtctaccagggaagctcatcagagactcagcacccaagtttttaattgggagctgacatgtaggtaaggtactctctgccttgtatgtacccaagttccagattctcaggagaatgtgtgttagcctaaaccacgctgtttgtagttcaagcacggtaaacacagatatatacattttgttttaaagcaaccggttaatttacttggaatcagattgtcattctttcttggttgctagctctaatcttggtgcacgtctttatcctgtgggctgttggagtctgccctgtgcacacatggttcatggatcaggcagacatttgcacagaatttatatacagagcttggggccctgtctctgtggctctctcctttgtcatattctgtcctcacctcccaatgggtgtggtattttcctgtatcctggttgttaaggccaagaaggttatgagcttttaattgtagcttttgccatctttcttggcgcagatagacctgctttcagagcagaaaccgcagaaaggaaaatgtatctagtggtgttcctctcttccatggatcgactctcccctctagaatctgcttgcgtttgtcctcactccagtgtcttgaggtcaggagttggtgaattaagcccacctgatttttagaaagaaaattttattggaatatggccatgcccatttgtttacttattgtctgtagctgttttttgttacaaatgcatagatcagtagttgctggtatttactatttgacccttttagaaatagtttaccgacccctgccatagatagtttggattttatattttgtctagggtttacacttggtgtatgagttgatctgataggaatttattcatctattatttgaggaagtagaactcctaggtttgtttttatttgtttagttcttccagttttgttaatcactgatatgaaagaggtgaggaagaattgttttaaatgactcgctcatttgttaccataattttaactctagcatattcagatgtcagagattttagtttttttgaaagtgctctttgaaatgtatattgtaggatgaaatactttttctttcactccttcattcagcacatactcatgaatcctctgtaaatgcaaggcacgtgctaaactctgtaatacattaaagatacatcagacatatagagtgttctcaaaaaactttagtttattaaatgcactaagttcagcttactgagattaaacatgtgtacaagtaactgtaattccaaagtggaaagtataaattcatgtcagagagtggtcttttttgcggcctggtgtggtgactcgtgcctgtaatcccagcactttgggaagccaaggtgggcacatcactcgaggtcagagttcgagaccagcctggccagtgtggtgaaaccctgtctctacaaaaaacaaacgaacaaacaaaaaaacacaaaaaacagtggtcgttttttgtttttatgaaaatatggtttttggacttttagtatagaataacatctctctcttttttacttcagactttataatgttatatttggtctttattacatcagggatactgcaaataggagagataacaatttcacagttctcctgattgatatttcctatcagcttccacttttctctgggttctcatctggagctacattgattctggagcagggttccttgtagtgagcaacctagcgttaaaaggaggatttttttttttaaaggtcactttgtaaactgcttgtctgtttgaacttagggcatatgtaaaataacaactagcatcttcatagtactttttctttcataaaaagctttacatacagggtgcggttactcacgcctataatcctagcgctttgggaggccaaggagggtggattgcttaagcccaggagttcaacaccagcctgggcatcatagtgagatcccatctctacagaaaaatacaaaaattagccaagcatggtggtgtgcacctgtagtcctagccacttgggaagctgagatgggaggattgcttgagtccgggaggtagggctgcaatgagccgtgatcgcaccactgcactccaacctgggtgacagagggagaccctgtctcaaggcaaaaaaaaagaagaaagatattttaagtctttgatttggtgatattcagtacataagaagactgtattataagtgccttctaatatttatttattttattttattttatttttgagactgagacagggttttgccctgttgcccaggctggagtgcagtggtgcgatcttggctcactgcaacctccacttagcaggctcaagtgattctcgtgcctcagcctcctgagtagctgggattacaggcccagctaattttttgtttttcagtagatacgggtttcaccatgttggccaggctggtctcgaactccaggcttcaagtgatccgcctgccttggcctcccaaagtgctgggattacaggcgtgtaagccactgtgttcggccaatatttattgttttattgaagaaaacatcctgaaatgttaagaaatcttctaagaaatcttctcagaagattaaaagaataaatcttaaatacattcatatgtttagcaaacattagctttatcttttttggcttttttcttttaggagaaaaggatcaaatgtcttcttggttgttacagctagatattctgtgtatgtttttcggtaaattgttcattacctatactaaaaggaaaaggatgtcttttctaaacaatagttgtaacatagctgataaacatattgacagtttagcttatcttagcctagtgaataacctcacctgtggtaggtatgttggattaatgctggaaacatcccgtaaagaagaagtctgattagagttgtctcctatttctcttttcccacttcttcccctcacccctgccccaattctaaagccatcatctttgtatttcagttgactggtatgcaatattatgaccctgttactgatttagaatatacttacgtcttcctgtttatatttgttcagccctatttaattattattattattattttttttttttgagatggagtctcactctatcacccaggctggagtgcagtggcgtgatcttggctcactgcatcctgcacctcccagattcaagtgattctactgcctcagcctcctaagtagctgggattacaggcgtgcgccaccacgcccagctaatttttgtacttttaatagagatggggtttcaccatgttggtcaggctggtctcgaactcctgacctcgtgatccacctgccttggccttccaaagtgctgggattacagtcgtgagccaccatgcctgcccttaattattattcttacttagcccatcttagatttgaaatttgattacattcaatgagattaaaatataggcttttgagtgaaacggtttggtaaagcttactttgtataaatatagccatgataagcagtatgttattcttcagattattaaatatttgtaatgagaacattgatatctaagtattcttgctttctatattgacagattataagagaaaatagtatctctctcagtgaaatcgaattgccgtgctcagaggatttgaatttggaaactttgtcgtaagtgatgtataatgcaaattagctatcctagcgtctatcagataattaaattgaaatataccatgtgggagtaatattgtccttgatttaagtaattatgaatcccacatgtttctaaccattatttatcagatgttcatgacgttggttaaagctctctgaagtacagagctcttgccctcaaaaagcaatattggagatttaacttgtatgtatttgttttttatcctttccattaaagaaattggcaacaattttaaaaattgtttttgctgcatatgaaactgtaggcaaggggcaaacttcatgagtaaggtgacccgatgcttctgctgaaaaaaaaaatacatagaaatctgctgactgagggcacttcatcattcccagaaagatataaactagcttagagaactggaatatttattgttacttatttcaagttaattttaaagtaaaataatgattattaaatttcttgtcacctgttttcagccaagcacatgtctacataattgcaggagcctgtttgtctctgggtttttgatttgctggctcagaaaacttaccagcatttaactgtttggtaagaagtattttagtttactgtgttctttttttttgtttgttttaacaaagctttaagatgcttcttataacttggaattttttcttttgtttttctagcataaatttgccaaagattttatgacttatttgtctgcacctaatgcttctgttgtaagtctttttatcattctccttgggaataaaattaaacttgaaaaaaatttactgatgatccagttacttatgtgttatcagatatctctgctgtttttttaaatgtagaatgagagatctgaagaaccattagctcatctttttatttttgttttgcgatattaacttaggtgagaatatgattaccctggaaggatgcacaggtatctagttcttgtgacaagagaataaaaaaggccataatattcacgggttgtcatacctcatgtaattctgtctcagtattaaatattgggaatttcctttttaaaaaatattagtacttagtaaggattcagttgcttttgaggcattgcttctctgatgacaagactgagagattttatttcctggtaaaagctacatggatttatgcaacactatttataatatggaaaagttagaaacatcaaaaaagtctaaaagtagttaattaaatttgattatggtttatttatatattcttacacagtggagctaccaaaatcacgttatacaagaattttttgtggctgggtgcagtggctcatgcctataatcctagcaactttgggagaccgaagcaggaggatcatttgagcccaggaggttgagatcagcctgggcaacatagggagaccccatctctacaaaaaataaaaaattagccaggtgtggtgacacacacatgtagtcccagcaacttgggaggctgaggtgggtggatcctttgaccccaggaggttgaggctgttgcatcactgcacttcagcctgggtgacagagtgagagaccctgtctccaaaaacaacaacaacaacaaaaaagaaacaacttttttttgtgagtgaagcttgcttgtaataggtcatttaaaaggttaaaaatattgtgtagagtaacatctccatttcatttggaaaaaatatgtgtaggtaaaggaaaaattcagagaaaaagccaaaacgttaacaccagttatctttgggtgtgacattccaagtgattgttatgtcttgatattcaatatttgaaattatttctgttgaacttatatttcataatcagggaaaatatttgtatttacagatttttttttttctctgagacagcgtctcgctctgtctcccaggctggagtgcagtggcgcgatctcggctcactgcgagctccgcaccccgggttcacgccattctcctgcctcagcctcccgagcagctgggaccacaggcgcccgccaccacgcccggctaactttttgtgttttttagtagagacggggtttcaccatgttagccgggatggtctcgatctcctgacctcgtgatccgcccgccttggcctcccaaagtgctgggattacaggcgtgagccacagtgcccagcccagatttttttttaagttacaaacttttgtagtcttctaatgatggctaagctagttctgataataaagaaatgtaacacaacagttatagtgatgtcatctcttcacctgacagacaggtcctcataacctagaaacttgtctgagcgtggtgctgctgtctctccccatggtcatggctggctcaggaaacctaaaggttttgcagctttgtcgcttcttacacatgaaaacgggtggtgaaatgaactatggttttcacttagcccaccacatggcccttggacttctatttttgggaggaggaaggtaagtgaatatgtatttttccaatgaaaagatctcattggtgagatctataagggtgacttacgttgatcttgaagataacatgaaaaatttaaattctgactagctcttagcttaactagcagcattattcgacttgatgggcttctttgtagtttaaccgtcaacttatggtctactcagtagaattaccatcctctctgacacactgagcatcactgtatttctcagaatagtctgtgctctgttcttcagtgcattactgcttgtgcccacctggttaaaaattttaccattctactaagctactttctcagaaaggtcacaaacaaaatcgtttaccagatcctgtgacattttcttagttttcagctttcttgatctttttccaacatgtgccattcctgactacatcctttataagactgccctggctttagatgaaccaaaaaccatgtacagaaaagtgtataaatcataggtgcacaggtcaaagagctatctaccacagaaaaatctctttgttatcatgtagatcaagattctgtatagcactttcaactcacagcacccgtctctgcttctgccatgcacccctctcaatcactattatcttcctttccccaaagatagccctatctagtcttctaacaccttacgttgattttgcctgtttttgacatttaaattgaattatacacgatgtatccttttgcactttacttttgctcaacattatgtttgtaagattcatgttgtatgtagcaatggattattcaagtttcagtgttgtattacactttcattgtatgactgtaccacattttattgatctcccccattgatggatatgcttcttgcttctagtttggggctgttatgaacagtgctgttagggaaagttgtacatgtcttcgattttgttgtatatagaactgtgtggaattgggtcataggttgtacgtgtgtattcactttcagtgaataataccatcagtgctgcagtgcacttgtaccattttacatactcatgggcaggatgtgaagttccagttgttccatatccttgtcaacccttgttattggtatagtctttttagtagtctttttagttttagccaactagtaggtatataacaggatctcattgtggctttaatttctgtatttctgaataatgttcttgagtaccattttacacttttaatagccaactgcaaaacctcttttgtgatgtccaaatctcttgctacccagtttttgtatttatctatgttaaaatttttatttgtggtaaaatacacataacgtaaaacttatcaatttttaggtatgcaattaagtagtgttaattatattcacactgccgtgcaaccaatctccagaaatttttcatcttgcaaaactgacattctatagccattgaacaactccctgtttgcccctcccaccagcctctggcagccgccattctactttctgttttgatgaggttgactgctccacattggtttagctttgtattgatttctgtggattctttaaactatgtcctaagcccttggtcagctttgtttgttgcagctatctttgccaccctagggcttgtttgccttttcactctctctcagtggtgtcttttgatgacacaattattaatgttcttcttttatagtttttacttctttgtgttgtttatgaaatattttcttacccagagaaaaggagatattctcctatcttatcttctagaagtttttagcttttccattcacatttgaatctaaaatctacctggcacggatttttctccatgtttttttcccgctgctattgaaaagtttctccttctccactactctgcagtaccacatctattatataagttaagtgcctatacacctgtgtttatttctgggctattaggttttgctggtctgtttttctgtacttgcaccaatactccattgtcttatgagtcttggtatccagttgagtaaatccttcaaactcggttttcttcttcaaaagtgtgtttttctcttggctccttgcattttcatataaatattggaatctgttccatactaaataatctgataaaatattgatcagaattgccttgattgtatgtgtctgtgttaaggagattagaatctgttacagtattgtcttccattctgtgaatatggtatacccctgtatatatttagctgtagtgtgtgtgaccttgatcaatggctacagtgtctgtgtaggctaattttcccctcttctttaaggctgagcttaccattggaactcaccttttcagaagtacaaaaagtaaagttgatcagaaaggtgtgtatttcctctcaacatgttttgtggaattgtctttctttaattgtttagaattaataatggtcaaagaaatattactatgaaaattcttatttattttattctatgatttttgaaaattttttcctttcaaaatgagcctctccgtgtctcttaatcccatctttcattgttccaaactgtatgactctcctcgctcttctttcatatcgaattgatttttctaccattctgctactgcttttctagtgatttttggtttttaaatggtcatgtatactctgtaacaacatttaaacttagcatagctacaccattatgtttctacccaaaatttctaacattagtatcttaatatttatctttgaattttggtttatcaaaagggtacaaagaaaatggcttattccatgcacatgccaaaatagatgtatctctttgcttaaattttgaaatctcttctttctaatccattaaatatataagcatatataatgaattataagtccttatttaatactccaattattttaaaagacagggaaagagatttgggtatatgtgtgtgcatgtttgtgtgtaagaaaagtatttatactcaatagttttagaagtggttttatgtgatgtcctacaccatctttatttcaaaatattttttagaaaaactctgggactttagattaatttgcctgtttgctatactaaatttgagcaacaataaagtaatttaaggaaaattttaatagaccctttaccaagagaatatttttaaagtctatgaaactttatcttaaaagtgtatcatattggtgaggaaagaatttatatttagaggaatagttgtttatacagtcattgtaactttttttttttttgagaaggagtctcgctctttcgcccaggctggagtgcagtggtgggatctcggctcactgcaagctccgcctcccgggttcacgccattctcctgcctcagccttccaagtagctgggactataggcgcccgccacggcgcccagctaattttttgtatttttagtagagatggggtttcaccgtgttagccaggatggtctcgatctcctgacctcgtgatccgcccgcctcggcctcccaaagtgctgggattacaggcgtgagccaccgcgcatggcctcgttgtaactttttaatgataacttttgccttttcatttagtcagtcattctaaaggaatcatcatgcttcacagaaacagaaaaaaactgtttaaataccaattacaacattctgtatttttaaaactcagatttataattgtatatttatatacataggcatatacataggcatatacattaataaaattggataagaaggtggcatacttggtacatgactcttcaatatttataatttctaggactgcattcatggtcttcactactctgctattttatgttaaaaccttgcttcaagggttgaaatttaacatttatgggatattactttggctttaaatagtgatgatcttgaaatggcccaaggactaaatgaaaagtggaatgttcacaccactgacactcttgtattatgagggcatcttatcagtatgccttactattataccccagtttcctgattctcaagaatgccttgaaagtatgtgcaatataatcaataacatctgtccccaccgaacttactttgcagttactctttgagcacatcaaattcttccattgccgctcttctctgtgccctttatccgcacttcccagctcacagcactgacaaccggtgagtctagtgattctgtcttcaatgtgatacttattaagttctctaaggggatcatttggttgtattttggtttcatggaattatttccaaattagcattgttttgttcttcaacttagttatattcctggctaaatcttttaagaaaattatctcacaaagtattagaccagaggataactttggacacctgatgactgaccagtcttccaccattctcagatctatagaactgctctaaacccaaaaggagatcaagtaaagttgtctttagggaaaaaatcatcaggtaaaggatagttgccaagggaagttcaggatactttttttgtgctctaattatttaattccaagagaaaagtttgtctgatttagtggcaatgtctgtatgagtttctttttttcctttcacatagatgccgagaaattgtgtataaatgacatagacgggacaagaaaagcaaaatacagcaaaaaaccagagacaatttagaagtggcagtgagcggtagaacttcaaaccatgtagaagcagttaaaagctctgtgttttagggtacgaggaaccaccaacacttaagtttccctagatatagtttgagacatagcagatctcttgcatatgggggcagagaagaaaatagcccctataagacacctgagccctgtgctcaactgaaggcatcccatgttgtctccccagagacaggtcaagagccctttattgtttatgggagaagggtcaggagcacttatcacagtaacctaagccatcattttaaactacactacaatgtataaccaacgacagaagaaagatagctgttttacaaaagtagcctaatctgaagaccacactctgatggtaggtgcagcacaagaatattgttaagttaatacacttctgacatgtggcctcatgcctgtcatttaggaaagattttttgagttgttaaagccaattattggctagggtacagtggagagccacactcacatactgctggtcatagctatttggcttagctattgtaaacgaagccattttccattggtgacaagaatctttttttttttttttcgagatagagtctcgctctgtcgcccaggctgaagtgcagtggcgtgatctcgggtcactgcaagctccgcctcccgggttcatgccattctcctgcctcagcctcccatgtagctgggactacaggcacctgccaccacgcccagctaactttttgtatattttagtagagacggggtttctccgtattagccaggatggtctccatctcctgaccttgtgatccgcctgcctcagcctcccaaagtgctgggattacaggcgtgagccactgcgcctggccggtgacaagaatctttatgtaatttgttagtgtcattttttctgatctttattgattttatttttaatagatttatagaaataaatgtatttgagtaagaagagggaagttactgtctataaagctttttaaaattgaagtctcattttatccttctttttttttttttgagacagagtctcactctgttgcccaggctggagtgtagtggtgcgatctcagctcactgcaagctccgcctcccaggttcacgccattctcctgtctcagcctcctgagtagctgggactacaggcgccagccactgcgcctggctaatttttttgtatttttagtagagacggggtttcaccgtgttagccaggatggtctcgatctcctgacctcgtgatccacccatcttggcctcccaaagtgctgggattacaggcgtgagccactgcgcctgggcgatttttttttgttttttcttctgagatggagtcttcctctgttgcccaggctgcagtgcagtggtgtgatctcagctcactgcaacctccatctcctgggttcaagtgattctcctccctcagcctcccgagtagctgggattccaggcatgtgccaccaggcctggctaacttttgtctttttagtagagatggggtttcatcatgttggccaggctcatctcgaactcctgacctcaggtgatccacctgccttggcctcccaaagtgctgggattacaggtgtgagccactgtgcccagcctatttttcttttatgagatcttaaaatatgaaaacttttttgtttttacattctaaaatagaaatcttaaagtttaaaaaactgtttgagaaccccaaagaaaaatattgccatacccacatagatgtttgatgtactgtgtttcaaggacgtgtgtatatgtatgtgcaagtatgtatgtgtagaagaactttgctgtctgagaagaattgacatcctgtcttcccccttcttccctatcaatccttaaggaaaaagaaaaaaaaatctgagaagataaaaacagatgcctatgttgagtagaaagggatttttgagagtgattgattttataagtggtcagtttgatagtaaatattttcatattatgatactttttacctccctgtaaaacctcttcactgtgaagactaaagtaaagaattattgggtcaaaggtcagttatataaaatttttaaaagataatttctccattactttttaatagaatcttatctgcctttaagatttctgttcatttgaagatattacttgagcttctgtcctgtcttagcttataggcaacagcagattgcagagctcatattgtcacagttgtttgttacccactctctgtcttttttgtgaacaggtatcatctccaggctctccggcacctctatgtgctggccgcggagcccaggcttctagtgcctgtggatgtggacacaaacacgccctgctatgccctcttagaagttacctacaaggtatctctccctatcatttacttgtaattttattaccactcatccgtctttgcaggtcataatatttcaaatgtgttgtccagtaaaaggtgataagtaatgaattgaactttcataaaaatggaagcttccaaagttattgtatatcctgccaggccattcatgctcatttatatgatctgggtatcactttttagggatcatcagctactcttttgtccttagagcttataatttgaaaatgtccctgttaactttatgtgactgacagtagtgttttgtataactgattgagttagacccattcttagatttgttagctgaaacttgaaaacccaaaattgtgtatttgatgacagctttcatttagatgcatagattacaagttttatatcctcctttcattcagcaaattattaagtaccttctgtgactcaaaaccgtgctaggctctggggtacaaaatgagatgacattgtcattttccttaaggaacttctatcccctggggagccaggcatggatacaatgggaatagagggtgataattggagatgtctgtggaatgcaggggaagcagagaagcaccctcgcttagctgttagttatggggttgaggctgtcaacagtggacagtgtttggactaggcctggcccactgagtggagctccttcccagcggagaaggcaatgtgcagaaacccagcagcattggagcacggcctttggtgctgctggcctgtgaggagcaaggcttgaagtgatgggaaggacacataccctgtgaggaatttagacatcagtcctttaagatttgagtaccagagaggattttatgccatttaaaggtctctgtatgaactgcggggatagggggaggtatagcgtggagatgtttcttctttgttgtttccactgactacctagtgaattgtggctggacttttacatttgtaaagggcactcagtggtatgaacaaaccaaagaagaattgatggctcctacccttcttccagaactccatcttttaaagcaggtaagctgggtgtgttcgggagttgggtccaaggggtcaattcaacagaatggcatagcgttaaagatagctaaataaaagcctctgctttcttcatgtattgtagcagataagaaagctgcagcaggaggaaaagtcagaaagaatagagcaagtcttttcttagagatctttattgatagcttaggtggcctcagaacatgatttacattcattttttgtctggaaatggagcttgttaccttccagatgcctctttctggctgttattgtttcctctgagaaacataggtttcagtttgtcagatgagcatatttttcagctttgggttgactatgtttacgtttatcttgacagattaaagtaaaaggcccaagatactgggaactgctcatagatttaagcaaaggaacacaacacttgaagtaagtacattaaatttctcaaatttaccttttaggaagtgaatagaagtatataagaaggtataaattatagattattatctggaatgtgactcatcaccctttaatctcattcaagactatatgtagggtatgtcttctgtaaaacagtctgtatctttgaaacaagacttgtgttagaaaatgaaagttttaatttcaaactccaaccctaaatatttatttattgagaaacttgcactgacttccttgtgacagtaatggacttatctcttggtatattaacataagatttagtttaagaaagtgtattagtccattttcacactgctataaagaactacctgagactgggtaatttctaaagaaaagggatttaattgactcacagttctgcctggctggggaggcctcaggaaacttacagtcatggcagaaggcaaaggggaagcaaggcatgtcttgtatggcagcaagagagagagagagaggtgcaacacttttaaaccatcagatctcatgagaactcactcactatcatgagaacagcatgagggaaatctgcccccatgatccaatcacccccaaccaggtccctctcctgacatgtggggattacagtttgacatgagatttgggtggggacacagagcctaaccatgtcagaaagtaaagctgatttgtacacgcacaaaagaactttattaatcagtgtttatcagaccacatcttttgttgcatctctttaccattcttttgctagaaagttctcctaaatttaagattattgtagataatatatactactcagccagtttattttgggtggaaataatcacgtgcagttattttagagtgttgatacatttatacctaaagtagcatgtcagttaagcctttaaatttcaaggaagtttaacaagcatgtaaaagtttttatagtttggtcccaatgtgaatttttccagactgtatattagctgttttctgtattgttctgtccttagatttgcagcattattttcttcttgctgcaaaccaattaatagatatttagtacctcatgtaccctaggcatagagctaggggatatagggaatacaaagaaatgttagacaaaatgttatcttcgaagctcataattgagccaatagtcaaagtgcctcctcatttaacaagttccatgaatctagacaccaaagaaaaacagaactttattctaggctttctcatagggactgatttaatcttagacacagtaaataatcatttaccttagtggaaaatggtaaaagcttcatctcctgtgaacatggtattgggaaaacactgtttccagccaagaactgccagtaataccttatattaaattcattctttttctttcaggtccatcctttccaaggatggggttttatatgttaaactccgggcgggtcagctctcctacaaagaagatccaatgggatggcaaagtttgttggctcagactgttgctaacaggaactctgaagcccgggctttcaaggtagtattattgattggtaaaaacggaaagaaataattctaaattgctggcttcctcgcccattgctataaacttcaaaggtggatctgcttcctttttcattgttgcagattgtaaagactgactgtggctctgtttgctttttatgtgataaaataaataataaaatataatgaatataaaatactgtatataataagtaatatatatataataaagtaaaatactgtaagttaatgtttacatttagcagcaaggacagtcacaccatatcttgacactgtaacaaatagtgattttattattgatcttcaaatcggtgaagatttacttaatttcatagcaaaaatagaaaacgagttttgcaagctagcaattattaactccatttaaaaaccaccatttgtttccttaatctcggtgaggataaactgatgacagattcagacttcttttattagtttgctttattatttgcacagtacttgactgccagtgcagtagtgtttgaaataaggaaatagttacgataaatgagggtaggaagcaatctcattcccttggcggggtcagcacatattttgctctatattcttgactcagataagtttccaacacaagaaatttgtcccataatcaggcattaagacttctgaatttaacttcagtttcctgtaattccatgagcaactgtgtccctgctggtgatacaaagtagagtagtctaaagtagttaggaccctaaggaataattagacggcaaaagtggggcaggcagactggatgagtggcagccagaggactgagttagcatcctttgttcttccaagtacggagacagcagtttattttaattcaactcatatttcattttagtcagttacttatgaccgagcctttataatggttcccaggattgaaatgtataaatagttcccagggttgacattggtgaattttgtttggcagtattcagtaagttgtttatgaaatacttttgaaagatttttggacacagtttaacttaaatttgtagtattgcttcttctaaaaattagagcatattccaaagactctaacccaatttgtgaagaaaatagataagtttagacttgagtttgaacgaagaaagtatataaaaattaaaagctatttctatttcctgcctactggagttcagaaataaaatataaacctcagtggaaaatagtaataccttcatatttcattttcaatcttgaaccttgagtgatactgtttttttcccaagtttaaaaagttgtggtaaaatgcacacaatttattgtcttaaccattgcaagttacagctcagtaatactaagtgcattcacattgttgcgcaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacccctcattctacttcccctagtccctggcaaccaccgttctattttatgtctctgtgattttgattatactaagtacctcatttatgtggtttcatacactgtttatctttttgtggctggcttgagtgatattcttttttccttaccttttcagtaacaattctagtttctggtaggctttttaattagtcagtgaaggagggaaaagccttttttggatgagttgtgtaaacaggaagacctgtttgttattggccttttgataaattagcagctcatgttaacttgtgcaaaagcttcttgtaacttcttagcagaacaggttgatgaggcaagtttgcatcatctgggattttttgggaatgttgggtgacaaaggggaggtagagttgttagaactgtgtgtattacagtttaagcgtaaggaaaataatcttttgttgtcttatactgttgtggttgtttgtttttttagccagaaacaatctcagcattcacttctgatccagcacttctgtcatttgctgaatatttctgcaagccaactgtgaacatgggtcaggtatatattctatggtttgccgagccccaggactagaatttgttattatttctatgcatgggtcacccaaaacatctctactatctatatctatctttgagattgatgacatgcgtcagtcacattggatgacttttgcttggcacgtatagatttgcatagcctaaaactattaaattcagcaactttctaccttgatagaagaaacaacttaaaatttataagacatcagttttgacagatgatagtttctgtcatctacaagaatgatacccatccatattctgctttatgttttcagtgtttaccacctttctcttatttttatgtaatttcattaactgtttcctctgtatattataacccttctttttattgttcatacacctgttaccttcaagattccaagggtgctgagcagatttttctttatttttttgttttttgctttttgagacagggtcggttttttctgttgcccaggctggagtgcagtgacgtgatcatggctcactgcatccttgacctcccggagtgaagccatccttccacctcagcctcctgagtagctgggactacaggcatgtagccaccatgcctggctacttttttaaaaaaattttttgtagagatggagtctcactatattgcccaggctggtcttgaacttctgggctcaaatgatcctcccaccttggactcccaaagtgctgggattataggcatgagccactgtgcctggcccagatctttgacttaatccaccatagagacaaggaaagattggatgcatatatggccttcagaaaatttctcaacctctccaaaatgtagtttcctcatttctaaaagtgattataatagaacctaccttacagtattgttttgaggattaagtgaaataaccttcccctctcttttttattgaatctttactatacatgggacactctgctaatacttaaatgtcatttaattatgaccctgagaataggtattttatcattctgggcttacagatgaggaaactgccactgagagatgtcacatgcccaagatctcacagctagtaagagctgggctgtgcactccaggtcacgggtctctaataaagcccatgcccacccttaaccccagctggacttgactctgccacctcccctaaacttgttctggtcagtgttttttttcttgcagctttgttactcggtttcctttctggatcctactcttcccagcccaacccaaggcatagctctgtgatgtcctatctactcattttgtcctagtttggtccattcctctcttctgtagcacttactatccttaactgtctcttgggacttaatttttttttttttattaatgtttaatgttacatgtgctgtggcttttttaaaagattgtagtgttacttttatgtcattcattataaaacttaagaatgggccatagtagtgctatacaatttgtttttgaattgattttggaatatactttgtgctacaaaacttctgattttctgcagaaacaggaaattctggatctcttttcttcagtactctatgaatgtgttacccaggagacctcagagatgttgcctgcatacatagcaatggatcaggtatggatccaaaaacctataccaattctggtgaaatttgtcctgtagttcaagtaactcactgaatagtgtggtaaggttcctagtgtccttccttttagtttcccatttgcttttggaaatttaagaaaggaaaccatataaaatttgaaagctctcaaaaatccaaaaagcttgggctttatgttgacaggagtgccccttggggggctgtcttcctttaagggttcccattcctcccttttgtctcccctgactaggagaggaggggagcactcccttcctctctcccatcttatttttgcctccctcctggcaatgcctctttgtagaagtctgcatgtgagccgttagtgaacagaaccctagcgatggcagtactgtgaaattagacctatgtgatgaagcttgcaagaggttacagagtccatatgcagttatctaggcattggagttcatttttaaatttctcttgttattgctattttaaaagagcctaaaggggtaatgcagaaaataatgcttaataatgttcttaaaggatcagaccaatttattcactttaggcaaattagtaatacatacaccttttcagtattatcatatctttcagacccagatttggagctaagccaagccagtagttttctaacctggcagaaatttgccttggtatcttaaaaatacagatcctttaattccatgtctcatctattgaatcagaatttctggggtgagatccagaatctagttttaaacagctctttaagtgaatatagtaagttcacagctgagcatctgagactcagtgtctaagagaaataacctttaatgataaaaataatttgctaaaaagctgaatggaaaaatatatttagccagaggataattcccccaaaccagaaaacacacagtgttaagtaacatcattaaaaaccaagttccaatataactaagtaggcccagaatgccattattgtctggaatccacccttttttggttggaaagtatggatatatggtatccacgctggcactgcttctcacagtgcctctttgtatagcagccaaataacaagttgtgttatttgctggatgagaatgttgctggctgagaatgtgtctttttactctctgaaccctcacacctttacagtcatgggtggcaggtctttatgcatgaatatcttctctggttgcagctgtagtgacttgcagatggatctcaagggcagtattattagtagtgttcttcttgccctctaccccctgggatctctgccatgtcattgtacccagcttgagtttcccagaggtgactggctatgaccttttgggtcttggttattcggagctgttgagccaagaatgagctcattcacctttgttacttttccctgcaagctcctcatgtagggccatattgaaggaggtgagccattcacctgtacccagtgacggcgcctctgtgggcagactgcatcaaaacacagaatggaccaccccccgaccctttataattcggagccacatttaaaaaatactcagtctacaactctgatgaagagacagagcactctttgattaaatagattgttgtcctctttcctcttcaaggctataagaagacttgggagaagagaaatgtctgagacttctgaactttggcagataaagttggtgttagagtttttcagctcccgaagccatcaggagcggctgcagaaccaccctaagcgggggctctttatgaactcggaattcctccctgttgtgaagtgcaccattgataataccctggaccagtggctacaaggtaatagtagcattgtagcatagcgctcttgtgcttttgagatacattcggttcaggcttttctgttgtaactttgttttttcattggtaagcaagataaatctgagtataagcaagaatggctatagatttaacgtttccagctagatgaattagactttgattatctactttagcttctttagtaaaatacatctgacccaggcagataatatttatagcattttaaataccacttggtgctcaggaccttgttctctcttccctagcatcagatcacatttcctttccagtgcctctgtctcctgtttcctaggggtgtggcctgttgccttcctgaggccagcagccatcctgtttttgtactggcaccacatgtacatgtagaagttgacgtgtgcttgctgagtgagcttgttgtaccaactcagttttgaaaacctgggaccgcacagctatgtgatgtcacagtggtggctttctatcagcaggatttgtgattgcaaggaaattgtagttactcgttaacagtgtagaagtgattctgacttacatgaggcaagcgatggggcctttagatttatggaaatgtgtctgtgtgttaaatacacctgaaactgattttcaggagtagactccttgatcttttcattctttttagttcattcaaatgctcccagtaaatatctgacagttgcttgctttgggttaatactaaccttagtaatagtagtagaaacaattcttgctttgattagtgaaaactattagtaatcaatagaccctaagcgtttgaatataattcagtttaaaactatccacctgtaacactaggaaataaatttctgaaaaaaattaaattgtaaaccaagttgtgagggatatacttggaaagcctgattgcagactctccatgtttatatttaaaagctgcattgtatttgtcatttcctgttcagattcaaagatcatataacttcataattttttggatagtcatttttatcctcatttttggggaaaaacatgttatttcaaaggttttcgtgtttcgtttttattcaatttaacatttgatcacctatggcagacctttgctattgataataaatacttccttaaatctttgcagattccctgatttgcacatttcatataatgtatggaactttggcagtgattagaacattctctaaaacagggccctgattgccttgttgctctttagcgcatttggtggtttccagcattgctgtcagcctccattgaatttgacttgccacacagatttatcaaaaatgtgtttattttttagtgaaaaactagaatttttttttaaaacaaaacctcttaaatatatagtctcctctcttacaagcactagcagttggcattggggtagagaacaataaattaactgaaaattggaaattgcattcatatttgtgtgtaaaaatcacagatgcatatgtggactttcaggatcactcactaacaactcattagatctgagataacccattgaatcactacactaatctgaaaatgcagccaatttatattatataaatgtcggttttgttttttctttttttgagacagagtctcgctctgtcaccagggtggagtgcagtggcgcgatctcagctcactgcaacctccacctcctgggttcaagcaagtgtcctgcctcagcctcctgagtagctgggattacaggtgcatgccaccacacccagctaatttttgtacttttagttgagacggggtttcaccatgttgttcagtctggtctcgaactcctgacctcatgatctacgtgccttggcctcccaaagtgctgggattacaggcgtgagccatggcgcctggcctatataaatgttttgtacagtatttatctcctcaaattataattttgggcaaagaaagcgggtttcaagtttaagaactttaaaaagttttattaactttttcatattttgttatggaaatttaaagaatatacaaagtaagtagactagtgtaataaaccacaacaccaattttaatagttgccagcattctcctatttttgcgtcatttgtaccttcacccattgccacactcaattttccaaattgtgccattttactttcccaccagcagtggattgcaatgcaatttttggcattgtcctttttttttttttttttttttaagacttgtcaagtgcagtaggaaagcaaagtaaacccaaagcaagcaaataaaagcagaaaccaatgaaaccaaaaacagataagcaatagagaaaatcagtgaaacaaaatgctggtagacatgagaaagtcattgaagagaggctgaaccaccatgctctccttcatgatgagctgttcaaagaagaatctcatctgttctcccttaacctttctccctctgctgcctcccccaaacctaaatgtttccacctcccagtagactgacatcctcacaactgtgttcagtggagtctacagttttcatctcactccatctctacaatggtgaggcttttagctacattttccttcttgaaatgagcctcccttgactttgtcatagcacactttcccaatttttaaaaaaaatcctctttaaaaattctcagtatttgtcaccatttcactgtcactcctttgttgacccttttggaagtcatccttgctcctttccctccttcccttctctgcgatagctgacccattgctgatgcctttcagtcctcatcatagatatttcttgaatttgtccacattttactatttctacctagaacagaatgatgattttgtgcctggaccactgttatagcctcctaaatagcctccttgctttttctcatctccattccaaccatctcaatttaactgacagaacagtcttttaaagaataaactgatgtaacactcctgcttaaagcttttcaatggctcctgattcagctgtgaaagaaatccctactgtgtggcaccaggacctgtgtgacctgcaaggcgcctgttttcctcaacaaagcctcttttataccacttgctccccacaccaccctggccccttccacttgctcaaaaacactgagctccttttcactgtggggccattgaatatgctgttttccctccctagaaccttttcctctcattcttcacctgcccaactcatatttatccatgcagcctcagttttaatggcatttcctcccaggccttccaagaccactctccctcaggcagctttcctgacatctttagcctgcccgctcatgctctctaccttttttctgtatcaaaatgcctttgtttgcaagtaacagaaggcctgacttaacctgcctttaaacagtaaggacacaagtatgcctatgttattagaggtctgcaggtaaggcacgtaaagggtcatctttttccagtgtcttcaactccatttctctgaggttccatcagctacattctgtgccatgactttatcctcagtgcatttttcagatggtaatcaaatggctgtaacatgttcacctctagctcagcatgatactcagaggaagaatagagttgcttctaggagttttgtgatgagaatgagggaatttctttccctggagcctccagcaagcttgtcattaagtacctcctcaggtttctggctcgagttgcatctcatgcacacctctcaatctatccctgtggcagagaatgtctcttattgaaaaaatggcctgggtttgcctgtctctgaactaacactgcatcaggagaatgggattgccttgatcacccaagatcagtgattctcaaagtgtggtttatggagcagcatgacctgggcacttgttagaaatggagtttttctggccccaccccagacctactgaataagaatctctgtgctctgtgcatggagtggggcccactcatctgtggtttaacaagccttccaggtgattctggcacatgttaaagtttgaggacccctggccaagactagtaaggatctagttctggagctgaagtcagtcccatcaaatataatatatggtggagggtagggtgcgacaaggggtatttcggggagacaaccacagtgaccactgcacctttatagcactcatcacaatttgtaattatgcatttgtttgtgtcattatttgtgtaatatctgtctcccccaacaacactctaaactctacaatgacagggactcagtctagcttgtcagagtagcctcaataccggctatagaacctgctttatatatgctgagcgttcaataagttcttgatgaaaaagtaatagaagatatttcttgtgcctctcagttctgtcatcagttggttccgttccatttgtttctctcacagtcgggggtgatatgtgtgtgcacgcctacctcagcgggcagcccttggaggaatcacagctgagcatgctggcctgcttcctcgtctaccactctgtgccagctccacagcacctgccacctataggactagaaggtaattgcatatctaagtcttatcttcagtacctctgttacctacccctttacgttctagtttctcagtagttactgcccctagtttgactttcctcttcattaatgttgcagtgtcattgttagggactgttttggagcaaaaaagaaaaaattatcaactttatatatgaataactttcatttttattcagaaaaggatggattcttcttcacagagccccaaacactgatctatactaataaactaaatattccatattattctttactaattgatttttttattaaagctatttttctttattttctaggttttcagttgggttttttagaatcacatataatcttaatttctaatattacaaagctttacaactaataaatacctaattttgtgtttgaatttttttataatagttttaaaaattaatagtattatcacctgattgtatttttcagaatacagaaacagataaaaaaaatttatccattaagctgaatactaagatatgatgaattctaagcacccaatttttctgagattctcaaaaaaaatattttctgataagggcaaagattgttccatttaatcatttaaacttgaagtttaattacattactagttttttgctgttttgcaagcctctgataaaagtttactatctagagacttctggttatggccatgatggaattgcttgtattggactcacttgccctcaaaaacaaatataaaagctaaaaaaaaaaaaaataagaaaagggaagtacaacagggagagctttatattcaccctagcttctcccccaaaggcatttgccagttcatagtacaagaagtagagtgccagcaaaaagcagcaatgctgcagggctgaggagccagaggttgggtttgtgattgcccaagagcctagaacttgaggaacacagtctcaggcaggagagaacgatagaaatcataactcagactctggatatacctttcccttgagttacttaatgatattttagccttcatatacatgggataagacttcaagagatctagcagaagccacaaggccaaaaatgtaagcaaaaatgtcagcagcagcataggactgaggagacaaagggtggaattcaacgcttgttaaagtgaagtggctctgatcagcatcccagctcctcaggtgaattaatacatggccaagccctaagcctgctctagcctaattttagatctggtctgcttcagtttcactccaagcagacttgacctacaattagcctagagcagaactaaggtgatctgtgtgctttctccccacctgacagaagaaaatgtaaccttcataggagaaagaaaacatacccagagcccccacaatttttagtctacaggattcagtgttgaatcaaaaattatgaaacataataataataaaaaaacagataatagaaacagacttatgtgtgattcagatattggagttatcatactggaacttaaaataactatgtctaatgtttccaggaaaatagaaggaatgatagggaatttcaccagaaacctggggtcaataaaaaagagttaaatggaaattctagaactgaaaaatatagtaactgaaatgaagatctcagtattggattatttgaagtgaactggaagacacttatctgctggaagacaagtagaaagtaaacaaactgaagcacagagggaagaatggttaggaaatacagagaagagtacaagagacatgtggaaaccgtgaaaaaaaaaataaacatgcatggggttggaataagagaataagaggagagaaaaaatgagttagaagcaatatttgaagagacagaagctaagaattttgaaaaatggtgttaaatattaacccacagtgaaccctaagcaggataaatacaaagaaaaccatacctagtcacattaatagtcaaactactaaaaggaaaaggaagacattttaaaagtatagacttcttttcaggccaggctggacaaacagggttgttcaatggtcaactgtattagaaccagtaaaataccacttagatagtatttgaaggtagacaggcacttttgcacattatatttaaagaatttatatatatatatatatatatatatataaaattaaacaatattagtagtttcacatgtagttataggtcactttctgaagtctagaatgggtaaattctatcaaatcatatacaggtttgagtatccttaatctgaaatctgaagtgtttgaaatcgaaaacgttttgagcaccaacatgatgctcagaggaaatgttcattacagcattttggatttgggatttttggattaagaatgctcagccgaggctgggcgcagtggctcatgcctgtaatcccagcactttgggaggccgaggccggcggatcacgaggtcaggagatcgagaccatcctggctaacacgttgaaaccccatctctactaaaaatacaaaaaaaattagctgggcgtggtggtgggcacctgtagtcccagctactcggggggctgaggcaggagaatgggtgaacccaggaggtggagtttgcagtgagccgagagagcgccactgcactccagccccggtggcaaagtgagacttcgtctccaaaaaaaaaaagaattctcagccagtaggtgtaatgcagatattccaaaatctaaaaaaatccagaatccaaaacacctctctcttcggaagcattttggaaaagggatactcaatttacattacagtgtattaaggaatttcataattttaaatattgtctttgcatagtcattttcaaagggaaaaatgcctgttttaaacatgattgtgtttctgaagcttccttgaaaggagaggtatggctgaatttatttagagatgtgaccttcccaccccatttccattttagggagcacaagctttgctgaactgctcttcaaatttaagcagctaaaaatgccagtgcgagctttgctgagattggctcctttgcttcttggaaatccacagccaatggtgatgtgaccgtgtctggcggtgaacctaccctgaaacgtgacttctgcacaaaaaacgtgaccaaacatcaaagctaaagcaatgtttataaagttttatggtataactagggggaaatgagctgcacaaacctcaatgtattttaaatctgttgctgtcatcattaacggtatatgacatataaaagcaagttaaaatttacttttgtaaataaagtttttggtttgtttccaaaactcttgatgattgctttagttttggacttagagaatagagcaggggttgctggagtgaatattgatttttaaagtctttgaactgtggtggtataggtgaagtgactaagcccaaaaatgccaagttttaaaagaagctatgtcataaagttttactttctgtggcaaaagagcgctttagcatttcctcagatgtcacagttgtcctgtctaaaataagtttgtacttctggtgacaatgccagacactcttatgatgtgatcaccttaaacaggagaaggagatttttgccctcagttgctcaacatgaagtactgtggactgaattgtgtcctcccagaattatatattgaggccctaatccctgtgtgactgtattaggcaatagggcatataggagattactaaggttaagtgaggtcatcataagggtggggccttaattcagtagaattggtggcctcctaagcagaggaagagagatttttctttctctctctgccatgtgaagacagtgaggagtcggccgtctgcaagccaagaagagcccttatcaggaacagacttggctagcaccttgatcgtggacctccagcctccaaaattgcgagaaaatacatttccgtcgttgaaaccacccagtctgtggtattttgttatggcagcccaggcagactaatacgtgaagcctgctctaaatagataaaataagaaattactacagagggctctttagaaattgtatttaaaaacaagacaatccatatttacctaagatttacagaacgtatgtctgtaaaaggagggatttctggactagatgatggtgaaaaatgttcatataaaggcacctccagcttcgagttgccaacacaggaggaagaatgctccctgctgttcagatgctgatatgtgtcctgtgcttcctggatggccagtgggatcataagctggtagaagcaagatcttcatccactgacttcatatttcttccacatcctgaactgtggtgtttgactttaaaaataaattaaagcaaatagaaatgtttccattgagattttggcaaaaacccacatgacatttgcgtctgcagagtagacttggaaggcatgcacctggaggccaagtggtattctctggactctctgtccttgcatttgcgtggctgccccgaggactcccttcttcctggatgtgaagcagaggcacggtggggctgactgagaggctgaaatgtgcttctcttcacagttacatagttttcttctaattaaaaataaattttaagtggtagattatgaaaattccatttgaatcaagattttaaaaattcaatatcaaaccagttgttactgtcttcactctccgttgtttacgattgtgtgcttttccctgaataaagaatgactggagagacattagttgtttgcacacatattaactcatacctaagggagaacagcttttagaacattgtcgatgaaagcaaatatcagctttaaaagagagaggacagaaagactgcagatggtctggaagcagcatttttaggccatctgattagctagcagggagcaaaggggaggctgggaagtcagcccttgagtaggcctgctggatcatcaaataaatcaattgcagctatttttggggcctcaaaaaatcctgagggtatggctctcaccatccagaacctgcagcctccttagagccatggctcaaagggaagtgctgcagaaaaacatttggctgttaagtgttttggcccaaaaatagcacacatcatttcctgttaaagcctgttggcccgaagtagtcacactgctctacctcatgtgcccaggactgggaggagaggcagacgctggtgaggatcttatgccagttacatcatggttcctaacttactaattccctgtgcccatcttttctacttagatagatagaaataggtatcatcgcttccatagacataattaaagaaaccatacaatttacacatacactcagagtggtggttctttccccagtagacgctgacatctgcgttcctcccttgcaggtcttctgaaggacctagcaggagactcaggttgaaaccctacagaacctcgccgtgtgccgccgagtcttccttgaataaggccattttctcaccctttgtctagtaactagctgactccacagctcatggtaaggggcatgtctcagctcagggggtctcctgacatcccagaggaagcaataaggtgggggtctttcatctctcagcctgatgatctgtgcacacccacttggtgggaggccagggtgcctgtgggcagatgggtcagagtgtgggccaggatttggagtagaagccagagcatgtgaaaatccaaaccaggaagacttcgttgcctcccgcatgcggggttgaaggcctctcttctgtggtctcccatcctcatgctgatcaaattgggggggaatgtctcactgtgtgaggatcaccccaattaagctgtgggggaggacacagaatctgatcccctctgtatccttagcgcatgctacctccagccaccaggggaaagaagcagaggtgaggtgggagaggtggccactctggacggtgtaactgggctggctgcctctcagcgcccacgagcaccccacagatatccacgctagtgtacaaaggttcccaagtggtggccttttcctgcttccaagggctgcccgggttcccccctctctgaaatagattggttgcttctcattacatcacaagctgcagaaaaaaaatttaaataaaaagcctctacagctgtgtccttaactcttacctgtggataaggatggacttgcctgcccaacatcctctatcttatgtctttgggtgaaagggaagctggaatgggcagtaggggctgcttggggcagtcaggaccttcaggcttcaggcaaggagacccactgatcagacacctgcatcaaatattggtgctgacagatcccttagatggcaccggtcctgcccctcctacagtgagatccctgtggctcagggagggaggttgactgccccaaagcacccatcacaaccctaatgaagctgactttcaaccacacttcctatactccaccctgaaccgggtccagtactgcctgcattcccagtccagcagactcttaggagaaagcagtgattaaatgtaagttaaaaggacttggcaccaggaagagtttatgaacacatttgagaagcagacatactaactcttctttacacctttggaaaagcaaaggctttgtgtaattggaatttgattaactgaattaatctatgtgttgctttcttggtcacattataacaaccaccttaatctacatttttttctcatagctaaaaagatttattcctatttcatatggtacattattatatgaaatcttaaaataagttattgattgattgaagcagagtctccctctgttgcccaggctggcatcagtgacatgaccatagctcactccagctcactgcaggctcaactttctgggttcaagcgatcctcctgcctcagcctcctgagtaaatgggactacaggtgcataccaccacacccagctaaatttttaaaatttttgtagagatgaagtattgctatggtgccgtctggtctcagactcctggcctcaggtgattctcctgccttggcctcccaaagtgctaggattacaggtatgagccactgcacccagcctaaaataaaatttttatactaaattcaataaaatatataaataactggaaagtcttaattctcagtgcttgccttgtctctgtagttaagggacctgtcacactcaggcactcttccttgtgatgctgtaggccatgtgctttaagaactcaggcacactagctcattaggggagcttaacataaggatggaggttggaagctagttggtgccactcgtgtttctttcatttgtcttacgttcgtttttgtgcatatcaagaatattttagaccaggcgtggtggctcacgcctgtaatcccagcactttggaaggccaaggtgggcggatcacctgaggtcaggagtttgggaccagcctggccaacatggcaaaaccccgtctctactaaaatatatatatatatatatatatatatatatatatatatataaattagccaggtgtggtggcacatgcctgtaatcccagctactcgggaggctaaggcaggagaatcacttgaaccagggaggcagagattgcagtgagccgagatcatgccattgcacttcagcctgggtgacagaggaagactccatctcaaaaaataagaatattgtaagtgctgcttactgtaccaattcagaaattagggcagtttcatcagctggaaatgtggataaatgtatgcaactctaaagttgaaggaagatgcgttagcaaatccatcatggttagcatccctagctgccatctgcctgccccgttggatctagagaagatgaggtcaaacctttctcactccatgttctatgcaaatttctgcaaatccacagagcagggtgtaggtgctgtctccaatgtcacttccctccaaactccctgctctgttgcactaattcatttgtggttcatctcactgtgccccatgcgtgggctgaatgtcagtcagcttggcatcttcactgcctccttttgtctctccttagcttccagctgttttccctatgtagtgtcagatgagagtcttccagtgggagatgcccatgcagggcctggaggatagaggaggaggtgaagcctttactctcctgcactggctacagcagacacagggcagatggcatactcctgactgcaggaagctaataccagctgtggcaggtgtcaccactcctgagtttctggaagtttacaggagcttctctgtcctctgcttccttcattttcctgtttggatctctgagcaaaatccatgaccccttgagggatgcaatgctcagatgtaaagtcgtccccatcctcgagtcccaccaaaaccacccactgccactcagggactaggctttgcttctagaatttctagccctctggttacctcctctgagctcccagtgctgttcacttttccattctcaaatcctcagttgttctctaaaatgccagaatttctttgcaatttcctaacccctgaacaaactcacctgggtggcaccaatctcaaagctgcagcagtgggtctcactatgctttcagtacaaccttacataagttcagagaaagcctggactgaggaaatgaaaacctgccctgctgctcatcaggctggtgattctttatccaatccactggtggtgagcccgtgggttgattccatgtctctgctattgtgaatagtgctgggatgaacacgtgagtgcacgtgtctttttgatagaacaatttattttctgttagatagatatactcagtaatgggattgctgggtcacatggcagttctcttttacgttctctgagaaatctccacactgctttccacagtggctgaactaattgacactctcaccagcagtgtgtaagtgatcccttttctctgcagccttcccagcatgtgtcattgttttacttttttaaaaaacaatagccattctaactggggtgagatggtctttcattgtggttttggtttgtatttctctgatgattagtgattagtgatattgagaatattttcgtgtttgttgactgcttgtatgtcttcttttagaagtgtctgtgcgtgtcctttgcccactttttaatggagttgttttttgcttgttgatttaagttcactgcttctttgttgtgggagggggaaggcggggatgggcgggagctacaagaaaagaggcatcccctcagacactgggttaaagaaggaagaggctctattcagctgggagcattggcagacttgcgtctcaagaaccgagctctctgaagaaagagttcctggcccttttaagggcttacaactctaaggggtccacgtgaaagggtcatgatagattaagatctatagatagcacatgtggttagagtgcggggttaatctttttcagcttttacttcctccttctcttcagagacaggagacagtaagagaaatggcctctctcctcattcccccctttgagaacctcactcactagtgggagttctcactttcatcttcactatccaggtcttcctgagagacagctgaggtcttttgatgaactaaggtggtaacggagcctcttagtgactggagaaatatgggtaatgtacaggggagtaacatgcaggttcctaatactattattattcctattataagagttttaaatcctcctagagctggaaaccattttccaaacaggaatccaggatcaagcctatgccaaacctgcacgggcacatgtgccagctttgtcatgtctctaactatcctcatgcttcggctatgcatggaccagtcagcttctgagtgtgactggagcagggcttgtcgtcttcttcagagtcactatgcaggtgttgtccgggcttggtctcgcctcccaagtctcagttggccgggagcgtccgcagacttgtgtctcaagaactgagctctcatcttttccttgaatgacctgagagactttgttaacatttgtggccttctgagctcccttctttaacccttccagaagggcttccctgtatgggtttagcctttgcataccctgtctttcatttgggtcccagtgggggtctgttcctggtaattggatcctcacatacttttgggggttttggtaatcagctggaacatgttcttccacccacttagttgctgcttggagcactctcctttcatctgtgttaaagaggtacatgagcaactggtggcaatcagctcaggtggggttgtgggtctggataatagtttggagcaaaccaattatagcttgaggcttttcagtataggatggggtattgtttttcagtataggatggggtattgtttttccaattgaggagatcgacagaggtgaagggtttgtacacaaaggcatgcctttccactatatgcccatcctcatctacccagtatactgttgctttctcatgggcatttgtatcccagttctaggcctcaaatgggctgccaagggaggggtttctcctgaggtctcacatcctgtcttttctaccctgggtggcctaggggtatgtaggccttgggaagctcaggcgcagtggcctcaggagtgggaggccttcattcttggtgaaacggggggccactggtgccatttcttgccatgaatcttctgatgttgggtcggacaggacttcaggagctgactcccctcagcgggtggagcaggattcttctttggctgtctgtccctttgctactagtactgctgctgcctgtcctcttaacgactgtggggggtctaaaaccagctgtaaccaagtgtctatgtacggaaactggtctgggtgtcctggcttaccagttaccttgtgccatacctttgaaacaaggggccagtctaggcttccttctgatggccaacctacttctaatgctggccagtctatctcacacaaagttctaagttttcctggtgtcatagtaactccatagtccccattaaatcctttcttgaaatttttcaacatagttcctagtggagtgggcttactttgcgttccacccatcttcctcctgagacaaaacaacactcacaccacaagaaggaaagtctgaaggggtcactcactcatcttgcctgtctcaaactcaagcactcattcactttcactttcctttttgcaaacaagttaagccaaatcaaaatcaatattgagatcaaagtgccaattgcaatcaagtcaagtcaaatcaaaatcaatactgagatcaaagtgctgataagggcacattgtgggtgatcaggcgacacttccactcaaatggagcgggcaaattcccaggactggtcctactgtattccagatgtccagactccaagtgccggttccttcccggtgttcagctgctgcattgatcctccatggggccctgccgtgcactgctgtgatgaggcattccaccagggcaaatgcctacccggcagtgctctcaggatctgcattgctcaagctggctggagtcccccacagggatgctccgcagggcaggccaaagctgcctaaggggctccctcaactgtccattaatcacctcacttctgggtcagggaaccaagaaatgtagcaggacaagccgcagacaaaacccctcagacaccgggttaaagaaggaagaggctttattcagccgggagcattggccgacttgtgtctcaagaactgagctctcatcttttccttgaatgacctcaaagactttgttaacatttgtggccgtctgagctcccttctttaaccaggtgtctgaggggttttgtctgcagctcgtcctgctacagtgacacttagcctcagtctcatttccagtagggtcaaactgatgacctgacatacttattttctgtgctctcagctgtgtctaaatatccctgtgaaccactataaattcatgggcaatcaagcgtggcccaaaaatatgaccagagtggcgcaaacctgcctacaatagcccttgaagctgattgaggcagtgcctagatgccctgcaagaaggctggtgacacctacccctgtctgaggcatcttcctcatgtctggtagatgctctcttcctgctcctcccccattgtccctggggctcctcaaggctctcgaggcagccactgatggccaggttctctgtgggagttggctctcctgtcagccctccttccttctctcttttgcccacattccctcctctcctgtcttcccccaaaattcaaaaactgtttttattcctgctgcatccccaatcattcatctggagactcacaggtggtcccttccccatcccctgagactccttgggagaagatagttcaggatccgagacttggtctagtacaggaatgagtgatagccaccctgagtgagtgccttcatggctctctggagttccaggcccttgaagcggagcttacacttacccagagtgcagcccatgacagtgtgaaagagcactggctgtagccaagcgttagggaccaaatgcttccaagattccagagcgttggtctagattcactgatgtcatcacatcattccacgaggaatggctctttggtttataaaaggcactcaaggaaaaggccatgagcctcacagggaagggggttagtgtcccagcccgaatgctggagtcacctgctcttaccccaacatgaccttcacgtggggcctcatcttgtgttcaatcaaatccattaatgatttcaaatgaaaatgttacattcacatagcagaaaattgagaatatgcaaaattaaaagttgattaacctctcatctatactacaaagttacaaatattgtttatttttattgccttatttgtgtttagtatcatattaaaatttaaaaatgtaagctttaatattttgagataatcatagattcacatgtgattgtaagaagtaacacagaggggctctagatacccctcatcaaaatttctccagtggtaacaacttgcataactatagttcaatatcacaataggaaattgagtttggtacaatccattgacattgttcagatttcatcagtcttatatacacttgctagtgtgtgtgcattttgttctatgcaattttatctcatgtatacacttgtgtgaccaccaccaagttacagaacagttgtattataagaatacttcctattactttttttagaacttcatcttccctaatccctggcaaccactaatctttacaaccttataattttgttatttgaacaatattgaccaggcatggtggctcacgcctctaatccgggcactttgggaggtcaaggtgggcggatcacttgagctcaggggtttgaaaccagcctgggcaacatgttgaaaccccatctctacagaaaatacaaaaattagccaggcgtggtggtgtgcacctgtagtccgagctacttgtagagccgagttgggagaatcacttgagcccaggaggtcaagcctgcaatgatctgtgtttgtactattactggtggtgaatccacgtgggtctgcagcaacctcagttcttgcctcctcagaagaaagaattcgactgaagagcataaggcagaagaagagactggggcaaattttagagcaggagtaaaagtttattaaaaagctttagagaaggaacaaaaggaaggaaagaacacttggaagaggcccaagtgggcgacttgaaggacaaaagtgcagggtttgttggggtttggtatgcaggcatacttctggggttttgtgttccttctcccctgattctttctttggggtgggctgtctgcatgcacagtggcctgctagcgcttgtgagaggagcatgtgcagtgtgctgactggagttgtatgcatgctcacctgaggcattcttcccttaccagctgaatgcccctaggaggtcatacaccagttaaactctgccatcttgcctcttagtctgcatgtgtgagcctacttgttcaactcctgagattttactgggaagctactgatcaccaggttcaggtgttttctatttatcaggaaactgcctttctctggcactggctgtaaccaattattattttagagagacagttaacaactgcttgaccatcacctggtggttgcctaacattcctggtttggggttgtgaggggctctctcctgccctgctcagacctgaccagctacctactataacagcaccactgcactccaccctgggtgacaaagcaatcctgtctcaaaacaaaaagaaaacaaaaatgaaaagcccccagtattacctaaatggaaccagccagtatataatctgggattggtgtttttcacttagcgtaattcctgatatccagccaagttgttgcatgaatcaatagttaattcatttttattgcctagtggtgctcccagtcatatgataagggcacattgactttgtaagaagctgccatactttgttctagagtggtcctgccattgtacatgcctgccagcagtgtctgagtgatccattttctccgcattgacagtgtttggtgttatcattattttctagtttaaccatataagactgtggttttaactgaagtatcttttcaataacatcacacagttggcaaataatgtttatcctttgcccatgtcttctcattattgagccataatttttaaagatattttattgggtaaacatatttacataacagtaaatgccttaattgtctttgtatattctaaatataatttctttatcatttatatggcttgcaaatattttctcccattctgtattttttttttttttttgagacggagtctcgctctgtcacccaggctggagtgcagtggtgagatctcggctcgctgtaacctctgcctccggtattcaagcaattctcctgcctcagcctcctgagtagctgggactacaggtgcatgccaccacacttggctaatttttgtattttcagtagagatggggtttcaccatgttggtcaggctggtctcaagttcctgatctcaagtgatctgcctgccttggtctcccagagtgctggtattacaggcgtgagccaccacgcctagccctgtctcttccttccttccttccttccttccttccttccttcctttcttcctttctctttctttctctttctttccttctttctccttccttcctttccttttctttctttcttcttcattctttctttctttctttctttctttctttctttctttctttctttctttctttctgtctctttctttctttgtctgtcttcttttctttctttccatctctctctccttccttccttcctttcctttcttccctccccttccctcccttcccctcctccctcccctcccctcccctctctcctcacttcccctcccctcttctcttctcttcttttttctttctctcactacattgcccaggctggagtgcaggaacctagattcaaagatacaattttagcactctgtaaccttgaactcctggcctcaagtgatcctcccacctcagcctcctgagtagctaggactataggcccatgccacaatgcccagctcaaggagtgatactttgtcttgtgcatcctctgtcttgcctttccacttagctatggcctggctagagttcttaatgagagaagtctgctataatcctttctcccaaagagcctcctttatacactacatggtcactttcttccatatacgagagaagagtaagcttgctctctcacatcatcattaccaaatctcagctgggcaattaaaggaaatacttggatatttacttatccaaatacttggacaatttccaaagtagaattatcacagttttggctttgagaaagaacttggtattattgcaggtattttgggaacacttatataatattttctattatacttcttgagaggggttggttatttagtgacatgaattaaggcattataatattaaagaatggggcatcaatttcattggtaagtttcctcttcagcagaaaagagataagaatgttcatttatgcataaaagaacttgtcaaatgctttttttttcccatcagttaatatgatcatgtaatttttcctccttagtctgttgatatggtgaattacactgattgcttttcaaattttgagtcagccttatatccctggaataacttagtcatggttaagaaaaaatatatattgctgaattttatttgttgacattttgttaaagatttttatatatatcttcatgacaaatattggtctgtaatttttaaaataccgtttttatctggttttggtatgaggttaatattagtttcataaaataaattaggaagtattccctgactttttttttgtaagagattttgtaaacttggtgtttaaacttttaaaaacatttgttagaattctcgagggaagttatctgaatctagagatttcttttatgtcagttttacaattacaaattcaatttcttaaattatctatttcatcttgagtgagttgtggcagtttgtaagtttcaaagaagtagttcatatatctaagttgacaaatttgtttgtagagttgtttatagtattcccttattatcatttaatgttttaaatatctatatcccctctttcattcatgatattgataatttgtctttgttttctttgttagatttgctagaggtttattttattaatcttttaaaataatcaactcgttgtttcattgattctctactgtgtttctggtttcaattatattagtttctgctctttactatttccttccttctttctgttttggttttcttatatttatttattttagagacaaggtttgctctgtcatccaggctggagtgcatgattatagctccctgtaaccttgaactactggactgaagcaatcctcccacctcatcctcctgagtagctaggactacaggtgcatgctgccacacctggctaatgttctttattttttgtagagatggagtcttgctatgttgcccagtctgatcccaaactcctggactcaagcagttgtcccagttctgcctcccaaatcactgggattctaggtgtgaggcaccttgcccggcctgttttggttttattttgatctttttctaatttttaaaggtggaaacttagattattgatttgagacttttcttttcttatgtaagtatttaatgctgtgaattttcctcttagcactgctttgggtacatttcacaaattttatgtgatagtttcattttcattcagttctatgtattttaaaaattttctgagaaattgagaactttctttttgacccatggattacttataattgtgttgtatagttttaaagtgtttgaagatttttcatatgtctttctgttattgatttctagtttgattccattatggtatgaaaatatactctgtatgatttcaattttaattttgttgagatttgttttatggccctggatatggtctatcttgataaatgttttgtgaacatttgaaaagataatgtgtgctgtctgatgtcactggggcaatgttctacaaatctcaattatattcttttcattgacactgtttttgtgttcttctaaatccttgctgattttctgcctagttgttcttttttattatcactttttatttctttatttggtggttttgcctagttgttctatcagttgttgagagagagtgttgaaattttcaactataatgtgatttctctctttctccttttggttctatcagtttttgctttacatattttgcagctctgttatttgatgcatgtacatttaagattgctatgtcttcctggtagattgactcttatcattatgtaatatccctttatgtctctgataatctttttgctctgaagtctgctttatctgatattaatagcaactcctgctttgttttgactgatggttacatggtaacatggtatatatttttctcatccgtgtatgttgaacttacttatattcttatatttgaagttaatttcatatggatagcatatagttgggtcatgatttttaatccactctgccagtttctgttttttaataggtctatttagacaatttacatttaatataagtatgagatattaaggctaagtctgccattttatctatctgtgcttatttgtgtgtttatctcttttttttctctgttttatcttccttgctttcctgtggattgcttgaaaatattttataattccattttgacttatagtgttttttaagtgtatttccttgtatcaattttttagtggttgctctaggtgctacatcctgtacatgtaactcaggaaagtctatttgagttgatgttttatcagttcgaataaagtgtagaaacttcatctccctttagataactttaccctatcacattgataatataattatcttaaatagtttctttctatatctcgagaagtatattagacaatgttataatttttgcatcaaccatcatagtttagaaaacttgagaagctaagtgtagcatatatttacccttattttttctctttttgtcctttcttactttctgctattagaagattctttctatcatcatttcctatccatctcaagaaatttccttagttattcttttagggtaggtctgttggcaataaatcctgtttgttttcctttatttgacaatatgttgattttccctgcattcctaaaggatatttgtgctagatatagaattaggggttgacaggtcttttctttcattacttgaaaaaaatctgtcacctctagtctctgttgtttctgatgagaaacacattgtcatttgaattgttttcctcttataggtaaaatgtcatttcaatgttttcaagatttcttcctttagtttcagaattgtgattataatgtgtcttagcacagattcttttgagtttgggatttggaatttgctcagctactcgaatctgtagctttttgtcaaatttgtcatttttcaaccattgtttctttgaatactttttaagccccatactctttctcctctttttcttggtttttgatcatgcaaatgctagaccttataaaaatagtcccatggatccctgaagctctttccccctgccttagtatatattctttttctggctcagattgggtaccttctatttttctatattcaagtccattgattcttttctctatcctcttgtttctgttcttcagccatattgctaaaatatttattttgtttattgtatttttttcaattctaaaatttctatgtggttcttttcaatatcttttttgctgagacgtttttattctttcatttgtttcaagcattttcataattgctcactgaagcttttctattttagcgagtgttctttgacattgtgttggcagaggggaaaagggcattgccttcttagtgccagatgggagtggaagtccaggttacccatttggcaccattgacacctatgctgggaaggggttccttgttactgctaggtagaggtcagagtctaagatttccatgtagctttcaccaacactactgagggggaagggcatgcttcattaatgccaggcatgaatgaaattcctggatctcatctggttttgtccaacaccattctggctggcgtgggatgggtagggtgctttgttgtagccaggagaggatgcaagtctagattctccactcagcctttgctaacaagtgtggggctggagtcacatttttttcatggtgtttggctgggggtgcttatgttgtagacagaagttttctgccttgttaggctgacttttttctggtcctttggctggggaagcttttcttggggccttttttttttttggctgtgcctgttggtatttctaggttgctgcttctctggcacccagtttgagacataagaagccaaaaagaggccaggcacaatggctcacacctgtaatcccagcactttgggaggccaaggtgggctgatcacttgaggtcaggagttcaagaccagcctggccaacatggtgaaaccccatctctactatagatacaaacattagccaggcatggtggcaggcacctgtaatctcagctatttgggaggctgaggcagaagaattgcttgaattcaggaggtggagattggagtgagctgagatcacaccactgctgtgctccagcctggatgacggagtgagtgagactctgtctaaaaaaaagaagccaatcagagaacttataaccatgtcattcatttcttatgtcctgggatccttattcagtttgtcttctttccatatttcaaagtctttcatgcttcatatataatgtccagtgtttttgcagcacttagaaggaggaatagagagaaatttatctactccatcttgtccataaccagaggttcaagagagtaattttattttgccattaaattttgagtgtctagaggccattactgttagcaaactttcttcaacagagggagtgtttaccctgaaagctgcatttatataaaaaataaggtaccaaaaaattaggaagaaaaatgcaacctgagagtatgtgataacttcatgtacacttcttttctcttttatttgttcactattatacctaaaagttatgagaatagagaataacattaataacgttctgacaatccttggaattctaagagaatataagacatccctctcttattttaagaaagcatggaatactgatcagcaaaaaaagaaacgacttgggtggatatcaagggaattattctgagtaaaaaaatctttgagggttatatgctgcatgattccatttatatagcattattgaagtgacaaatttatggaggtcgagaacagatttgtagctgccagtttagggaagagggtagggagagggatggctgtggctatgaaagaaatagcatgaggattccttgtactgtgttatctgtggtggtggtggtcatacaaatctacacataataaaactgcatagacacacacacatactggagtgcatgtaaaagtggtgaaatatcaatagacgaaaggattgtatcaatggcaattttgtggttgaggccagacactacccagagacttcagtgaccctcccctgctggtgatattgtactatatagtcctgcaagttttcaccattggggaaactgggtgaagggtgtatgggagtctctctagtgtttcttataactgtatgtgtcagtctacaatgaattcaaaagaaaaaagttttaaaaagcaaagcaaagcattttgctattttgtactttcttcctctgcagactgccctactcacttccctggtgcaaagaggaaatggacagtctaatgtggcttctgcttaatagtctcttgtgtgcatagagaacctgttttttcccaattgtgtaagagttggttgttcttttctccatgaactattgtttgggctttgagtgagtgaggggagatttggtcctattctggagttacaagagggagaatctgacttatgtaggcaccattggtttccactgctgtccttaatgcccttctgaataagccaggtgattttctctgcacagtcctgaggctacatccactgagactggctctgtacaaagatgctaaacgccagacactccccagatacctctgtgccccctcccctattgatggagagcagaagagatatgagtctttcacggaggctgacatcacatgcagactttggcctcaagtctttgtcacttgccaaggacagaagaaataccgtgaactagaaagcttttgtgagtataaggaggagaaaaaaattagccagagttgcaagatgctttatgttgtttcaagtttgttctcatctctaaaggtaaactataggacccacctgctggggcaggtagatgagataatcctgcattagtgaactgtagcatctgactttcatagagaatggttttcttagtagaaattggggcgcaaaaaaatgaatgcagttatgggaactttgcgatgagatgcaaaatatctgggtagaaagcagataaattaccctcatgtatgtattttagtataaagtggacatgattactaggtaaaatgcacagaatttctcagttttcattgatggtatgaaatgtctcacactcaaatgtcagtaagggccagaagaaaatgtaaatataaggagttagtggataaacaataatagaaagtatggggcattgtcaataaactggagatcttggattcaatatgaatgttttcaaattcaaatttttaaacattgtgatggctggataatcacatctgaccacagatggtcagcagctgcttcaatataagttgtgcttggcttttctacatcatgaacccggaaattaagcttttctgtatataacaaaagcacaaatatcaatggcgtaaacaagattaggtcacctgcttctcgttaggatgtagaaagacatgaaaactttcctcctgtggtgatgacaagaatgaaccacataagaatcgtacgttcatggggctttcaaagattggaagatgtaaggaagctctgatgaactgaattgtagagggcgcgccctctagatgagccgagaccctggagctctctggggcaagtgcctgaatgagttcaggtgggaaaagtagcagctgcctacaggcaggaggctttgcagggttaagaaggagcatcctgcgtcaggggcaacatgtggctctggaggagttccaaatgcaaatatccatctctcagcccaacaactctcttccttacctggaattttgctgggaaagtggcattggagaaggggttggtagcagggagaatacagacagccttacacatctctgtgaggcttgggttctggagccctgcagaaggtgaacctaaaggtgaatccaaactgtctgaaacagtagccactccccagcttccaaacatgaagaaaaggtaagaatcctttaattatagcaatgcaagaggctggggttgggctaccagagtttcttacattagatgtaaagtggtatgatatgaattcaagatagagattgccagactggataaaaaagcaagaccaaaccatacagtatttacaaagatacactttaaatatgacacagatacattgaaagtaaatggatggaaaaggaaaaacatggtaatgtccagactcaatgtgagagggaactcacacagaggtgtggctgattttggcattgggaggtgtgactcattggcattgggaggcatgggccattggcactgggaggtatggtccattggtactggaaggcatggcccattaggactgggagttattgaacattgggactgggaggtacggctcaatggcactgggaagcatggaccattggtgggaaccatggctcactgcactgggagatgtggaccattggctgggaggtgcagctcattgccctgggaggtgtggaccattgcacgaggaagcatggaccattgcactgggaggtgcagctcattgccctgggaggtgtggaccactgcactgggaggtgtggccactgcactgggaggtgtggactattgccctgggaggtgcggaccatagcactgggaggtgcaggttattgccctgggaggcatggatccttgaactgggatgcgtggaccattgcagtgggaggtgtgggctactgggggccatgtggcatttgagttatggcagaatgggtctgggaaagagaattctgggctaagagagtcttccgttctttcttgtttcctcctctggaaatggctacctcttcttcctcaaaggaagctgaggaatgtctgcagcaggcaggctgtgtggggacttctagaccacaaaggcctgtctctgtgacagcttaggcctggtggggtgttcatggctgtgaacaccccggagagaacatggctgtggtctttaccagccctccattcctcttcccctcatagatctgtgagagaaaaggaaaatggatgtgttccttcgttttaggtagaagggctttgaggactggagaacgcctagggagaaaggggtgatcaaaatataccgttgttccaggatgtaattataaaaaactgggctccaaatatgaattcaggaatacttggtccccgtgccaatgcagccaagcccctgcacggtgtgggagcaactcctggggttggtgggaggcctggctgatgcatgatgggtctgaaaaccgctcaggctttgccaggtatgtgtcaggcactgatggcggcgatcggaccggcctaggttggcttagcgcgccctctagtgggagaaggtctaaagagcaaaatgtgagcatccttgccacagggcagaaatgatgctgaacgtgcacgccacatcaaaggacatacgtgcttaagggacttgtgcttaacaattactgtgattagtccgttctcacgctgctctaaggacacacccgagactgggtaatttataaaggtgttttaatagactcacaattccacatggctggggagccctcacaatcatggctgaaggcgaagaagcaaaggcacgtcttatatggtgtgtgcaggggaactgccctttataaaaccatccgatctcgtgagacttattcactatcacgagaacagcacgggaaaaacccacccccatggttcaattacctcccactgggtccctcccatgacatgtggggattgtgagagcaacaattcaagatgagatttgggtggagatagagcaaaaccatatcagtcaccatcttaaattgttaatacattggaatttgtttatgtctgttgtaaaaaaggccagtcgcttagctatttcatggcggttttgaggaattaccaccataacttatgggagagtgttttggtaaatggttacataagtatgaggaattttaattttttcattagaaataatgtgtggaatttataggacaatttattaagaagcttaaatgtatgtatggtcgttgattaatctaggtccatttctctcctagagagctgtcaatagagattgagtgtgtggtaaggcttcctcctcggtgggccttttagtgataggatggtcaagtgaggaagggctgtgctcctgcggctcctaattctgaattacatttattgggccatgcagtctggtttagtgcctgagtttatgtatgggaaatgaattccatttctacatgctgggtccttatcagagcagaaaaaagaacccacgctatgcagatacataaatgtcacccacatgaacaaggcactgtcttcagtatggcatgaagggggcagtgatgaatgggcagctggagaggggagcgtgttcagatgagacaggctggtgcagacatctggggtcaaccacagcagacactaaaatgcagtggggccgtggtgagggggatggaggggatgtgggaggtgagtgggagctgagggaagaggagtggctcagaatgcagtggggggtctgcgagaggaccagagagggaggaagcctctccttgggaagagttgggggcaggtcaggagaggttccaggtagagtcagaggtggctgggctggggtggtgaaagccacccttatcctccctgtgactcttagggtcattgcactgcttttctgcttccagatgagatggagtagcagggacggcgtttatcctttcacctgacataattaacacaggacaaaatagatgaggaaaaaaacaacaaagcgaaactgttgccatcagacagcgcagagctgtggtccctgagagggagagacagacaagaggagtgctaggatttccccagagggtgtggcctggacactttccaagctgtggcccatggatgtggctgctgtcgtggtggggtccctccggggaaatcactttgtcagtgaacagcaacatccttttctgatttttctagtaccacgcattgttttctcccattgtccaacaaaggaggcaagaatgcagtgtgccgcattcctcctgcagcagcgctccggtggcgtaccttaacctcgcttttgttttttcatgtgttggctgagtcagtgagtgtgctgtggtggacctctgccatttgtagctcctcaaatcttcagcaccctcttcacagtttgatagttccccacagtgtacctcctgccttctaatgagtctccaaatattccatttcacagccatccttgtttttgaggtgcaaacatatgatttaggtccagggatcataggcacccactcaaggctttgatcccaaacagttcccatggctggggcagagtgcggtggaggggcaggggcaggggctgacagctgtggcagaggcttcctgattcagctgcctccagatggggccagagcggctgcccctcactgcattagatctatggtatggcactgggggtctctttcttcagcattcgatttggtatgttatcttttttttttctttgatcagcttttcattatctctattcacaagtcgttataatattgctatttatcagtttaatgtaacacatatgataaaaacagatgataaaaagtatcatattaacaatgagaacattattggctgggtgcagtggttcacgcctgtaatcccagcactttgggaggccgaggagggcggatcacctgaggtcaggagtttgagaccagcctgaccaacatggagaaaccctgtctctactaaaaatacaaaattagccaggtgtggtggcacatgcctgtaattccagctgctagggagggtgaaacaggagaatcgcttgaacctgggaggcggaggttgcggtgagctgagatcgcgccattgcactccagcctgggcaataagagtgaaactccgtctcaaaaaaaaaaaaaaaaaaaaagagaacattattttacacaacccatttactgaatatgcagcctcttgcaacaataacatagtggacccaactctaccctctgaatggaccacttttatgattctcctaaaaagttttgagttggatatagtttcttgttgcttctctctgtgatccgagacttaagaatgagtctctggaaacgcagcaattggaaccagacctccccaggatcaaagaggacaggagtgggagaaaggacgcaggacacgactcccaccgtctccagcgctgcgccgtatgcttgacctcagagcatgcaggcactcaatgtcaagtgtgcagccacgtctatatcctgcatctcaagtgctcacaactgtgacaattagcagatatgggagagaggaggcatatcatggaggaatgagtcagtcccaaaaattacatgaacatttctgaaatttcaataccaagggttaacttctaaagtactagtgtataaacagaagccatatagctagccatgaactgaaatgcatgtaccatacagtgaaggagctcctgtgcatacaaaaccacccacgtctcatttatctctaattttaaaataactcattcccttgctggatatgcaagtgagtggtggagaaagaggtctatctgcaaggctggcgggggttaaggatttcattgcttccaaaagacgtgagcaagagaactttattactcactgaaggggattcttccttctcagccaagatggtcccatttaaatcacttttgaatttcctttcaagcttcaattgtgcaaattctagttgtggttgaggatcgtccccaacagctttttgagttattccttggactcttcctttttctactatgttttcatgaataattctagaatccatatttatatccagcccaaggcttctttcctatagaggtgtcgttgagttgtgagcttcaaagatctgatcatactgtttaaaagcaataggcttgggagtccagatgtcagcttctcagatccattttcacagtctgatggtgtctgctagcaattatcagtgcctgacccagaagcggtctattgcacctcagcttggaggaaaaagtgaaggcacatgcagtctgggaaaaaaagagaaaggaaggaaaaggcaggcaggcaggcaggcaggcaggaaggaaggagagaaaaagaaaggtggtaggtttctatgtactgacttggatttgtgtactgtgttccccaggcaattctaatccggactgcattcccctcaatgtctctaaagctgtcacatttgtaaatgcttactgcagaattttcttttttttcttttctttctttttttttttttttttctgagacggagtctcactctgttgcccaggctggaatgcagtggtgtaatctcagctcactgcaacctccgcccgtgggttcaagtgattcttctgtctcagcctcccgagtagctgggattacaggtacctgccactgcacctggctaatttttgtatttttttaatagagacggggtttcaccatcttggccaggctggtcttgaactcatgacctcgtgatccacctgcctctgcctcctgaagtgttgggattataggcatgagccaccgcgcccggcctgaggaattttcttaaatgaatttttaagttgtttcatatcaaaaaggtcagcatcttcacctggtcctttactcatctgaaaagcatcccaaactttcttgtgctgatgaaattgagtataaactgtgtctcaaagggctgcgtcatagggatttgcatgcttctcacacagcagaaccaagtgctgaatgagagagtcctttctctgccggaaatttaaagtctgcagttgattttcagacaaaaaatcccaggctttaggattgttgtcatttccgtcatggggatcctctttctctcttttctttctttctttctttctttctttctttctttctttctttctttctttctttctttctttctttctttcctttctttctctctctctctcttttctttctctttctctctttatttctctctttctttcctttctctttctttctttctttctctctttcttttctttctctctttctctctttatttctctctctctctttctctctgtctctctctctttctgcctttcttgcctttcttgcctgcctgcctgcctgccagcttgcctgcttgcttgcttgcttgcttgcttgcttgcttgctttctttctttctttctttctttctttctttctttctttctttcttttcttttcttttcttttcttttcttttctttcgacagggtcttgttctgtcactcagcctggagtgcagtggtgtgtgatctcagctcactgcaacctcgaccttccgggctctatcgatcctctcacctcagcctcctgagtagttgggtctacagcatgtgccaccacgcctggctaattttattttttgtagagatggggtctcactatgttgcccagtctggccttgaactcctgggctcaaatgatcttcctgccttggcctcccaaagtgctgggattacaggagtgagccatcacacccagccatgaggatgtttgagatgatcctcttaataaactcaacaacagtctcatccatctctctgtcatggcccacgtcttcagctacctctctcctcctgcatgctatctttgtcctataataaatcgttcactcctgaaacctggtagaggggattctgttgtctataacccccaccagtgcatttctatctaacggttaggaaaacctccttggctgggcacagtagctctcacctataatctcagcactttggaaggccgaggcaggcagatcacctgaggccgggagttcgagacgagtctggccaacatggtgaaaccttgtctctactaaaaatacaaaaaaatttagttggctgtggtggtgtgtgtctgtagtcccagctacttgggaggctgaggcaggagaattgcttgaacctgggaggtggaggttgcagtgagccgagatcacaccattgcactccagcctgggtgacagagtgagactctgtctcaaaaaaaaaaaagaaaagaaaagaaaggaaagctcccaactaaacactcaatggcctgctcataacaggagacacaggggaggtagtccagggtgggcgagtcagccgttcagcagcatcgtgaagaagccagttccttccaccttctactcattgttgtgcggcttcttcccctttgcgatctggtgctgcattccatctctagtcttcgggcatcactacttttccctgtggtgctcaacaggccatacagggcagctctgatgttggccaagtggaactgatgtggtcaggagacacaaatccattgagaggaggcagcttctccttggaagcagaatctccctttttatatccatgagaaacagccaggagagcaggaagccaagggctttctccttttctgttgcatgccagcgccctctttggctatgagcagcaggtctctctcccttcaccactgcatttggatgagactcagaggctgcttttgctgtcatctgtttggcttacttggtaagtttctgtgatttgaggcttgtcaccacttgtagagtttttgcttgatcgtgtgttgtttgtccagctttggttaaggccgcttaaaaccctgacctttggagactttgtgtgcaggattcctatttcatcattgtcgtgttttgtcgcaaagtcaggtttgcatcttggagagctttctggtcccccttcctgagttttgtgcccagttttgtggatgagtccatcataaatcttgtggatgaaatcttccaggtgcttctggacttttctgttcttttgcttcgcctgtgtagtgagagggagaagtccaacattaaatgagccctatttttacccaacgtctctttctccctgaccactctgtgtaaaatgcaatcataactcctccttcctgaccagcacttctagtcctctttatcctattttttctttctccatagcgcttatcaccctttcctatgccatctctgcctccagatctggaatataaagtcctcagtaggaaatacctttatctcttttgttcaatgaggtattctaattgctcagaatggtacctgacacatattaggtgcccaataaatagtttgtgaataaatgagtgaataaatactcaggatttttaacaaaagccaccaaagaaaacatgcttaatttattcaggaggtggaaatcttgggtgggatgaattccttatgagacctgcgagaagcgcaggtgatagtttgtgtgtgtgttcgttgtgcatttttattgatataaaacagaagcactggaaagtgtgggaagtgcgcatgtcatgaggatgcaggcccttggctggcttgtttatttcaggggtggttaggcattgtcgccctgggtggaggggtcagcgacgagccctctgaggccatcctgtgacatcccctgggcacctcctagtgtttgtcattcccgacgccccagggccagtgtccttggccttggagatctcaggctctgctggtttccccacctccctggctgtccctttttagtcctttcccacctcctgaccagacactgaacatccttggggctggtctccttcatttcttgctatattctttttttttaaagacggaatctcgctctgtcacccaggctggagtgcagtggcatgatatcggctcactgcaacctccgcctcctgggttcaagtaagtctcctggctcagcctcccaagtaactgggactacaggcatgagccaccatgcccggcaaatttttgtattttttagtagagacagggtttcgccatattggccagggtggtctcgaactcctgatctcaagtgatcctcctggctcagcctcccaaagtgttgggattatagacgtgagccaccgcgcccggccactatattctctttctattcaatttcattcttccctgtgcctctgcttaccatggggcacccacttgcagaggatgcctgattccatgccctggctccctccttggtggcctcatgcatctcaaactcaatatacccaatgctgtgctcagaccttccagctcaaatgcgctctgtctcagacatgctgcaaccatcctcctgggagttgacacctccccaccgtatcccctcacatccagtccctcagcatgttcccttgatcctaacttctaaagtgtccttgaacctactcacttctacctcccatgtgcccaccagacccagccccaaccacttttcgctggggtaacctcagtagaatttacactggtctcccttcattctctcacgcacacgacaaaccattctgtaccctgaagctggtatggtttttgaaaagctcaaatttgattgtgtctttaatgagttcccattgctctgaggtcagtgtggcatctttcatggggaaggtcatggccagcccccttccccttctcttcctatgttccagccaccatgacctgctgtccagtggtcatgagctgagtccctcatacccaaggcttttccagatgctttttctctgctggaacactgttcttgccttgcgttgctagcaaagatccccatgttcattaagcgcctcttaaatgtgacctctccagggaagcctcctccactcccattgcccattgccctggctcagtcagaccactctgtgtcttccttgttggtgctctctcctcttgtcattaaatcgctccatgtttaatgtctgtatcctccacttgactgtatgctctacaagggcagggtctaggctggcttggatgttatgctgctgaatctacagggcgaagcataggaggtgctcaataaactgaatagattttgaatagatgttcactgagggtaatactgaggagtggggttgttctcaatccttactgtagactccaaatgccagtactgttgggcgttgcttcctctgaaacactccttgaagctctgagtctcctttggatggttttacccaactccactcgtgcctccatcccttgctgcctctccagacatttgccttccttgtcattttcaggccgtcagctacagtgactgggaatgtgtgccacttggctctcacactcgcctctcactgtcgtttttctctcacgggagtttatcatctattcttctcatttccttgcctttctctctgcagcaccgataaatcatcagtttcacctgaacttcagaaagaagccattccttaattttggcagaagcacgatggagtagaaagtgaccaagtagactgacttctgatcatgtctctattgtgacatgccttcatgagctcccattgttcttggggttaaggcctttaatatatgttacaaggttggaatcactctggggaaatggccgaaactccctgagctttgtttcctcaagaggaatgtgaggtggattggattaaattccacctacaaccatttccatctcttacatttccagaatttgtcccagaatcatagaagcaaaccttgttcagagaggccatatccagctttgcaaaataaaaaaaaaagtcactgtgctggtgagatgggcctcaatcctggtcacatttctctcttctctccagatatctatgcttcctccctctcctgcctccccagaatataaacagctccctgagggttgaggatgttccttcgtcccactcccaacctgtcacccccaacttccagatttctttaaaagtcaaagagaaaggaaattttcaggaaggagatcatgtctaagagctttttattagtctcatcttccaatttcctgtagactcaagcttctttctttctgtcgtgcggggtttaatatccagtggctgtttgacaacagcaccaggaaatggaatttccatcctgattctgcctggaaccttgggcaaagtgcccaaaccttctgcctcactctcctcctgggagtaacagtccccaccctacagccttctggggcaagcaacagagacctaatatgaaaatggaaccagagagttctgatggatgtaaagtcctcaataaatgcatgcaggtattatttgttaatttttgccataggcaggctgcagcccccaggcaaactctgagtagaaggagcctataaaaacaagcctcctgcttctctctctctctctcatttttttttttttaattttttttttagacggagtcttcctctgtcgcccaggctggagtgcagtggtgcgatctcggctcactgcaaactccgcctcccgggttcatgccattctcctgcctcagtctcctgagtagctgggactacaggcgcccgccaccatgcccgactaattttttgtatttttagtagagacggggtttcatcgtgttagccaggatggtctcgatctcctaacctcgtgatccgctctcctcagcctcccaaagtgctgggattacaggcatgagccaccacgcccagccgcctcctgcttctctcttgaagcctgggttctgctctggtgtctccccagctcattgccggttgacggcacattgggctccctgtcagtcaggttggccacgtgaggaggagtcaatgaggcactgcttcctgccaagctgaggctgcccttcttataataaggaggtgagcctgtctcagggaaggttcttttcctaaatttcaggtgggattctaaacaggacaccactgatttttttaaaaatgaacctatcaagacatgcattttcatgggtgtaatcctgtttgaagtggtcacatttggggtttttatgtacttgctcctattactggtgaaacttctgtgaatgggcttcagatcatgaacagcctcagtggtggcagagtctcatgatttcaagttaccttatagttgagaaatagccccgcagggtaggtgatggcgtactccccacttgccattctatctggaacccggaaggtggtcaatccatattcactgaaatgaaccaagaaatgagactgtggctataaggttgaggatgttcatttgcttgtgaagcttctaaacaagatcttccaaacagttaagagaacacttggatatctttatgatggtgtgtttgctttgaaaaataaacatgaaagagaaccattatgttatagctccgctttctagtgagtaccccgtcaaggcatcatatccctctgtgtagcaatggaaaggcatttaacccaatgattgaacctctctgtgcctcagtttcctcatctctaaaataataatagaacctagctcatataactgttaagggggatcaaaggaggtaaaatgttgtgacaaaagttgcataacacagtggagtgtatttcattcattcccaagtctgaacttatgtgtagaataatgccacaatctatggccctgtgtcctgaaatgcccttcctccaggcccttttggagcaagagctccaaggggctgttccctcagataataacctaggtgattggaaaccttgactagggagcacagacctggaggtcggttccagtgtgggacagttggtcatatttcccactcaccctctgccatgcaaagtgggtgaggcagtggctctggccagttcattggcaggtggcaaaaccttgtctagtctttggcattgggcatgtgataccatcgatggccagtaggtggcacaagttgtccatcactgccgccagctttgctccattgggtgctttctcagaaggggaagatctatttctaatccagtcctggctttatggcaatgcttaatcacatggaagggaacatgcaataactactggtatttctgtaaacatgcatgctaagaatcagctgccatttggaaatgaggatggagggaacactcagtgagaggtctcctgaggacaatctaaaaaaggaaaaccttgagggttttaaaattttagagccagttaacctttgtgactcatggagagaaacgtttagaacccagaaggacaatgagaatacatcctgtggattgtaacctggtccaaggtccaccttgccctctccaccttccttcagctgtgaagtttaggaaggagagacaagatccccttgcatggagtcagcttacccacttcatgacccccagcagggccgggctgcaccttctgggctgtttgcttaattttttattcttttgtcctggcaagttgcctgcttcttgggtttgtcgtttccctggaggaaagtttatttgaatctcattctacccttaataaaattggcaccagataaatacgaagcggatgaagagacacattgcagcaaaacaaaaagtggaacgtggtcaacaacagggcgatgaggactttaatacatgtgtacactttctaaataaaaaattttcattgtagtaaaatacacataacataaaatttaccatcttagccatttctaagtgtacagttcggtagtgtcaagtacgttcacactgttgggcagctaatctccaggactcttcatcttgtaaaacagaaactctctacccattacacaacagctccctgttcttctctcccccaacccctaacagccaccattctacttcctgtctctatgaacttgattactctagtgtcaaagaaaagaatcaaactctgtaagatatttgaagagatttattctgagccaaatatgagtgactgtggcccccgacacagccctcaggaggtcctgagaacatgtgcccaaggtggtcggggcgcagcttggttttatacattttagagaggcatgagacatcaatcaaatacatttaagaaatacagtggtttggttcagaaaggtgggacaactcaaaactgggtcggggggacttccagcttataggtaggttaaaaaatattctggtttacaattggctgagtttatctaaagacccgggaccaacggaaagaaatgtctgggttaagataaaggattatggagacccaagtttttattttgcagagaaagccttcaagtggtaggcttcagagggaacaggttttaaaatgtttcttatcagacttaaagtctgtgttgatgtcagtgctggagaggtatcatgaggcatgtctgacccctgctttccatcatggcctgaaacagtctctcaggttaaattttaaaagagccctggctgagaaggaagccctttcagatggttgcaggggcatggggggatgcttagaattttatttttggtttactctaggtacctcatataagtggaatcacactattttgtcttttagtgactgggatatttcagcataatgtccacaaagttcatccatgttgtagcatgtgtcagaatttccttcctgtttaagctgaataatattctattgcatgcgtgatggttaattttatgtgtcaacttgactaggttaaggggtgtccagatagctggtacaacattatctttgggtttgtccttgaggacgtttccagaagagatgagcatttgaattagtaggctgagtaaagaaggtccgccttcgccagtgggtgggcatcaacccatctgttgagggcccaagtagaataaaaaaggcagaggagggccgggcttggtggctcatgcctgtaatcccagcactttgggaggccaaggcaggcggatcacgaggtcaggagatcgagaccatcctggctaacacggtgaaaccctgtctctactaaaaatacaaaaaaaattatctgggcgtggtggcgggcgcctgtagtcccagctacttgagaggctgaggcaggagaatgacgtgaacccaggaggtggagcttgcagtgagctgagatcgcgtcactgtactccagcctgggcgacagagtaagactccgtctaaaaaaaaaaacgcagaggaggagcaaattctctctttctcttcttagctggagcatccatcttctcctgccctggggaattggagctcctggttctcgagctttctgacttggggactcatcacccttagccccgcaggttcccaggccttcagctgaacgttggtcactccaatggctcccctggttcccaggccttcagattcagcctgaacgacaccatggctttcctagttttccagcttgcagatggcatagggtgggcctctttggcccccttaattggatgagccaatgcctgtaataaatctcctcttatgtatctgtatatattctactggttttgtttttctggagaaccccgactaatagagtatgtacataccacattttgtttatccacccgttcaccaacagacactcaggctgctgccttctggccattgtgcataacactgccatgaacatggtgtaaaatgcctcttcaagaccctgcttccaactcctttgggtatatgcccagaagttgaattgcttgttcatgcagaatttatttttaattttttttgtgtggaacagccatactattttccatggtggttgcatcattttacatgtccatcaacagtgcacaagggttcccatttgtccacatccttgccaacatttgttattttctgtttttcttttttcttgatggtagccatcctaatgagtgtgagatggtgtgtggacacttcaagtttgctctttctagggctttttctggagtgggcaaggctccctgatcccttcctctgaaagtggtgttactgtaaaggtggcattttcctgctggtcatggtggcacgcgcctggaatcccagctactcgtgagactgaggtggaaggattgcttgagctgaggagtttgaggctgcagtgcactatgattgctcctggaaatagtcactgcactggagcctgggtgacatagtgagaccttgtctcaaaaccaaccaaccaaccaaccaacccacccagacatttccccttctgccctcccctcagagctctgcctagagagcctgctgagtgtgggtacttctgggttggtgtctccaccctaggaacccacttgagagtgactttatttggaacaatcttcagtcacaggaatcttctgggaagtcaccagaccattgctttgaagagtacacagcctcagaccctctggggacaggagcaaggcaggctgatttattaaccacgctgcgtcacccttttgccctagaggttagatggtcccaggagcccccctcgccaagacactcctcagagtgggggtaggagggtgggaagttctagatcctcagtctggccttcaaatattccattacattgccggggacatggcgcacccacatttatccaaaggacaggggtctccagaaatgtctgcccgcaatatcctttggttacctccaaaacattctcttgaagttgtttaactgccatacattgttgtgggccggccttttattcccagattcacttatttaaaaaaaaaaaaaaactctcgagcatctctgaagagagaggttatatggcagatgcaagtcagcagaaggcagagagctgagaatggtggggagagagacacagggctcacggtgtgacaagcttcttggtgagtggtcaagtgcgtaatggccaggtaggcggctggtgggatgtgctcaggcagaccagcgtctgagtcccaggctggtcactaatttgctctgcgtccttgggcaagctccttcctttctctgtgcctcagcttcctcatatactaaatgagggtagtgagagctagctcagagctgttgggaggtttaaatgagtggatgatgtaaatacaagtgtcaggaatagtgtaggtgctctttagtgttcacccactgctgtggtttgagtgtgtccaaagttcgtgtgttggaaacctaattcacaacaccaacagtgtttggatgggggaccttcaggaggtgattaggtcatgagggctctgccatcatcaatggattaatagtgttaccttaggagtgggttaatcattgagggagtggtttcttgattaatggataagttcagtcccctttctctattgctccctcctgctcttttgtccttctaccttcccccatgggatgacacagcaagaaagtccttgccagatgcagtctccttgaccttggacttcccagccttcagagctgtaagaaataattttttttgttttctttttaaaataaaccacctgtatgtggtattctgttacaggctaagatactttctttctccactagccacttgctcagtacaagttgagagaagagtgttgtgaagcccaagtttaggcagagaggagcaggttagggcaagtgagcaggcagggtttgtctctcacccacctgcatttagccaacagctaccagtggcagccactgggctggtggacatgttccctgccacggagagaggggagtggtccagctgcaaggctctagttctgggatctagtcttggtgacggaggatcctggaaccatctaacctctggggcaagagggtgacgccatgtggttaataaatcagcctgccttgctcctgtccccagagggtctgaggctgtctactcttcaaagcaatggtctggtgacatcccagaagattcctgtgactgaatattattccaaataaagtcactccctggcaaagggataagtccctacccaggagctgcccaaatttttttttgaaacggagtctcactctgtcacccaggctgcagtgcagtggtgcgatcttggctcactgcaacctctgcttcccaggttcaagtgattctcctgcttcagcctcccaagtagctgggactataggtgcccgccaccacacccagctaatttttgtatttttagtagagatggggtttccccatgttggccaggctggtctggaactcctgacctcaggtgatgtgcccacctcggcctcccaaagtcctgggattacaggcgtgagccactgtgcccgacctcctgcccagatttctattttattcttgcactcagctaacagcctggctgcccagaggcaggtacaacttattcaagagcaggagaattccaattttattatttaaaaaatcacataattaactgagtattacaagctttgagatgtttgttggttaataaagatgaatgggctatttgaggtaatggcttttaattaaatggaagctaataactttggtaagtttgtccgagtagtaatcttggctaacagtttgaagtttcgtacaataatcttggctaacaatttgtagcttgccttgcactgatttcatagcattcattgtttacaacacgcagaacacccactttacagatgggaaaacggaggctgaggctaagggcacaggaaggctgtggggggattgcagtccacagcagccccgggggtctcaagggcatattccttttaatcatggcttcccacacaacatgcatccctaattctgttcacctgacccctgactaaagctcagctttagggcaggagatttaaaatacaaactcattatatctgcaggtgtgggctgcagggagggcttggagatgtagaatcctcctttgctgccatgtagagagaggaaagactgcatgcaggcccagctctgctactcacggcctatacaaccctgcacactttatcccagagcttaaatcttttcccttcttgcagctcttcttctgttaagggacctagagcaggacataatcatctgttcttcttatggaggggctaaggaacaagaaaaatggtaaggagcaaaaaatggggccaggtcatttgacaaggaaccctgggaaatgcaaaagttgtatattctttgctgagttggagcattagtgacctttctctcttttcttgtgaatttacaggagttgcaaaggcccagcacctccctgtggcttttaaaaccaggtatgtgggcaatgctcagcagagactgaggaccatggccggggtgccctgcagccctttcatgccgggcagctgcagcctttaatttgggggctattgtggtattgttggtattattcagggtttgggcttcaagagaacctgtgatgatttctttgttatttcacagaaattggtctgaacggttggcatgtaatgcggtggcactggttctcctgtgtttgcccaaaaccttgccaggagaaccaggcagtggacgggtgtgtggtcagtgtggtgacctgcaaacaccactgtccacacctcatgctcttgctcaagaattttcccaggctccgtgcatgtgtaaatttgcaaaaataacaaagccaaccttcattgtttgttctctaaataagaagaagcttcgtggtttgtgttcgagtgaaacagcaagggagaattttgatcctgtggaatctggccagaccttacagggttgaggggtctctgcactcacatttgccgtgttcctgtccctctgcctctcacctttgaatgcctccctggggcagatgctcccggctcctactcctcggatcctttgtgtaatttctcacaaatttctagagctcacatggaccttcctttcatagtccaggaacacacagggttgatcctcgaggcctgtgcctctctccgggcacccgtaacaccctgctccatgtttgcttcaccttggagtaatcaccttgcactcaccccattgtctttgggggcttatgttttgtgggtgatagagtgcatcatctatgaggtaaaatcttttatgtgtgtttgcttattccgggatgcactggtggccaggctgtgctcattctggctcactgagggtgtgttatcatcctgccatggaccaccctcttctagaaggaacagaacatcagggtctccctcccagccccctgttccaggtaaccacagcgtactgcaggaacaaaggtgtagactgaaagtaagttaaaggacagggctgaggcctatagactgatttttcggagtaaggaggtgggcccttttgaaaatattgagatataatttatataagataaaatttacggctgggctaggtggctcacacctgtatttctagcactttgggaggtcgaggtgggtggatcacctgaggtcgggagtttgagaccagccccacacaaaaccctgtctctattaaaaatacaaaaattagccgggcgtggtggcacgtgcctgtaatcccagctacttgggaggctgaggcaggagaattgcttgaagccgggaggcagaggttgcagtgagccgagatagcgccattgcactccagcctgggtgacaagtgcgagcgaaactgcgtctccaaaaaaaaaaaaaaaaaaaaaaaaaagataaaatttacctattttaagtgcacacaatgaattttggtaactgtatgcatttgtataaccacccgacaatgagatacagaacacttcatcacccccaatagttccctcaagcctctttgcagtttctcccctccctttggcctcagcaaccagtctgtgagtctagttttgcctttctagtctttcatgttaatggaatcaagaagtgtgtactcttttatgtctggcttcttgcattcagcatattttggagccttgtccgtgtcactgtgtgatttctctttattactgagtagtaatgcattgtacagaggtagcacaatttggtttttcatttaccagttggtgaatattcgagttgtttccagttttgggcaattaggaataaagttgctataaacattaatgtacaggactttgtggggagttctattttcatttctctttggttcatattcaggagtgggtttgctaggtcacaggatagacatatgttaaaactttgtaagatactgcaaaactgttttccaaggtggctataccatttgtattcaaaatcaacacttttagcctagagcatataactggccttcctgaaatccatggatatctatctgtgcaatggttttagagacattttattgcctcccacatgtaattaagttacttggcttttaggcaaaagatgataccatgtctatggatgagatgactctagttttgaactctgggttttgcagaagagtttgcattatcctcctcctgaggaaagcagatacatccgccacgatgcatgtgagtcaggtcttctgcgtgtcctctgaatcaggttcgcatgtgtgcctctaatggcagtttcgagttcatcctgtgttgagataatgcctgaaggcgagaggaaaaaatatctgtggttgtcaaatcgggtggaaagtgattaatcatggagacatttacggcatgctgaactgtttcgtttcctgacctttgtcccacgtgcgttaggggcaggcggggtcaagtttaaatccaagatgacaagtgtctgaggctaaggaaggtttctgctgaatacttggcttagagtcaatggctccatgtttcacacctggtgaaaaccgactcgcaattgaaagaaacagcatgggagtgtcaaacacttgctgacttggccttgggctagagcttcttgcgagggttttagaactgacacaccctttggatgtgctgggggcatctggtttttggtgcctgagtcacaaatcctggaatacatttgcccacagtgtttccataccattggaagtgcattatggctgcttctcttagagtcctttaacctcttcctcaagagccagctttgtcaacttgatgtatctcatggcaggcatggactcatgcctgtgtgtcccattgtatccccagatcatgggatttgtgggattcagccagtgtcatttactaatcactaggtccagggccaagtttaggtgaggttcactccatctaagctgtgttttgggggagggagggtctctattttttcatttagagaagtgactagacactagaaaatgtcacagagtaaacgtatggactacagcttgttttctgaaaaggtttagggatcccgtgttagtattgaaagaccctttgaggcctcatcccctccacccagtgggcacacaggcctctgaccttcagcgccaagtctcccttgaggtcagcttctcttcatctttcacttcttttctcttcctttcacccctgctggttgcagcgacaaggtccctgccaactgcggtgtgcacactggcgggccttcacctcccttaaaatccagctctcgaaatgtctgcaagggagcagcctgcaatattacctaatttgtctttaatctggtattcctagaataatccagagaatagagtggcctactgtacacactggattactcaataaagaacatgatgggaaacggcagtatttttctgttttaaaataagtaggtttggagggagctgggaaactgcgggctttagttacaaaatgactataattgtgggagacgtattttctttgaatgttgaaacacattggacaggatatacaatttagaaataatttacagttagagaaaggccctttcatctgagagggggcacatcttctgattggaaaggatggtcccaggggatgagggatcgggccccaggtgagcttcatctttttctcttccaacttcagtgtggccaaacagagcggaaagtcatcacgtagaaggacaaagtctgtgtttttttgtttttgtttttgttttctctcatgagagaagcaggcaagtgctgcctgagaaggtgaaggctcacctgtggcaggcttgcttcaagctggctgcagactgaaggccacccagaggctttggtcaccaagggtggcatgatgggtggccttctccttgctcatgcagctctcaccagcaaatttctactgaatgcccactctgtgcagggtactgtgccaagcacgagggatgccaggacccggaagaaagaactctgttagagaaccacagctgatagctgccagtcagcagtaaaggttcaaagcttggcctggccaaggagctatcacggagggctctgtggaccagggtcttgtagtgggagtgtgtcagcagagtggaggggttggaggagtgagcccaggtatgcaggggtatggatgggccgagagccttgggcctggcctggctgaaggctgtcctgttgaggcactggcaagtgggcttgggaggcagacggatgaccagacacggccccacagagatcagcccaaagcgcttggacccagggcatctgggatggttcttgaggtgagcgcatgaagccttgttttagacacatacactagaggactccagcctccctgcaagccctcctcctctctctctcctcactgttgaggcgagtgctgtgtctgccttagattccttctgcaggcttctgtctgcctgccagcagatgcctctatgtctgtcagccctcagaatgtcaggcacatgcactacccactgtgtgtgtggggtgtgtgtgtgtgtgaacatgtcagatacccacacaggctctccactgttcagtgtgtctccagtctgggacctgggggtggaaatagtcaccgtctacatccatcttcttctgcttctctcttaggcatttccaattcaacatacaccagcctgaactctttatccacatccctttccagcatgctcttcctccagcccctactgaccccatcacaggaaaaagccattctgttcttccagttactcagggcgacagcctcggagtcatcatcgatgtctttttcctctcacacctgacacctgacctgtggccatcctgttgactctccccttgaaatacatccagaatccagccccttgtccccactccagcactcacagtcacattgcacctggtctggaccccagcaagtgctgccctgtgggactccctgcttctccccttgctccacactgtctattctctgtagcctttaagaacaactcaggtcatttcactgtcctgctcaaaaccatcaaatcgtttcccgtttccttcagaatgacattcacagtcctttccgtcacagctctgcgtggcctgtggtgcctctgtatcctcatctctgacttagtttactccaccccattctcctccttcaccagactcccaggcactccttcacgagcagcatgcacctgccccagagccttggcaccagctgctttccctacccagaacactctccttcccacatcttcacagccagctgtttcattccctccaagtcccttatcagagaggctttttcagtcactttgagtaaaacagaaacctaccttttcatcattcttgaccccttaactaaacttgcttgagtttttgttgttgttgtttgctcgttttttacttattaccacttgacatcacttttgtgggaatccccttgcttttatggaaatatgtaagagtaaagaacttcatcttattttccgattatccccaggtcctagaacagtgctggcatttggaagctgttcagtatttgctgaataaatgaaatgaattatgctgtgattcactgtgtgtttggaggtgtttggagggactggcatgggaggattggattctacggtggtaatagtgacatggcatgatgaaggcatggagtagaggggcggccacagaaatgcaaaggaaggatgactgagggagaggcctctagctcggttgttgcaggacagggatgcttgactggcagtgccttggatgactcgttataagagctgtactccagactcaggatatgctttaaccataggttttcagatttctcctggggtccagtcaactcccatgccagtcccttgttccatgatcccaggccctgctccaattccttaactcttattctgtaaccgtaacccaaatggctaagcctgaggttgcaggctgacctttagagaaaaagttgaactttctctttaaagctaagtgggaaaaaaacaatgacggataaaatgtaaagatgtacaaaggtaccagtttgtacctgggtgtttgaatttctttacattttgctgtcagttgtacatggccatttgaaatgagtaatttaatattctgctgatttttaaatacatagatcattttcatggcactacatagtaaatctgtgctttgcttgtctgctatctgtgtgtttaggttcacaccagttctggtcgtgaagctatagctcaggcattatcatggacttcctagaagctgccttgccagcaaggagcctaagaggtgttcagaaaaattatccaaaacttggaaataaggaaagaggatgactctatgtcctttaaagtccagatcagagcattgtctattagatccactcaaggattatttaaatctcaaggagaatgtaactttgcttcacatactgtttactagtaactggctgcctgtcaacttgtgggagataagctggatacaattttgtccagtacagatgcaaatgattcccttcccttcccttcccttcccttcccttcccttcccttcccttcccttcccttcccttcccttcccttcccttccctcccctcccctcccctcccctccccttcccctccctccctccctcattctctctttcttttcttttctctctttctttctttctttcttctttctttctttccttccttccttccttccttccttctttctttctttctttctttctttctttctttctttctttcttctttctttctttccttcctttctttctttctttctttctttctttctttctttctttctttctttctttctttcttctttccttccttccttccttccttccttctttctttctttctttctttctttctttctttctttctttctttctttctgtctttctttctgtctgtctgtctctctgtctctctctctctctctctcattctgtctctgtctcattctgtctctgtctctctctctctctcattctgtcacccaggctagagtgcagtggcatgatctcagctcattgcaacctctgccttccgggttcaagtgattctcctgcctcagcctcccaagtagctgggaccactggtgtgcaccaccacgcctggctaatttttgtatttttagtagaggtggggttctgttatgttgcccaggttggtcttgaattcctgagttcaagcaatccacccactttggcctcccaaagtgctgggattatagacatgagccaccgcatccagccagctcttttatgtttaaatcggccaagcgtgatcgatttccttcaggttcaaaagattacccaaacattacagttgtattgtgccatagaacattaaccagttttgtatgtaacttagcaaacttttttcagcattctttctgacatacgatacatctgtgttcctcaaatgctttgagaatcagcttttccatcctatgggttccctcagtaatgagttaaagaattgtgcttgctacctgtatgagggtatgagagccaagttcctaatattttgaaaatgatgttttgatggaggagataaaaagtctcctgtgttagctatataaacccaaacctacaaaatgatgtcaagtaccatagaatgtatacaaaagacataacctactcctcccaccaatttctattttattagcatgcatttctcaggaaagactgttcaaaaggtaaggagagaataccattctaccattctgccaattcaagttagaccagctatttctctttgcttattcacttcctgttttctcttaataaatttatttaaagacaatttattagagaaaaagttgtcttacaaatgcgaattgtaagttgtcttactgatgtgatccagcaatccgtcctggccggcaccctgccaggtctgtaattaagactgggggtttgctctgcaaggacacattctccacctttgtctggggggctctgtactcagtcttgcggtttgtctgtggagctgaggtgctggttgggaatcaggagacgtcagttccggtctcagcaaagctgctgcgaggtgcggggcagaggcctggtttacctggtataccacatgcccttgacttccctgtggtaggtgcccctgattccgctccagctcttgctttgcatgtaatttacactgaggttgcaaacaactgcttattcctgtgggacttagttttttccttagggccaatctgaaaaacttacctccttagttacatcctacggatttgcagacaaataggggaaagaaatggaagaaataagggaaaatgttatccaaagttggaaataatagaagattactctatgtgctttcgatgtcatactagaagaagccgctttaagtagcaccattattctgaatggagaaatctgtggttgctttagtcatggagactacatcacaactagggttttccttttatttttgagatgtgtgtgatgggggaggataggggtacagcattctagaaatggcctcattttgcatttccttaggtccaaagttaaaataactttctgttctaagaagctttaaaagtggttcatggaccaggcacggtggctcacgcctgtaatcccagcactttgggaggctgaggtgggcgtatcacctgaggtccagagattgagaccatcctggccaacatggtgaaaccccatctctactaaaaatacaaaaaaatttgctgggcatggtggcgtgtgcctgtagtccctgctacttgggaggctgaggcaggagaattgtttcaacccaggaggcagaggttgtagtgagccaagatcctgccacttcactccagcctggtgacagaactagactcagtctcaaaataaagtggttcatttctttctaaaatcattaattgaacattaaaaaacattggtaagaaaaattgaaccaagaaggttttgggttatactgtaggtcagtgagctttaagtttctgtgtctctgaagctacatggctggacgatagctgaagtcagtgccccgagtgaagcctgaagaggagctgatggatttttctggtggggaaggcctgtgactgcactcagagagagctgggccaggcggggtgaggcacggtcactctgagttcacagacccactctgatccttgaatgggtctgtcctgaaataatggggaatcctggaacatgctgctttgtgtagacgcctttctcctttgcaacttttaaaggtatttgtcccctgggtttcatttgaaatgcttttttcttcttcttcttttttttttttgccagatgctttcactaggagcagtatccagaaagctatgtttctaacctaccttgttgtttgcctcttgggcaaatgggtttgtttaccttattgactcagttcagtggaaaatattaccctgattgggatggagatggggctgctgttctgaaataactacgcaagtttacctgttcaggtgggacacagcttcttgtgttagtcacggatgaattttgaaaatttatacatagtgcaataaatgctggtttctttccccttcctcactccttcctggggcctatatgtgtgtatctctaacacacatacacacacacgcaggcacacacacactcatacacatgcacactcacacacaagaggatacgttgcatatacagctcaatgctacaaagaagcccttttaccagaagagcacacgggaactccgctgaagtttgacagggtgattgtcttgtggctactctaccctgaggccagagcacagtgagggcctccctcctgcccccagccacaccaaagagggggcaggggttcacagggagcaaaagaggagctttttgccatcaccatgagacggtgaccacaggggcctggctcgaaggtgagggtggggctggtgactggtgcctgtggattccagagtggttggcctacacagcctactgagaggtagagcacggtcctttgcgtccctgtggactccgagtgcctgccatggtttggaaggtccactgaaggctgagtgctcagcggcgttgccagccagctggatgcatgtaaacagcattgtgaatggagaacattctttcaccttattcttgcacattcttctcccctacttagcttcttatccttcctatctactcatctagctagcaatccctaaaattaaatcatttataaatgagtccgatgagggtctttttttgaaaactggatttagtgaataaggcagacccctgtttttggatagggctttgcctcttgttattaaggaggaataacttgttcccaacttggttggtgaccccagctgaggaggaacaagtggcagatgagtcccagggaagacccctagggggaatggctggaggtagctgtatcagggatgaaaagggtgggggtggtgatgaggggaacgcagcccttcatgcaaagaagtgggtgtttgaaatcagtgggtgactatttttttggcaatgtgggctccttaggtcatacacagtggccttagaaagccagccctgcctctcttccctcaactgatggtggatttgtgtaatgagatcaccgtcttcttgaaaaacacttccagggtagctcattacaaagcctcgcacagtgttcggagcagggcgagctgcaaggccccgggctttccattctgaaagagctgtgggtgtcggggtggctgccagctgtgagagctccgtgggtggggactctgtccctcaaagccacgcactcaggcttgcccattctagtgtctctgtgggagacaatcaatgtaatttactctattaatggaatgaaggattacaataataaaatctttttcaaggaatgcaaaaaagcatttatcaaaattcaatatccattcatggtaaaaactctcagcaaactaggaacagtaggaaacttccttaaaataataaaggcatttacaaaattcctgcaggttgcatcatgcttaatggtgaaagcctgaactatctcctaaacccatttactcctcctcagggaagacttccctgaccccatgtttaagtcaaacactcattatacattcccttaggaccagcctctcatccaaagaagtgatcataaatgcaatttaaaatgtatttgtggttgggcgcggtggctcatgcctgtaacccagcactttgggaggccgaggcaggtggatttcttgaggtcaggagttcaagaccagcctggacaacatggtgaaaccccatctctactaaaaatacaaaaatcagttgggtatagtggtgcgtgcctgtaatctcagctacctgggaggccaaggtggaaggatcacttgagtctgggaggtggaggctgcagttagccaagatcgtcccactgcactccagcctgggtgacagagtgagacttcgtctaaaaaaaaaaattatttctgccactatttgcttaatgtttgttttctggtgtaggcattcagctctgtgaataaaagcattctgctgatttctgctgccctgtatccagacggaaggaatgggtgagtgaatgacaggcacctgttctgtttacagtcagtaaagtaaacacaacactacacgtatgaactccaccggaaagatgaacacttatggtatatttggtgccactgtcccagggagagtagaagtacagggttttgttcttctgacttgagaaatttttgtgctagaagggccactgagggtcatccaggcctatcactgcccaccccaaatttataggtgaggtcactagggcctgagatctgaagcatgcatgacatcccgaatgaactacaaatcctaggtcagagttaacagtagtggtaactgcacaggatgagttggtgcagggtgacaagctcatgcgtggtagctattttgaatcaataccccgtaactaacctctgctgtttgaaacacctggcagagtgctgcaactcacccttgggcaaagccccactctctgaggctgtggtggggttcagggaatactaccccaaaatatggcagattggcattggagaaaacggcagaagcaggaaggcctctctcaccttctccttgcccttcttttcctgaagcaggccatgaaaccaagctgactttctcctggagcaaggcataaggtccttgtgtgagaggtgcccactctttacctggaggggaggaacatctttatctctgaagacacagggacgcagaagaaaagctgaacaaacaggccttgctgagttcccccttgtatataactaattagatcatactccctttgtccaatcacacttctccactactgtcgacttctccatcaaacttacaataaaaacacacaggtgtccctattccctatttctttatctttttctttctttctttctttctttttttttttttaagatggagtcttgttctgtcacccaggctggagtgcaatggcgtgatcttggctcgctgcaacctctgccttctgggctccagcaattctcccaccatagcctcccgagtagctgggattacaggtgcccgccatcatacccggctaatttttaaatttttgtagagacggtgtttcaccatgttggccaggctggtctcaaattcctgacctcacgtgatccacctgcctcagtctcctaaagtgctgggattgcatgcatgagccactgtgcccagcctctttggatcttttttcctgaggtgtcttatgttacataaaatttaaattaaataagtttgatgtttctcttgttaatctgtattttgccataggtgcctcagctatgaccctcgtaatgggtgaggaaaaaacacattttcttccctgcagctgcttggccacctgccttttgcttggattggcagaaatctggcttaatctggcttctccagtcctccatcacctggccaggaggtagcccttggtctaaccccttctcatgtttggaagcagactttccctttctttctaaggactggtaggcagctcctcatggatggagtgataactccagaatgtcttcgtgtgatggctgttggagtgggaagtgggctgggaggctgtgctggcatagactttgtgtaggattgagaagacaataactgccagtgtgaagatcaggcgggagttgggaagacagctgagagtggccaaggggaagccagagcctcttcaagtcatctctagatgggtgtgaaagggagagaagaggccaagaaaccatgagattaaaaggtggaggtgggggcatagagatcccagctgctctaggggaccctcccaggcaagtgctgtgtgtgtatgctcctccactgttccttctgcaatgcattccatctggctgctagatacggtaaagggaatgaaaggtgggaaaggcaaagggtgcatttaatccactcttcagctgtgaattctctagaggagagctagtccttgtgtttgttgatgcagctgcctctctcctgagacctgtaaaatgacttttttttttaaaggtaaaatcatgactcttacacaaatgtaaaatgaacacatgtcaaagattttatttagttcattaattaatgagggaaccagtaagatgctacaaccagcccaaaggagaattaaaaatgccacgcatagctaggacaataggaatgctgacatagaatttacaaatagatgcaaaattgatgatagccactggacagtctgtccacatgtccatggacaaggatagttggcattccatgggtcttttacaacttgcaaaccgaggaaagtttaggtcctcctttttccttgctgacctttcatgggtcagccctcatctggacatcaacactcctgagacatgtggtcactgcaataattgactgaaatcagtaaagacacaatttctccctctgctgctccgtgttcctgtctagagagttgttttcctctccaagtaaaagttgttaaagagcttaaagacaatgaagggcagagagagccaggatgtgaagacttttctgctgtactgtctttcacagatccatgttgcagctgggagcacggggaaacctggacacgcacttcaccaaaatgagacaactgtggcaggagacaggctaaggcgagtggggacaaatcaatgtgctggatgccctggtgtacctgtgacgaagaagcaggagctgggaagagagaggaaaaggaaatagacaagtgaataaataaataagagttcagaaaccccgtctccaccaaaaatacaagaaattaggtgggcatggtgctggcgcctgtagtcccagctattcgggaggctgaggcaggagaatgacgtgaacccaggaggtggagcttgcagtgagccgagattgtgccactgcactccagcctgggtgacagagcaagactccatctcaaaaaaaagagttcaaaggaagtgtagaagagttgagagaagaactctatttgcacattcactcttcagttcatttcctcattcattttctgaacagtgaatctggctctgtgctggatcctggagcataaagactaaattagctgcacaaagaccctgatcactaacatcctagtgggaaagacacactgtgtattaagctgagtaatcaccaccttcccaccatgtctgtatcctgatccctggaacatgtgaatattatcgtatatggcaaaatggactttgtagatgtgattaagttcaggatcttgagttggagagattactctgcattggcctaatgtaatcacaggggttttcataaggaggaggcaggtgatcagcataggagaaggcaatgtgattatggaagtaaatgtgggagtgatgcagctacaaactgaggaaagctggcagctctggaaactggaagaggcaagggacagattctctgctggagccttccaaaggagccaaccctctgacaccttgctttcagccttgaaagacacattttggacttctgaccaccaggactgtaagagaatagatttgtgttgtttgaagccactgagtttgtggtaattgctataggagtcataggaaactaacatatatgctgaacaattgcatggtcgcatgattgcaatgtagagtgttttgaggaaggaaattaaggcagctggggagctgatgacaggtgtcctggaggaggaggtttcctgtggagagctgagggctttgaaggaggccacccatggtggtggattggggacgtggcagtttcaaagcatacaccatgtgaaggaaggaccctgcagaagtcccaaatcaatgttttcttgcttatccctggtggatgatggaggctggtggcaggggcattaatgtgtggccatggtggtctgtgtgatacggtgaaaatgcaaaggagatgaactcccaagacttttgggagacatttataggaagatgggtgctaaataaatccaaggcagtcttttcagacagagggcttgataccactaattaggcagcttggatgagtggcaccatggaactggctggtggttttcttgtgaaaatagacacaaactcccttctctccatgttcttagaagatgtgaatttagaggtctccacattgcctgacaaagtctgttttaactgggtaaaataaaaaaaaaattaccattgtattgctcctgaaccttgcttaaaattccctttaaagatctacaaagggttttgctcatttgtacaatcttaaaggtcacaaaattagaagcttagcagccacatgccaactgcacacagcatttgaaatctttgacacagaccgttccagaagtcacaactggcaaagctgcacttcttgtgacactcagtagcctgcacacccatctcctggcttgtaagcatatgcctttttgtccagccagctgaggtacttggttcctgattgttttcttgtttgttttttaatgctcagatattctcatgtggtgaatatttgtgagccaaattacttggcaggagcgtttgatgccatggccaaatggggagcccagagtcagcatctttttaaagctaactcttacttgccagctcctctttctgcccacatactcgccccgtaccaggcccagtggctgttgcacagacaaacaccaagcagtcctgcaaaccccatttgcttccttctgggcttgatgctgcctgggagtgggcttctccctgggtggtatgtaggagttttccttacattttcatttcttatcagcttaccatttgcaactgatgcaggacaggcaagaccccaaactggggcttagcccaggaggattcttggctttgcccaggagagaattcaagcacaagtggtggtgttagacagcaacttttattgaggcagcagcagctgtactgctccctgtggagcagggctaccccacaggcagtgtgcccagagtagcagctcagggacagttcagcagtcatatttgtacccacttttaattacatgcaagttaaaaggcagttgatgcaggcatttctaggaaaaaggtggtaacttccgggtcattgggttactgccatagaaaggggtggtaactctcaggtgttgccacggcgatggtaaactgacatggcacactggtgggcatgtcttatggaaagctacttctgccctggccctgtttcagctagctctcaatttggtccagtgtctgagcccagcctctggagttgagtcccgccccctacctcactatcttggttctatttggagatgccctgaaaggctgtgtccagtcccacagtgagtgaggaatctatgctgaggttcctttggaggtgaattttgaatgacgtataacccagtacagaggaaaagtccagaactgagggatgcaggctaatattaaagactcatagttttgggggctgtctgtccaaaggctcatgcatgggcagaaagagttcacctgacctgtgctgtgggaagtttgctgtaaacattctgataaacatttaactttagtccctttcagtaccagtgccatgccctgcagtgttcactaagcgcccacaggcatctgctctctgtgacctgctcatatgacgagctaaagtcgagcatgcttcattcacagccaggcctcctccttctttgttggcctgagtgtgttgctgaccattcatgggtcagccccgacctggacatcaacactcctgagaaatgtggcaactgcaataattgactgaaatcagtctctccctgtttgctggtccatgttcttgtctagagagttgttttcttctccaagaataagaaggtggaatcgatttttccaccttttgttcccctcaccccagtgatgatgaggcaccaggagggaattttctgactttctgcaggcatttatgttctgcttcacatcatcatatttattcctttaatgtaggagaaccttaaatgaagcttgttggaaataggccatcctccataacctgggtttgttggagcccatgtatagaaatgatttcttggcaactctagttctcttgagcatgtgtgctatggttaaagaggcagaagggcacaagaattttagcaccctgaggactgaaaaccttccatagaaccagcatacatattgttttataaataaggagtattcttggggtatagttgtttgcaaagaaagggagctccttaagatttatgacccagctcacaataaccagatgacctgaatcaagggtgtatgtcaggaacaggatcctggaggggtcaatgacagtgtccatctgtggcctcaaagagcccgttcccaactctcctgccttttgacagaaggtctgtctggttatggctttaggaagatagatgacttctgtatagtcacaggaagagtctgcgtgcctggagctgtgggctggaaaggaggtgagagatgctggcctctccaaggcctcgtccacgtgccccatctccagacaggagcagccagggctccgttaggctgcaaacaatggaaaacctgaatagcagaggcttaaaaaacatgtggtttgcttgtctcacctgaaagaagtctgaaattgggaagtccagggctgggtcagaggttcagagatgctggggttgaggcctagatggctttttggccttttccccaggaaaaaacagaatcaatcagaaggtggctgatgtaggtcaggtgggctggggctggaggggatggtaggctgtgagtctggcgctccctcttgctggtgtggggatgggtaccaggagggcttctctcctccaccttgctctgttgctctgttgctctgttgcccaggcacccattgccaagaagccagactggaattcccaatgggatggggcagtcccaaggcacatggaatctttggtgggacttatacaccctgtactcctgtgagctcctcagtcactctggtcaaaaactctaatattgttccttttaacacagtcatcacccaaaaccctgttaaacacccaaatgcacctggggcaacccttgaccttatggagcccactttctttgcaaacaacacagatgttgagatgaagcaggaaggagtggttacataggaggatccagaatccccaaccccagggagttcgatatgggaaaaatgcctctgagtagggcggagggatgctcagagggctgcagggtcctgggaagtggctgtgtctcaaagtgtgctccatattcatacccgtctttccccactgcttttatttgcttcgcttttgaatctgtgattcaccttctttggtctcacctcttcctcgggccctttggttaagggcaggctgattactgcatatggctgtgccccagccctctgctttacccagcgattaaggagaagcccacaccaattcaacaaggcttgcattttaggagcagacaaaaatcttagacccagaagccaggtgtgcagaaaatgcatgttggcttccctttagcgttatctaatttcccaggctcaattctgtctgggtaaaggaacattattcttggttagctgaagtcccctgcttttcctgcagatgtgtctgatgctgggggctggcattgctccccttgggggctgggagatgctctcctttctggtctttggttgtcagagcctgctgttcactgctgttgtctcttgttctgactccaccccagctctgcttcaatcctactctctccaggccacagccacccactgggacctcccatgaagctcttgggagctctcacccatcctggagggagcccatgtaaatttgggcctggcttgttgattctgaatcaccaaataggcatttgcgcagcctgcctctccaagggaacttcagggttttgctgccactctggactttgtctgaggctatctttctgcacaaactgcacaaagtggggatgaagcccacttcatgggcacaggcccttcccaggacactgcagcctctccatacccctcccccctactcaggaggcctctgtgctgctgaggccaaagatttgctttgaaaggccaaatattcttcctgagccctggtcttaacccggggctgaagctttgctctcaaaggtaaaggtgaagacctccattttcctctgctctctgcaaattgcctttggctgaagcagggaacaggaaatgaatgaccaagttatgtggcctgggagagggagaagagcccagtcaacagctcaagaaatcccgccatgtctacttaaggggaagaagagagaaaggaggataaagagagattttttttccttttaatataatgcacattaaattttaggttgtttttttttttttctacatttaggtcccttatgtggcagaaaattccaaaatatattagtaaaaatgaacccaccttacatactcttggggtttcgttgaaatgttgagaagttaagaaactttgttagattattttacttaatttttaaaaaatagcctatcaaggagttttcaaaactttttaggtgtataaacaccctatttcggaaaccaccgtattttacactttcacttcccacctacaccagctcagtgacaagaaagtgtctgaaacaaggtgcaaaatcaaggttctcagaaacacgcttgggacgtcttgttccgcagcttggctgctctttccgcccggagtgtccttagcctgtgcccctttcgaactccggcactttgtctgcggagtagctccagcgcagtctcccagcgttacctggcagcctcctccttcctggagcaggagaagcggctctgtctcctgtgttccatcatcgattatggctgctctcacactgggttaggaaggtttggtcacctgagtgcctccctcctctgtgctgttggactctatggtttacatactcctagatgctattttttacatactcctaagttttcaacctgagaaatctgaaaccatcccctaaccttacctggttacctgttgaaaaatgtgttatcccagaggtagattctttgggtcctaggcatctggacttgcaagagtctcatgtcagtttcatgtgcttacaaaggtgataacagagagggacatagctgtgagtttttcccaacggccagtgagtgcttcgttccctgtatcatgttttatttatttatctatccccagggctagtgcagtttggacatagggtgctatgggttgaattacatacttgtcaaatccatatgttgaaatcttaacccctagtacctcagaatgtgacattatttggagagagggtatttatagaggtaattaggggaaaaggaggtctttagggtgggtcctaattcaatatgaccgatgtccttatatagagggaaaatctggacacagagctgtatacatccagggagaacgtcatctggagatgaaagcagagatcagagtgatgcagctccaagacatggaatgctgaagatggtgagcaacccaccagaagccaggagagaggtataaaaggtttctccctcacagcccttagaagccaccaaccctgctgatgccttgatctctgatcctcaaggatgtggagtagctgtgtgagaggctgtctgagggctcttcaaaaagttcataggaaatgcatattatgaaaaaactatgctggatttcaaattttttgcaccaaaattgatttgtactacctttttataacatgttcatgcacaatctagtttgaggcactaagaaggataatacatcagtttgaaaagagcctctatcagagcaatgtgaatttctgctaaaattgaagtaagaacaaacatcaaatttatagtgaagcttgaggggaagtatagtgaactcattgatgctttgtgaaaagcttatggagacaatacccccttcccccaaatcagcagtttacaaatagataacttcttttaagaagggagaagttgaggctgggcacagtggctaatgcctgtaatcccaacactttgggagcctggggcaggtgaatcacttgaggtcgggaattcaagaccagcctggttaacatgtgaaaccccatctctactaaaaatacaaaaaaaaaaaaaaaatagccaggtgtggtgacaggcacctgtaatcccagctactcgggaggctgaggcaggagaatcacttgaacccaggaggcagaggttgcagtgagccgagatcatgccactgcactgcagcctgggtgacagagcaagactctgtctcaaaaaaaaaaaaaaaaagggagaagttgatgttgaagatgaagcctgtggtggcagaccattcatgtcaatttgcaaggaaaaaattaaccatgccctaattgaaaagacctgatgattaacagacatttcagttggttcagtttatgcaattctgactgaaaaattaaagttaagttttccactcaatgggtgtcaaaaccattgcacccagatcagctgcagacaagaacagatctttcaatgaaaattaaacaagtaggatgaagatcctgaaggatttcttcaaataattgtaataggagacgaaacatagctttaccagtacaatcctgaagacaaagcacaatcaaagcaatggataccaagaggtggacattttccagtcaaagcagaagcagaccagtcaggagcacaggtcacagcaagagttttttgggatactccaggcattttgctgttgactgtctgtagagccaaagaatgataacatctgtttattatgagagtgttttgagaaagttagccaaagctttagcagaaaaatgccactgaagaattcagcagagagtccttctccaccctgacaatgcttctgctcattcctctcattaagtaagggcaattttgtgaatttcaatagaaaatcattgggtatccaacttgcagttctgattttgcttcttctgacttctttttgtttcctaattaaaacaaaataattaaaaggcatccattttcttcagttaataatgtaaaaagactgtattgatatggttaaattctcaggaccctcaatattttaagaatggactaaatgggtggtatcatcacttacaaaattgttttgaacttgatggagcttatattgagtaatacagtttataaagttgatatttttcatttttatcttttgattccattttccatgaacttcctaaagtcctcttgtatttctaggagggtcttggattaaaaaaaacaggaggaaggaacaagtgagaaattactctcatagtttatggcgtgtcttaacatcaagttacttttaagtcttttattcttttaggaagatattttctctttcagggaaaattaagaaacatcagggcctgagttatgttggaaaatctctcccctactctgactgtctggctttattctgagctcccaagctataacagtggcacttgggtgggatgagagtggggtggggctcacatctacatggctgaagaccaaggcagaatctcacacccaagtcttgattctttgtgctgcttagctgttgttcacaccacttttcctgcttgtgtccagatctgaatgaaactgatggctgttggagaggcctttgtcatctgactctatctgttcctctgtcaagtaataccatcaatgatgctattcatagaaacatttcatgtttgagaggtgttaggagttgaattgtcttctagaagctgttgaattcctaaccctttatatctgtgaatgtgactttatttggatataggtagggtctttgcagatgatcaaattaagatgaggtcagtagggtgggccttaatccgtattactactggtcattctaaaaagggaaaatgccgatacagacagatgcattcaggagaattctgtgtgaaaatgaaggtggagatcagtgtgatgcatctccacaccaaggaacactaaaggtcaccagcaaaccaccagaagtgagatgcgaggcattgaataggttttcctcgcagcttcggaaggaaccaaccctgttggcactttgttcctggacttccagcctgcaggtggttgtgtaagcatttctgtggtcgaagccacctggtttgcagtactttgttagggcagccctagcagactaacacaagaggtcattgaaagtgtcatatccagaacagtgtgccttttgggggaggaaagtccagttggccctttcacatacacgaacatctcacatttaaagacacaattccaggctgtctgtggacactcataggtgcccgtgaaagccgcctcagccataaacttcttggagtcacattgtgaagtatttatttttaattacagattttctttgatgatcctcttctcttctctttttgtttccttggcttgtcactcattcgttgtggtaaatagactgcctgctgtttacgatgagaagtagcctgtgctttggtctggtctcctgacgcccggttgccagcagtccttgctgtctctgggttggaagccgtgatgcctgctcatgggctcgctgtctcctcaggcatgaaagtggaggcatccttctggctctattttcaacttaccttggtgaggccacaagaccctattgacacatgaaggggaagcacagagggaaagggggttttacttttcctcttcaacagggctagccctcggggactgagcagagagagttgtgaatgctgggttttgaaactggccccaaacgattgtctcctggaatcagagaaggaacaaccgactgcacctaaaagaaacagagtgtttaccagtcttgctggatggctttaaaaacgcaaatacatacgcattctcattagcccatagcactcagccatcttcacccccattagagaaagccagtctgctgcctgcccccctcaagtcactgctgaactcatagcatgtgtcgggcttctggaacctcacagatgtattgccgcagacaccctttagatgagaggtgtaggttaggggcacaggcaagggagcggtcactcctagacctgaagcatctcttccatagacgtcacagtatatatcttcccagccagctcctccccagcccttcagggaaggtgaacacaattccacactagagtggcttttaaagaaaaataacatgtatgaactcttcccagaattctatgaaatgaatgagtttgcattactttttctagcttatgacctgagtcttttattttttcagatacatttagttgtgtctttcaaaatctatttttgcagaacctaccctttgttagcattgggctggaaccccggaaggataattatgtgtgggacttggtagctgcccttaggtgtacaatcccataaaggagagatgccatatgcagaatgatgaaatgcagcatgaggctaagtgtccagcatgggttatggagggtagatgagagagaggttggtgcccagaagacagccgtcctgcctcgggcctatatgtctgcagaggcccacaggagtggggcagtcctgttcagggagggctgaggggttctccgaatcttatcaggtaggacagggagactttagaaaggattgggcattcagtttgtgggtgtgttataagcaaagtctggagcagctgtgagttggatttcactgggtttcatggagcagatgtctcttgctggggaatgatgggatgtaagactagagacagacacagtcagaggcgatgtctgccttgaggcagacaaacagatttcaacttggtcttctgggcctaggcagtgagaagcctggaaggtgtctgagcttggagatgacctcatagagccaactttttggaagattggttgggtggcagagtacactgtatgaaggcacaggagagagaaaggacaaatgcacaaaggaaggatccagaattccagggcaggctggacatgtgggcctgaaggaaggggaggggtgaagggagacctgaccatggcttctgcctgcttgaccaagcttggcatgtacattagaatatacagagtttgaggcctgaggacccttgttctttttcaataagtaatggtattttaaaaaccatctctgggttttatcatgagcagaggcgaattccatgcacagtgaggactgttttatttatttatacttgttgaatagtaaacagcattgaagaatgtttttaaagaaacccaaacttccttttccatttctcagtattaactttctttttagcaactagggacacaattgaatgctattgtcttaaacctgcctgacagagcagaggtacacgctggggggcgtgggaacctctatttggcaaagggaacttctcctgttattcccatatggaaagagacataaatttggggagagcttgctccttccctacatttctgtgatccatggttaacagtctcctcaagtgaatttcaaattctctttccaataagctgcaaaagtacttaaatcatttatttgttctgctcctgaaatgagagttactcactaaagtcccaaagtgtcccgaaccatgaggtgtccacagtgaaatgacatgtttaaaagttgccataaatgctggtaactggacatgataataaatctgagtcatttcacatggccagttgggtcggtaataacaagacatgcacttaaaatatatatctttttgcctttcgggctataaagattaataaattgtgtaaatttccaagataaagtgtgagacattctgaattttatgtgaatgacttgcatggtgacagtaaccatgttctggcccttggaacaggaggtaatttactgttgatggtttcttggcataatatatatacgtatttggggggtaataatttaaaatcatccagcacatggtctctgataaggtgcataactcaggtactcagagttgttttataggaaaagagatacaggcacaccgtgcgactgcaatcccggcacgttctccttcctcaggaatgacaagggatggaaacctggctccccacggggaataataaagcatgcctgtgaaaaatgaatcctggacctgagctcagggccagagtgctccaaaatttggggctttcccaggacttagtccagatttgcttctgtccaggccagtgaccgcttgaagctgtagagggcaggggagggagggtccccttcctgaaagggaagtgctgtgagacgtggctgtcactgataccagtggggacctctctgcccccagcctctaatcatgcttgaaggtttactctctgagcatggcttgagaagacaagggaaagcaatggagattggccatcacagccaaattctgcctgatatggaggcctgagtccttttgtgcaggtggtgactcactgccctgttgaatgggaggaaggaacagtgatcagacccaaacactctggttttcttcccacctgtttctcagaagtaataagtgcagggctcatgctctgcctgtgtgtgtgtgtgtgtgtgtgtgtgtgtgtctctgtgtgtcctgtgtgtgtgtctctgtgtgtgtgtgtgcctgtgcgtgtatgtctctttgtgtgtctatgtgtgtgcgtgtgtgcctctgtgtgtctctgtgtgtgtctctctgtgtctctttctctgtgtgtgttgtctctgtgtgcacgtgcatacatgtatgtccctctgtgtgcctatgtgtgtgcatgtgtgcctctgtgtgtttctgtatgtgtgtgttgcagaggagctgctaatgtgttctcatgctggttgtactgccccgccttggaacaactttatccttgggtgcaggggctgggtgagcctggaagctgccagatgcagcacatgatggaggagaagggcctggaaacttttgcagttgtcactcaacaaacactcatgcagctcctcctgtgtgccaggccaggtgccaggagctggagggaatacagagagtgagcctgccgctttgggatctcatctcctggaggaggaataagttatctacttaggtattcaattttaactggtatttaattacagccatacaagtggttccattattagtcaagctgaactaagttttgctgcaataacaaattttcccagaatctcagtagcttaacggagcaaaggttggttgcttgtgaatgctgtctgtcctacaaggtggtgctctgctctgtacagtcactcaggattcaaggctgacaggctaccttcttctttaggctgtgcattctggaacatggggtttctttagcctctgtagtggggaagagagacaagagactcactcacaagcttctctatcatactaccttatgatggaggtggtgttattagcctttttacatctgaggaaactgaggcacagaggagttaagtaacatgtccaaagtttcacagcaagtgagtagcagaaccaggattgtgagctccagccatctggctccagaatccctgttcttgtcatgctctgccatctaattaaacagtttcttgggaagggaatgaagagatgtcagacaggccaggagctcaggggactagaaaaagaatttatcagaagaaggaaagtatgtcggggaatgacagggaaggataaatgagcaaggctagaatcccagaaaaatagagagacttcatcttggctggcagaatagcttttgcaaattcgggattagaagcctggtttcatgagtttgggacgaaagctacagaaaatgcagacacagggtggatcttacggattgtgaagtcagggaggtctgaaatgaaatagaaatggcccaaggaaacctttcatattcctttttgtttccacatacatctggccacaaaagctctttggtggtttatcccatctcactgcttccttagggctctttcaaactccttgcatctatgtaagcatggataaggagcacagcagacatgggacacacctgtgttgctttctgggcatgctgtaggatgccactttttggctgtgcacctggagcaagaggcagcagggcagcagcacccagccccctgcagttgaagctaaagactgcagctgcagcgcaggaattccccagtaggacaggaaagcaaacacaggcaagataaggtcagagacagccaactgtttacagcgtccaagctcttcctgggtttggtccaccctattaaaagataataacctcttaaaacatttcaaaggatgtgttggcagtgtttaagaggaaacataattgtcaccacagcctgggtagtgtgcaattgagtaggagaccatcttcaggataggatgggtgatgggcaagattgtgctgggagaggagttcgtttgaactgcagactccagaagctacagtggctgcccaacccatgaaaacacccacagatgctgtaactgctgggtatctgtcatctttggaataaaccactcatgctggggtctcactttctaagccattaccagctgcaagggttggctttgtgaaggcaaagggaagtttactttataacgatgtaggctatgtggagatatagaattataggagcacaaagtgcattactgactcactgttctgctgcccatagagcagctcatcctgctttgtgaggcattgctgtgagttgccttcaggcaacttgggaggaagagctgcctgaaaccctttcttgaatcttctttaaggttgctgatcaggacccatctaccatgggaggactgtggggattcctccatgacctcagtgctgagctgatctggctcattaagagatggttcttacgaccgggttcggtggctcacgcctgtaatcccagcactttgggaggctgaggtgggcagatcacctaaggctgggagtttgagaccagcctgaccaacatggagaaaccctgtctctaccaaaaaaatacaaaattagctgggcgtggtggcacatgcctgtaatcccagctactcgggaggctgaggcaggagaatcacttgaacctgggaagtggaggctgtggtgagccgagattgcgccattgcactccagcctgggcaacaagagcgaaactccatctcaaaaaaaaaaaaaaaaagaaaaaaaaaaaaagaaaaaaaaaagaaagaaagatgcttcttacaaagaactctttctttgcatctcatggataatctgaattgtacatctcactgaactaccttctttgccatggctgctggggtgcccagagcaagtgaccatggcatgcatgctgtcacctaagtggctttctcttatttttcttttccttctctgttatttattctgttgtattgtttatattttgataaactcacttaaattcattttgggacaagatgggatctaaaccaagaagtagataaatatgtgtgctttagagggtagttattgcagagtctatcctgggaagagtggctcctttgttcaggatgcctttctgggtatgaggggtgggttcaattccttccatccctttctagaagtatgtagtctttgatggattcattgagtcactgatttgttctgtggacacttattatgtgccaggccctgtgctaggcctgaggaaagtgacgatgacctcagagttatgttccagtggtgggagataggcaaagactatgtaagtgggcagagacactaattacatgtaagaaccactgccttgaagggagaatgaggatgagggtgtgtcttaggtgggctgccatagcaaaataccatctactgggaggctaaaacaacagacactgatttcacatgctcttggtggctggaggtcagagatcaaggtgtcagcaagttttattctgaagcctcttcttttagcttgtaggcagccacatctcactgtatgctcacatgacctcttctcagtgtttgagcagatagagagagagagagtgctttgatatctcttcttacaaggatgttaatcttattggaccccatccttatgacctcatttgaccttaattatctccacgaaggcttcatctccaaatcacatcacactgaggcttggggcttcaacatatgcattttggggtgggcacagacattcagtcatgacagagagggagaagatctacttcctatggggtgacgcaggaagcccactctgcagagggcaacatgcatgctggaatggaaaggataagaatgaggtggctgtgggagaggagggtggggaggcatgtgagggcgcgaggtggagagaacagccagggcagaggccctgaggctccctgagcagctggtgtggtcgcagcttactcaggagtggagagtagcacaggggaggatgtgagatgagtggggcacgagtgtgcagagccttgtaaaccagctatggtgagggttttgggtttcctactacatccagtgcaacgttactgaaagattgtaagcagagggatgtcatgatctggcttaggcttaaggagctgtgtggacagtgggctggagggattgggaatggaggcaggagactgcttgtcagttttggtaagaggctgggaccatggtgatggccacgttctagaagagagagtggaatctgttgatggaggaaatgtgagagacagggagagggagcacttaagggcaactcctaggctctaggcagaacatttaggtgcatggcgatgctgtttactgagctgaggggatgcggaagggagcagaggcaacgtgtatgtaatgggtaattgcatgtgtcaatttgactgggctaagggatgcccagatagctggtaaacattgctttggggtgtgtctgtgaaggcatttccagaagagactagcatgtgaatcagtagactgagtaaagaagattaccctcaccagtgtgggtgggcattatccaactgagggcctgaatagaacaaaacggcagagacagggcaaattcactctccctgcttgattgcacatcttctcctgccctcggacattggtgctcctggttctctggcctttgggctcagacaaggtgatatggtttggctgtgtccccacccaaatctcatcttgaattatggctcccaagatccccatgtgtcatgggagggacacagtggcaggtaattaaatcatgggggctggttttcccatgctgttctagtgatagtgagtaagtcccacgagatttgatagttttataaaaggcagttccgctgcacatgctctcttgcccgccactgtgtaagacatgcctttcctcctcctttgccttcctccatgactgtgaggcctcctcagccatgtggagctgtgagtccattaaacctctttttctttataagttacccagtctcaggtatttcttcatagcagtatgaaaatggactaacacaacagggcttatacatcacctcccctttagacttgaactgagttacatcagttcactgtctgcaagctggaggttttcctgggcctccagcttgcagacagaagattatggaacttctcagcctgggtaattgggtgaatgaagtcccataataaatctcttatatttctctacatgtcctgttgtttctgtttctctggagaaccctgactaatgtagtatgtaaggcacccagtcataagggcaggctatccttccattaatgacctcattccgggtgtatctgtagcctagaccactcttctaggaaaatcctattcccttcttgtctcttccatgtggaaatctcacagacattgcaacccaacccatccaaatcagatgggaaccaggggtttaatgttaacaggtgatatctgctgctgccggtctgccattgtcctaaagcattttatacacattttcttatcttagaaagtccctgtaagataggtgtgctaacaagaatcattttgcagctgaagaaatggaggtgctactggctcaaggaacctggattcatttagagagtgtgcccaggatgagacgtgtggagagcctggcctgaaccaacactaacagtctcctggacaggaggtgagtaaggaagaagcggcagggaaggagggacaccgggtgaaaggaggtgggtgtaggaggaaggagatcacaactgtgttgaaagtcctagcagcctgagaaagacgggggaagaaggccctgcaatgaaccctgtgaccttgggaaggacaagtcctcttgcccctggggcccactgtctgagtccctaggaagtatatatacaaagggtttcggaatgcagagtttgcagatgtgggctgcagctgcaccctgtgtgtgactggatggaattcacagctagaagtggttttgtccctggctgctgaatgtatcagctgttggtgccgctttagttttattgagtgggaaggatgtagaccctgagtctggagaatgggactgggctggccatggagcctggagaagagaatgagaccatgcaaaacctttattccttgttcttggtttcttgttaaacaggcccagtgccaccagattaaggaggtgagggggcggttgtaagaaagtaagagatcagtctgaagattataaatatgggccagtgcaacaaagggaaattcttgtgtcaatatttttctgagccagcacttgggagatcctgatttccttaacaaaatgataacaaacattttttcatgttaataatgtaagatgaacatttccttcatgtttaagccactgaatgtgcagtgaacaaaagacatttacatacaggcatatttgaggatatggaaggttcaattccacaccactgcaataaagcaaatatcaccatagagcaatttatacaatttctttggttttccagtgcatgtaaaagttatgtacattatactgtagtctattaagtgtgcaataaccactccttatctgtctaagaaacatacataccttaattaaaagataccttattgctaaaagatgctaaaggtcatctgagcctttagtgagtaataatctttttgcttgaaggagagtcctgcctccgtgttaatggctgctgactgaccacggtggcggttactgaagcttggggtggctgtggcaatttcttaaaatgagacaacaatgaagtttgacacatcagttgacttttactgtcaggaaagatttatttgtagcatgcaatgctgtttgggatagcattttacctacagtagaacttctctcaaaaaaatggaatcaagcctctcaaaccctgctgctgctttatcaactaaatttatggaatattctaaatccttttttgtcatttcaacgatgttcacagcatcttcaccaggaggaaattccatcttaagaaaccactttctttgctcactcataagaggctactcctcgtctgttcaagttttaatatgagattgcagcaattcagtcacatcttcaggctccacttctcattctagttctcttgctatttccaacacatctgcagttactacctccaccaaagtcacaaaccccgcaaagccacctatgaaggttggaatcgatttcttccaatcttatgttaatgttgatactttgacctcctcccatgaatcaatgtttttaatgacatatagcatggtgaatcctttccagaaggttttcaattgactttgcccacatccattagaggaatcactatttttggcgctataaccttacaaaatgtattttttaaataataaaactgggaagtcaaaattatgccttgattcatgggctgcagaatggatgttttattagcaggcataaaaacaacattcatctccttgtacatctccctcagagctgatgggtgaccaggcatattatcagtgatgagtgctattttgaaaggaatcttttcttctgagcaacaggtctcaacagtgggcttaaaatattccacaaaccatgctgtaaatagatgctatcatccaggctttgttattccatttttagaacacagccagagtatgtaactcatttatttatttatttaatttatttattttattatactttaagttttagggtacatgtgcacaatgtgcaggttagttacatatgtatacatgtgccatgttggtgtgctgcacccattaactgatcatttaacattaggtatatctcctaatgctatccctcccccctccccccaccccacaacaggccccggtgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacatgaactcatccttttttatggctgcatagtattccatggtgtatatgtgccacattttcttaatcccgtctattattgttggacatttgggttggttccaagtctttgctattgtgaacagtgccacaataaacatacgtgtgcatgtatctttatagcagcatgatttataatcctttgggtatatacccagtaatgggatggctgggtcaaatggtatttctagttctagttccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcgtgtgtcttttggctgcataaatgtcttcttttgagaagtgtctgttcatatccttcgcccactttttgatggggttgtttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtcctttcccatgcctatgccctgaatggtattgcctaggttttcttctagggtttttatggtttcaggtctaacatttaagtctttaatccatcttgaattgatttttgtataaggtgtaaggaagggatccagtttcagctttctacatatggctagccagttttcccagcaccatttattaaatagggaatcgtttccccatttcttgttttgtcaggtttgtcaaagatcagatggttgtagatatgcagcattatttctgagggctctgttctgttccattggtctatatctctgttttggtaccagtaccatgctgttttggttactgtagccttgtagtataatgtgaagtcaggtagcgtgatgcctccggctttgttcttttggcttaggattgacttggcaatgtgggctcttttttggttccatatgaactttaaagtagttttttccaattctgtgaagaaagtcattggcagcttgatggggatggcattgaatctataaattaccttgggcagtatggccattttcatgatattgattcttcctacccatgagcatggagtgttcttccatttgtttgtatcctcttttatttcactgagcagtggtttgtagttctccttgaagaggtccttcatatcccttgtaagttggattcctaggtattttattctctttgaagcaattgtgaatgggagttcactcatgatttggctctctgtttgtataagaatgcttgtgatttttgcacattgattttgtatcctgagactttgctgaagttgcctatcagcttaaggagattttgggctgagacgatggggttttctagatatacaatcatgtcatctgcacacagggacaatttgacttccacttttcctaattgaataccctttatttccttgtcctgcctgatttccctggccagaacttccaacactatgttgaataggagtggtgagagagggcatccctgtcttgtgccagttttcaaaggaaatgcttccagtttttgcccattcagtacgatattggctgtgggtttgccatagatagctgttattattttgagatacgtcccatcaatacctaatttactgagagtttttagcatgaagggttgttgaattttgtcaaaggccttttctgcatctattgagataatcatgtggtttttgtcgttggttctgtttatatgctggattacatttattgatttgtgtatgttgaaccagccttgcatcccagggatgaagcccacttgatcatggtggataagctttttgatgtgccgctggatttagtttgtcagtattttattgaggaattttgcatcgatgttcatcagggatattggtctaaaattctctttttgttgtgtctctgccaggctttggtatgctggcctcatagaatgagttagggaggattccctctttttctgttgattggaatagtttcagaaggaatggtaccagctcctccttgtacctctggtagaattcggctgtgaatccatctggtcctggactttttttggttggtaagctattattgcctcaatttcagagcctgttattggtctattcagagattcaacttcttcctggtttagtcttgggagggtgtatgtgttgaggaatttatccatttcttccagattttctagtttatttgcatagaggtgtacagtgcaatcaaactagacctcaggattaagaaactcactcaaaaccgctcaactacacggaaacggaacaacctgctcctgaatgactactgggtacataacgaaatgaaggcagaagaaataaagatgttctttgaaaccaatgagaccaaagacacaacataccagaatctctgggacacattcaaagcagtgtgtagagggaaatttatagcactaaatgcccacaagagaaagcaggaaagatctaaaattgacaccctaacttcacaattaaaagaactagagaagcaagagcaaacacattcaaaagctagcagaaagcaagaaataactaagatcagagcagaactgaagtaaatagagacacaaaaatcccttcaaaaaatcaatgaatccaggagctggttttttgaaaagatcaacaaaattgatagactgctagcaaggctaataaagaagaacagagagaagaatcaaatagacacaataaaaaatgataaaggggatatcaccaccgatcccacagaaatacaaactaccatcagagaatacaataaacagagtatgtaattcttaaaagccctaggagttttggaatgagcgttggcttcaatttaaagtcaccaggtgcattcgccctaataaaagagtcagcttgtcctttggaaacaggcattgacttctcctctccagctatgaaagtcctagatggcatcttcttccaatagaaggctgttttgcttgcattgaaaatctgttgtttagtgtggtcaccttcatcaatgatcttagcaagatcttctggataacttgctgcagcttctatgtcatcacttgctgcttcaccttttttttaattttttttttgacgtttcactcttgttgcctaggctggagtgcaatgctgtgatctcagctcactgcaacctctgcctcccaggttcaagcaattctcctgtctcagccttctaagtagctgggatcataggcgtccaccactacttctggctaatttttggtattttcagtagagacggggtttcaccatgcctggtggccaggctggtttcaaactcctgacctcaggtgatctgcccgcctcggcctcccaaagcgctggaattacaggcatgagccaccacaccaggcccaccttgcatttttatgtgatggggacagctttttttccataagcctcatgaaccatcctctgctagcttcaaccttttcttctgcagcttcttcacctctttcagccttcattgtattgaagagagttagtgtcttgctctggattaggatttggcttaaggcagcatggctggtttgatcttctatccagaccacttacgctttctccatatcagcgataagcctatttcactttcctgttcatgtgttcactggaggagcacttttaactactttcaagaacttttcctttgcattcacaagttggctgtttggtgcaataggcctagctttcagcctgtcttggcttttgacatgccttctactaagcttgatcattttcagcttttgatttaaagtgacagatgtgtgactcctttcacttgaacacttagaggccattgtagggttattatggacctaattttaatattgttgtgtctcaaagaacagtgaggcttgagaagagggagagagatgggagaacagctggtcagtggagcagtcagaacatacgaaacctttatcaattaaatttgccatcttatatgggcatggtaccccaaacagttataatagtaacatcaaagatcaccgatcatatgtcatatgtcaccatacagacataacgatgaaaaagttgaaaatattgtgagaattaccaaaatttaacagagacaggaagcgagcacatgctcttgatacaattgcttgacacagggttatcacaaactttcaatttgtaaaaaatgcaatgtctgggaagtgcgataaaatgaggtatgcctttactgactttaattttagtaaatgacttcataaggaaaaggaaaaaatgtcattgtgagggcactgtgtttgttatagactagctaggtcatcaactgggtggttttgatactagcagagtcctccatgtgctaggacactgtttgaaattcttgttatagctttaaaagtcatggttttatcaactaactccctattagttactgtaattgaatttttatgttagcttccactagtagcaagtttttgagtcaagatggcccttgggttttattgccaaccctgacagcagaatcctagacagggtcgctttgctcttaaagcctctgatgtccagttgcaaagtgagtataattgcttctctctcagatctgtgttgaggagctcaagaaataacgaatgtggaagcactcagatcaattactttttttgtttgtttctaccttatctagtttcctaggtcaaaagtttgcttggctaatggaagaaaggagtcccaacctttccaagtgggacagattccctagctgtgctctgtatattgaatctgcttcttatcatttggctgtggtctgtgtgagtgctgaaaaggaggagataatttcacgcactagggaaatggaaaagactcctgcttggcaggcaccagggtggcaagagaatccaggatgtggccacgcacagcttaaagactacatttcccagctgcctttgcaggtgaatgccatcagtgagacctaattgagagtatagtctggggagtctgggaatgttgcctaagaaaggctgatttagttggtggtgcaactccctttttacctcccctctttctctctttctggaatgtggatatgatggcagaaccacagatgatcttgaatgaggaggtcacttgctgaggatggtgcaacagaaagatggaaggagctcaatccctgatgagcttgtggacctactgtatcagtcctggattactcactttctgtcttttatggagagaataaaccatcctctttttaagttgctcttccccctttgtttgtgatccctcttaccatagaccaaacttaattcctaatgaatagatctgccaaattgtttatatcagagatgacaacaggaacacatctgtttacattttcctttctcctgaagccccacctagtcccagagggtggtgtgtttcttcactgctattttgggcagaagctacccggctgtggtggttaaagtcagcactgctgttagcccttgtggggcctttgtgcaaattgaaaaaaggcattcatatcctaagacaccttcctgttctttgccagaaaaatgtctcaatgcaaattgacaatgtgtggacaggaatggaacatgcccttgagaagcagcccctgcacaggatgccactgctcagctttgggtcaatgtccaggccagtatctgacctcgaacttctctctaggtcttccacctttacttagcacaggcctcagaacagtccagccaggggtctaggagagaaagtggctgagactgtgtgagatggggatggggcagaggacggatagggtagagggtggattacagtgagtttctggctattgactgctttcacatgagcagctcatttctgtgccaaccatttgactagtaagttggcagaagccctgcctgttggtcacattctggcccatgctacaaggccacctggcaggctcaggctgcagcacggcaggctgtgtgcacacggctatctcccctagtctgtccccagagctgtctgtgcagtcctgagctcccatgtaagccaatgctacttttgtgtgaagaaggtggacgaaatcatcagcaactcttgcttatatagaatgtgacccaagcaatggaaagagaaaatccaggtcttggttttgtactggcttgcgagaagtccttcttttcctctctagcaatttccctacatccatccctgcctacccacattggattaaagggaagagagaaaaatgccctaagccccagagagaaaggtggcagaaccatgatattgctgctcttgactttgtaagatggccaacatcagcccagagaaatctgatctgaaatagaatgagctcacctgacttcgaaatttaccacatttgtcatgaggcagtcacttaacctaaaaagtaaacaggctcttactctgtcatagtttacatttgtgtgtgtgtgtccttttctgttttctttctttctttctctttctttctttcttttctttctttcttctttctttctttttagtagctttaacttgttctgcaaacaaagaatatgacagaacaatgtacgttcctttgaaatggcaccattaatcttgatagcaagtttctaattatgaaggatagagagctttggctgcttcatggaactgtgtcctggtgacttttttcagtccctttttcttgctttccctgtctccggtagcttccttgagagctgtggtttctcagtgttagatattcaaaagcacagcagcctacaggccatggctaaatcttctttacaaccagatgcatatgagatcttagcaggaagtaagaaaagtaaacgcattattaataaacacacttaaatgcatacaataaaatgaatgctgtttccttcaaagtaaccctcctttgcagatatagtctaaccaagcctctattgccctgcccagcatggatctgaaactctcctccgtaaattctctagaactctaggaccgccccttctaaatgcccaaaagaatcccaactgactgagggcaaagatgcaccttatttctggctccctttcgcttcaccacttgacttcaaatgacttcaggctgattccagaaagctaatacaccctcaaaggacaatgcaccttcatttagctcactcaggagagaggccacagtcttgaggggaggcactctccaaggcacagctcaaaaattgtttcaagcaatggaatcttcacgtgaatgggcacatggcctcccacagcaaggatgctcgttaatggggaagaatcactgaaaatccgaattcagatgtgtttcagaaagcagcttcaaagtgtgtgactgatcttcctagtcctgggaagagcagaattggcccttagaaccgttaagagtcagattgtgaaacagagagttcttgttccccatatgtttcactctaaatggaacatgaatcagagctgggagaggagcttccaacttctgtcaataataaaagccttcttatgagtcaagtgctttgtaaatactttgattggtagaggaaaaaggaattgcatattgaaagaactgtatttccattaaaatgcatgtgtgtaaagtaaagaagggcaggaaacattgagcccaagactttctgagtttgagtgaaccaacctgctggagtggtttctggccatcactttgtgctgccatgtctcagcctgtgctaagtccagaggatctggggttccgatatttgcaagaaaaagcaaggacaacaggtttgaagtcaagcaatgggagggtctcccagagacctggagcagggaggatgagtgccttagctgcttctgtctatccatcttccatctgtctggcaatcaggatattttctggggcccattcaatgcttctctgttggctgggggctcccatcagctgccaggggttccacctgttttcagtggtccatgtgcagtactcagagaaatgcctcctgagggaatgagtccagcgggtgagcgccttttaagaaatgcggtggctcacacctgtaatccagcactttgggaggccaaggcaggcagatcaccagaggtcaggagtttcaaaccagcctggtcaacatggtgaaaccccatctctactaaaaatacaaaaaatagctgggtgtggtggtgggcacctgtaatcccagctaatcaggaggctgaggtaggagaatcgcttgaacctgggaggcggaggctgcagtgacccaagattgtgccactgcacttcagcctgggcgacagagcgagactccatttcaaaaaacaaggagtatgaaaatgctttccagctctttgcagtagggcctgtctcatggggtgcagcctggaacttgcgcaggcccctacacagaaggacctgtgcttggcccaatgctctgctcctgctgtcttgtcatacttaatactttttttagcaagaggccctgaatgccatttgcattaggcaaattctatagctgatcctgatgaggctcttctgtatggggacctgcacaactgcaggactgcaccctatgacgcaggccctattgcaaatggctggaaagcgtttttgtatttcttaaagggtgttcactccctggattcagtcgcccccaaaataacgtcttgggtgtcttatttaggtggcacctgcttggtctgaaagagctcatgtgacttcaggaaatactgaatttgttctgagaaagcctcttgccctaaaaaaaagtgtatggggggagtgctcctagtctgtcatagttaaagttcaaaggttatttacagtgtgttgcatccactgtggtgactcctggcagatcctgaacttaagcagacgtgtgttacagatcttaatgagtgtgttgatgccgatgggagttgccctggatcacaccaagtgggtgatgggtgggtgagaggagagacattctttttgttaacccctcatttccacggtcagtctcagatggtcattacaaacctcttctaaatctggacctcaacaagcccccctcacaccagggacaaagtaagggtcatgcgatggcctctgagctgaccttcgagttcagagtggccgtgtgctggtgctgtgatcattaaactgactgctttgcaaggtcagcactcaaggctatagatttatatctctcttttattctaaaactagactatgccacaaccaggtgactgtggtgcctcactcaggtggtctgtcttctgcagttgaaggcaggtctttttcctccatccattcagattgaatccagggggtcctccctggaagacctgtgttccacagaagactcccctggagcttctcctctctgcacctcagctttcttgtgggtgcagcaggccacccaggcccagtccctgctcacgacaatgacttcagctttccagggtctttctcatgcattcccaaccattagactccccagtcctctctctattttttccccttatttagtaaatatttattgaagatccattacttgcacaaaagacagcaggccgcagggaaaggggtttatagtgggagatacgatgaaaagatgattaagattgcaagttctcaaaagtttagatgttgaagtattattttccaaagtgagttacacagggtattaatgggtaccgctcaaagaaagggttctagagtgaatatgaaacattggcttaaacaaagttaaacattttaaattactgcacagcttctcaaaagttttaatatgctaatgtgtcatctaacttcccaaaaggagaaacataatatattggacttcttaaaagtatttatgacattttttcttgcattgaactagtcccagatagaagacttagccttaaagggcaaaataaaaagatgagttctttttctttttaactgacaaataaaaattgtatacatttatggcttataatatgatgttttgcaatatgtatactttgtaggatggctaaactgagctactaacatgtgcatcacctcctatttttttgtgtggtgagaacacttaaaatctactctcagtgattctcaaaatacaatacattattaactatagtcagcatgttgtacaatagatctcttgaatttattcctcctgtctaactgaacttctgtatcctttcaccaatatctccccaaccttccccatacccctgactccagcgcctgctatcaccactctacgttctacttctgagtttgactttttataatagattccacatatgaatgagatcatgcagtatttgtcttccgtgcctggctcatttcacttagcataatgtcttcaaatgtcctcagggtctgcccctctttctgcctctgtgggggctccaagtgggaattcgtggttactgtaattggcagggggcggagatttggagctggaacctctagagtctgagctctaccatggaaaggccgtataatgctcagcaagtcatttaactctttggtgtctctgttttctcattgataaatgcaaagataatagtgcaccttcactgagcttcactgggttagccaggtaaaaagccttatggggcaatgcctggctctggcaggcttgaatgctggccgctggctctggttctcccatgtggaaacaaagcctacgtctcacacccagcagcaggagcagcggggtctcggcccagccagtgtgtcctgagtggcacagggtcagacataaccaggtccatgaacatttgtgtctttgtataaggtcagacttttattgatgcaatttcaatcataaaagccactagctgcatggagttcccaaggaggtgattttctttagtgctacctgtttacttggtagttaaagcctcaggcgcactttacaaatcagtcagtattgcaaacaagacatagtagtacacttaatcaatatacaattgctatagattaaaccttctacatcagtaaacattcataaagtaatatttaacattaagagaaagggggataggataaacgggttaatgaaccagtccaagagggtaacatgaacaaggagaatgtcctggtctgatctggatggacatcaacattttgtaagaaagagactatcgtggcagatgctgggtgctggtcatgagtaacagcaggatggggtctatgaagacggccatctggagctggtgaattcttcctctttttatagcccccgagtcctctggtgaggactgataaagtgaaccttatctgattgggtatagtcactgttgattagacaaacatctggctcctgttggcatgatgtcttttaaaaatgtaagatggagtctttttctaagatggagtcacttaggtcaaaggtcctgtgtccacaggggctgcccacatttcaccacaagttgccatgagactgcccaggaggacccgaatgcctggagtgctccagccatgctcatgccacggcttttgtccctctgcctgtctttggacacctctggtgtggagttggagatgaggaggagaggcttgcattcctatcagcagtgtggaatgagcagaggtgcgggtagactgaagctctgtgtttaacctctgtttacagaatatggacgctgagagagagtctggggtacttaaggaaaggcttgattggattgcagaaaacagtttctgaaacagactatttctgaagactcaaattttaattcttttgaatttatacagcaactcatctcacaaataattattaaatgataataacaataataatgatactcttcctcctcctattatcaccaaatagcatttactgggtgttggcaaaatgctgggcattggtcaggaatgctggacttgtatttccacttgacccttcaaaaatccttgtgatcaataaattactatgttatataattaaaatattaaaattattggaaattttatttaataatagcaataatatattagtgtaaatacttttctgaataatgaaatatacaataatatattatgcacaaacacaaatgtgttaagtaaacacatcagagcttgttgccagccatgatataatgtgtattatcatatgctataccgacatccccatttgacattggaggatatgagctctgggttgctaagtgacatttcccaggttacagctctctggaggaggcagctggactccaggaccccgtgtttcctgagacctccatagcctgcctcccgctttgctgtgctgcttctatgagaagataaagtaatttaatagcagctgtcgatatgcagggccacctctcaagtgcttgaaaatagttctcttaagcgggaaatactttttttttttcccaaaataatttattatgtttcaaaagtatttcctctaattgcagggaatccaaatcaagcgcttgcatttcttataaacaaacacctctgtatactttcccctgaccatggctgacttcaaaaccaggccggcctgcaccagagcctcagagccagagaccgccccaggcagaaccacagactatgcagggcacctctgttcacctctgcacccatctccctgaagtgccgggcttggcttcccggcaacatccttcatttcaacagctaaatacgcggtcaacaatgggttggtgaaaatgggggcgcccaggagccattccatgccttcagatggggtccgggctcactgtgcaatgcatcatttcacacaggttaaaaggaaaagcagttgccagtgcctgttgttcatttaaggagattaaaatgatagaaaaagaggattttgcatttagacagtgagcagtggaatttaaaaagcagtgccagaaatcatttagtatgtgttacattctattcttttttttttttttccagacagagtctcactctgtcatccaggctggagtgcagtggcatcatcttggctcactgcaacctctgcctccctcaagttcaagtgattctcctgcctaagcctcccgagtagctgggattacaggcacccgtcaccaagcccagctaatttttgtatttttactagagacgaggtttcgccgtttggccaggctggtcttgaactcctgacctcaggtgatccgcctgcctcggcctcccaaagtgctgggattataggcgtgagccactgtgcctggccttagtatgtgttacattaaaaaaatcactccataaagatgtacaattattatgtattaataaaaaatgaaaataaaaagaccgtgtaaactgccacgtattcccactggagagctggtgagtctctccgtggatcgtaccattaccacaagagtcctctggcccacgcacaccctgctctgcccatcagcagtgctccccctcctctccgccattggcttctcatatcctcctgggctgatgtgcccatgctgtgtactcaacactgcctctggctggtgcaagcctggaagggaggtagacggtatggatggctaagcaggcgagctgggctggctgtggcctcggctgtctatcacgctgctacccagcctcggattcaggtcgaacttgcctgcactttctgaacacctagaaagatgcagcccgggcccagacagttcacttctcactcagcaaatgggaaaaaaaaatggagaaggcgctgcgtcctttgaggctcctgccctccagccaccttatctactgtgtctctctgggctcaaatggcgctttcctccagggctctcttggcgtctcatccctctacctccacagggtgtggtaccttcctttgttcctgtggttcccactgcacagctggatctctgttctcactgcctgaaattaacattcctgttcccgtttctcttgccttcctgacttccaggaggtggtggcagttactcagctctgcttccacaccctcgccatgtcttcctcaatagactcaaccctttgtcctgctagttgctagtactcaggtcacaggcagtggaactcgtcttcggcatttagtaagagatggcctttctgactttgtgccccagccacggtgcagtcttctggatctttcccagcagcgtcgacaccgtgagtgctgcctgtgcacgcattcgttgcattcttgctccagatggcagtctgaccagcacgactcaactcccctcccctcctgtccctttctagtaaaattgcctgtatgttaccccaacctctgctgactcacaggtgactgctgtcctgatttttaaccccgcagaataattttgtctgtttttgagattcacataaatggaattgtatagtacacactatttggtgcctagtggcttgaatttagtacagtgttttagaaacacatccctgctgttttgtctgtcagtagtttatttgtttgctgggtgatgttccattgtataattatcctataatttctttattcattctcctgttgttgtgcccttgtttatttccagtttttggctactgtgggagacagcatgtgtagcagtggcgctagctaggcttggacattagtctctctccagaacttgggacaggccattaaggacaggactggtgaatgtgacccagagcttgctgaccctcagctgcctgggacagcagtggcagtctgaccctgggggagtcagaggagggccacgtggtgaccgttacaccccaggagatacggactcaatgagcaaacccctgtggacaggggtcaaggaatctccctcctaaggaaatacagggttttgtgattttctttggttcaatgtcaagagaatcaagttgtgggaaatgctggaaccctcctcaactcagtgcactgagtccctgaatgctcactaaaggagacaggaaaggtggagtgcaggcctgcacagcagctactgggctctggatcagggagggcatcgtacaatatccaaggagagagcaacggaaggaaacaccagttaattcatttaaatctcacaataacatgtcatctctatttcatagatttgaaagctgaggttcagatatgttaaataatttgtccaggggtagcagctagtgtcagagccgcttcttaataactggccacagaactagataattctccaaagataaaatgcaaactaagtgactagtagaaaacattgattatatattagttttatgccaaatgctattcttgccagggtattacagttaaaaagacagacagaaattcttgccttgatggtgccccaggatgagatgaatgatgaacaaagtgaacacatagagtattctagaaggtggtctatggagaaaaataaaacagagaagaaacaggggttgtggtttcaggggtatttgcaagagtaaatatcttgaccaggaaaagcctatgagaaagtggcatttgaggacagacttgaaagagatgagagcatgaccctggggtgggattgagcattaaaggtgaggaaatggccgtgcaaaggccctgtgacagcagtgtgccaaggctgagaaaatgcagagagggcagggtgacttaagtgactgagtgagggggagtcataggagctggcgtcagaggggggtttctggggatgagctcaggtggacctcacaggccatggtgaggaatgactctttgctgagtaaggtgggaaaccatggagggtttggaacaggggagtcacatgccctgagttgcgtttaacaggatcgctctggctgcccagttgacaacagataattgtgggacagaaacatgaagacccttaggacattattgcaataattcaagcaataattcagatggtgactttgaccagagtggctgttccacacgtggtgaaaagtggtcacaataaggttcaattgggaaagtgggacccaaagatttgctcacggataggatgagggatgtgaaagaattgattctgactccaaggatggtgacattgctattcaccgaggtggggcaggtgacaggaaagcagctttgcagggaagaacaggaactcatttttggatacttcacactgggaaatgccaaggaaagctgttagacagctggatatctgcatgtggagttgagggaggggtccagctcggaaatataagcatgggcgtcatcagcgtacagactgtatttcaaacatgagagtggatggggttatctagggagtgcctctgacattctgaggttgggctagacccaggggaggagacagtagaggggcatccagtgaggggagaggaaagcaggaaagcagcggtggactggagggggtgtctggctgtgtcacagcagctcttaggtcaggtgatctgggggcttggcaatttggagctcatttgagggagattttgcagcaaaagcctgagtgggttgggttcaagagaattggggactgtggacacagacaactgcaaagggttgggtggagaggatgtaggccaaaagaggctctgtccagcctgaccaacatggagaaaccccatctctactaaaaatacaaaattagccgggagtggatgtgcatgcatgtaatcccagctactcaggtggctgaggcaggagaatcttttgaacccgggggtgcggaggttgcagtgagccgagattgtgccattgcactccagcctgggcaacaagaacgaaactccgtctcaaaaaaaaaaaaaaaaaaaaagggaaagaaaagaggcttcttctaactctttttcatggcagatttcaaacatatacaaacacaggatgaaagaacaaaatgcttgtgtctccaccacccacttcaacaatgatcttgaccaatcctgctccatctataccattccttcccttgcaaaccccaaacatgtatattaaattaattgatattgccccacctgcaaaccccaaacatgtatattaaattaattgatattgctccacagctcactgaggccccacagctcactgagaccctgtaaaagttttttgtttttttttttttttgagttcttctcccctctatgcttcatttgggataggtgccatggggctgccttctagtttgctgatcttttcttctccagcatctaatgtaccattcatcttatccagtgaactttccatttctgatattttacttttcatttctagaatttcatttgtttggtttttgtatcttccatttctttgcttgtcatgtttatgccttcctttttggtggctcacgcctgtaatcccagcactttgggaggccgaagcgggtgaatcatctgtggtcaggagttcgagaccagcctggccaacatggtgaaaccccttttctaccaaaaatacaaaaaattagctgggcgtggtagtgcatgcctgtaatcccagctacttgggaggctgaggcaggagaatgacttgaacctggtaggcagaggttgcagtgagctgagatcgtaccattgcactctggcttggacaacaagagcaaagctccacctcaaaaaagaaaaaaaaaaaggaaaaagaaaatatttgtaagattaaaaataactgttttaagattcttatcagatagtttcatcatcattgtaatttctattgactatcttttttaaaaatccagtttatgggttatggttttcttgcttctttgtatgcctggcagttttttattagatgctctatatagcgcacttttcattgttgagggctagattttgttgcatttccataaagagtgttggattttcttttggaacacacttaagttgcttgggatcaggttgaccacttcaaagcttacttttatgttttatggcaggcccagagcagcatttagtttgggactaatttagccctactgcagcaatgtccacaactagggcatggcatggatggagtggcccatgcagagtagggaggggcaaggcacgttcaagagctgagaggccattataggaaagatcatcttgtgactattaaagtggccaaggtactaaatctgtttgtccttccttccttccttccttccttcgtccttccttctttccttccctccctccttccctccttcctttcttccctccttccctccttcctccctcccttccttccctccctccctccttccctccttccttcattccttccctcccttcctttctttcctccctccttccctccctccattcttccctccttccctccctccctccctctctccttccctccctccctcccttccttccttccttccctccttcctatctccttccctccctccttctttccttccttcctttctgaaagttgggaaaataaagaactaaattccgtgcatgatcctagattggatcctgaattgggggtgaggtcctataaaagatattattagaacaatttgatgaaatttaaatttgtacagtatattaaataataatacataaataataaatttcctgaattgggccaggtgtggtcgctcatgcctgtaatctcagcactttgggaagctgaggcaagtggatcacttgaggccaggagtttgagaccaggctggccaacatggtgaaccccatctctactaaaaatacaacaattagccaggcatggtggcgggtgcctgtaatcccagctatttgggaggctgaggcactaagaattgcttgaacccaggagacagaggttgcagtgagcagagatcatgccactgcactccagcctgaatgacagagtgagactctgtctcaaaaataaaaaaaaaaaccataaaaatgaataaattttccaaatttgatcagtgtattgtgattatataagcgaattccttgttcttaggaagtacatatgctgaagtattgagatgcaaagggtcaatttactctcaaatggttcaacgacataaagagagaaaaaagaaaaaagagaaagagcacaaatgtgataaaatgtgaacaaagaatgaatcattgttgtactataattcccgggatcccaggaatatgtactcactaggacagtcatttgtcacgttgcttaggaagcaggtttggagtcttgtgtggggaattcgtcgacaccaccagtcccgagtttatgtgcagtggaaaatggagcagtgtggtcagcagtaggagagccagcttccaccctccacctgctgttccacgtggtgggtctgcacagcctggcttgtgagcaaatccatttttccttctctttgggaccaacatgggcttagagatgacatagccttgggcatccaataaattcaaatttgagaatctcaatgattcaaaattgctgctgtcaattaatacatgatgaattcatgttgttttgaaaaaagaatgattgaggtgaccaacagaagacttcaatgtttgtccccaagtaggtaggccaccccagatttccaaccctgggtgcattgcattggcaatctaaatcccaaggactgtgaactctgtggtcattctgcagtttcctctgagagtattcatgggttggggaatctcctgctgaaaaggatattgggtaaaattgctttatgtgagcactagtaaacatttagcatatattaccaagaaaagcaacactgtaagcccaggaagcttagagcttctcaaacagaaggggatgatggagaaaaaaggtgaaaagtctggcaggcaggatgaaggtcaatcaaaaaagggcagctggccacagggaaatatcatttcacccctactagcgtgactgaaaaaaatgtatgttggtgaggatatagagacattgctgatgtcattttaaaatggcatagctactttggaaaacagtctagcaattccttgaaaagttaaatgtagagtttccatatgacccagcaattccactcctaggtatatactcaagtgaaataaaaacacatgcccccgcaaaaacaaaacttgtacacgaatgttcattgcagcatttttcatgatagcccaaagtggaaacaacccaagtgtctacaaactgatgaacgaataaataaaatgcggcatattcataccaagaactatcctttggcaagacaaagaaatgaaatactgataaatgggacaattggggtaagctttgaaaatgtgctgagtgaaaaaaagccagacacaaaaggccacatattgtatgactctgtttatctgaaacatccagaacaggcaaatctgtagagacagaaagtagattagttgtggcagggctagaaggagagggatttagggagtgatgacttatgggtgtggtgttttctttttggggtggtgaaaatgttctgaaattagatagtagtgatggttgtacaactctgtgaatatactgaaactaactgaattgtacgttctagaaggatgaattttatggcatatgcatggcacctaaaaaaaccaaaagagggcagctgtgtatcctgggtttttccttgcttcttgtatgtgtgtttctgcagtccggttgagcagctatgcctcaaccctcgggtctatcctggtcttgaatgttcctgactgttgtcttcagtcttggaaccacacagcaccacagcacagcctgcaagccttcctgggaagatttacacctctaggctgagtctctgctactgcactttctcctccctctcaaatgaaaccgcagtgcctctctgtgtgaccttctcagtcatgcaatgacttctctttcatttcctataagcctctgagctctgccttctccttgccaattccccttagctccatcttcctttggccgtccgccgttgtgtaaatctgtagggaaatgtcattcaaagacaaaacccactgcttattcttctttcttaattgctccttgggaaatgtttgcttctgtgttcttggtgaaggaaagcttaattttgtctgcttttatatcactagtcttttcagattacacattcccaatcaatcacctcttgaatcaagtaattagttttattgtatcagtctatccttcagaatttcattatgcaaatataaacatgcataaatacattcatgtttccccgccttttacacaaaaggaggcacactgttttgtgccttgctttcgtttcacttactatgtctgagaacttttcacatcattatatggagagcttcccctttctttatcagctgtgtgagagtccagtgtcaagatggactgtgtttggtttcatcagtctctgtggaaggatcctggctgacctgtgtcttttgcttttacaaaccttgctggatgatctcacaatcaccttgttgcatgcacacgtaggcagagctgtagaatagactcccagtggggcagttgctgggcaaagggtaaatctctttataattttggcacatattgccagagtgccttctacagggttctatcaactgctgggcactcctgtcagcagtaagagtggctgcttctcccagcctttccagtaaaatatgttaccaacatttgaagccaggtgcagttgctcatgcctgtaatcccagcaactttgttactaacatttgggatttccgcaatggtgtgtgctaataaatgtttaacaaccacttctccaaacaaaacgaaacaaaacaaaacccaaaaccaaaaaaacaagaagccctaattgtagtatctgctgatttccatagcataaatacttctacccaggccaattgcaagctatcaacatgatgtccctgaacacggagttgggaagagatgggccgtagcacccactgtatagtatttctaccacacagatgcaagagatgcaagtagcatggataattgtgaaatgtggtaaaataataaggaatttaagagtttttatttcctttgtatttgtatgatttatttagttataaatttatataattaaatcttagcaacaatctgcatttaacaacctactcataaaaccagctcctaaaaatctggtaattattcatggtcaactgtcaagagtcagctccagcacactactgcaatgctgccaatttgaaaggtagcgaatgccatcccaatgtagttgtcatttttattgttattgttttacttgtttaaggacgatttgcatttccttttctgtgaaatatgtttctgtccttcgcacatttatctactgagttttattctcttgttgatttctaggagatccttatacatgaagctccttctgcatatcttttgtctgtgttataaactgcagtgttttttcccggtttgttatttatcttttgtgcttgcccatggcatttttctttttttctttttctttttttgccatgaagttgttgttgttattgtttcaaaatatagttgaattatttttttcattttttctggtttttttttttttttttttgacacggagtctcattctgtcacccagactggagtgcagtggcatgctatctcggcttaccacaacctccacctcccaggttcaagcgattctcctgcctcagcctcccgagtagctgggattacaggtgtgtgccaccatgcccagcttattttttttttgttttgtatttttagtagagatgggggtttcaccatgttggccaggctggtctcgaactcctgacctcaagtgattttcctgccttgacctcccaaagtgctgggattacaggtgtgagccactgtgcccagcccattttttcttttatggcgtccaaatgttgaataactaggaacaacaggattaaatacattttttttctaatcacaatcaagtttcacatacttaagcaagtttcttatactctaagcagtctgtacaattcctgtatctccttggagttcattatattcaattttgtctttttcttttgagtcagattattatttaaaaaccctctctacttaatggtatcacaaatatgcataatatgttagagacaggcctggcacacttcagctaaaaagaagtatgcatagaggttataaaatatttatcaagataccatcactagttcagtggtggctaaccccaccacttttctgtgactagtattatttcctactggggagtttcttcacttgtgtttgacttcccatgtgggcattgtcttagtaattttgtgttgctgtaacagaatagcacagactaggtaatttataatgaatagatatttgtttgacttatggttctggaggctgggaagtccaatattgaggtactgcatcagataagggaagctctcatatggcaagaaagtttacaggggagagaaagagagggctgaccttgcttttataacaaatccactctcaaggtaaagaatccactccctcaacaatgacattaatccattcccgatggcagagccctcatgaaataataattgcttaaagatcctatttctcaacacagttgcactgggaaacaagttcccaatgcatgaactttggggaacacattcaaagcatagtaggcatgtactggcttagtcctgcattgctctctccatcagacttcaaggcccaaagctctaagaatgatgctggagtgtggtttgtgttcaagaaatattagttgagacaccacattcaaaggtatgaacccctcagatagactttcatctgcatctccaccatccctgacaatgcccattaacatttagtcagcagccacacatttccagcattacttgagaagctgtgcatgtggtctatgtggtgtagcctcagaatacggtcatgcagaaagttctaactcagtgtatctaaaagccacttgaccacttagagtgagcttttatttctagcatctcatttttggttctgactttagaaatgtgaaaaccagatctcaggtatgatatgtaatttacccaaagttacctcattgctactttggcttttagtagtgcgtctggcacatagtaagtcctcaataaaatgaagagcatttgagatgacatgattttcccatttcccagtccagggctcatgtcactgtcctattacaggtatgacccaagatggtggtggctggatagtttccttccaaggtactctttaaggggtagacatgaaaggcagtgatcactcatgccaacaccctatgcttgtaacctgatctccccctggctggtaggccttattctgtcaagatttacccttagaaaagcatatgataagtataacaactacaaaatattgagggcatattatataccagttaatgtgctatgtgtccaatcctcatccaaccctgtctggtgttaatattattactgtcattttataggggtgcagagaggttataggactagtccaagaccagacagaggcaacagtagagccaggtggaaattcaggtctgtcatggtcacaatgctctttgtccgtggggcatggagttgcccaatatattattgttttacagtctttagacacagtgtcttcgcttgacaggaggcacgttcctttatgttgtaggaaatgcactgaacctgaataactctacaggagagctctcatccccccttccaggtcgtccctgctctcagcctgcacctcccattttttgatcaagacagccttgaagttctttatgtctgtggaaggaaggagacggagcttgtttttcacttttgctgccatgattaattatttttaggaaagcattgtgtcttttgagagaggattgtaagtgctgggagaataaatggatcttagagtgagccttgtgtgctccagacttccccagcttgataaacagcttcctgaccagtggctgccagtccctggtctcactggacggacattggctgggggccaatgtctgagttgaatggcgaggactggacagtgcttcttcccagccagtgtggcaatgagcccactcttaagaaggcgccttggcttgggaaaacacattgcacattagatgttggtatccgcggcagggacctgaggctggagtcactgccaggcaccttctgggaggcctggctttccagcaaggcctgcttcacattctcaggagaaccagacccagcataggaaatgccctattgcccaagaggaaaccccatgtcgaggaactgatataattaggatactgataaaaattagaatgagaaggggagggcctaaatgaagggtcatggggtgtactttttaaaaaaaacaaacaaacaaacaaaaaaaacaaaccttcctgcccttctctgcatatgaatatactacatgcttatccaagaaaactttgaaaagtaaataaaaatttcttccaataatttcacccagaaatttaacttctactatttttaaaggagtgtcttttgtatgccaaacttctcctatttttaaataatatatcatgaaaatcattttattttgtaaattggacctcaggtgtatgaaactgggttaattgtgacctatgattcatagtgcatgtattagtccattttcatgctgctgataaagtcatacctgagactgggaagaaaaagaggtttaattggacttacagttccacatggctgggaaggcctcagaatcatggggggaggcaaaaggcacttcttacatggtggcagcaaaagaaaatgaggaaaaagcaaaagtggaagcccctgataaacccatcagatctcatgagacttattaactatcacgagaatagcatgggaaagaccggctcccatgattcaaatacctccctgctaggtccctccctcagcatgtgggaattctagaagatacaattcaagttgagatttgggtggggacacagccaaactgtatcattctgcccctggcccctcccaaatctcatgtcctcacatttcaaaatgaatcatgccttcccaacagctccccaaagtcttaactcatttcagcattaacccaaaggccacagatcaaagtctcatctgagacaaggcaagtcccttctgcctataagcctgtaaaatcaaaagcaagctagttacttcctagatacaatgggggtacaggtatctatgaaatgggagaaattggccaaaacaaaggggttacagggcccatgcaagcctgaaatccagttgggcagtcaaattctaaagctccaaaatgatcttctttgactccaggtctcacatccaggttatgctgatgcaagaggtgggttcccatggttttgggcagctccgccctgtgattttgcaaggtacagcctccctccaggctactttcacaggcttccattgagtatctgcagcttttccaggtgcatggtgccagctgtcagtggatctaccattctggggtctggaggacggtgaccctcttctcagagctccactaggcagtgctccagtaaagactctgtgtgggggatccagtcccacatttcccttctgcactgccctagcagaggttctccatgagcgccctgccactgcagcaaacttttgcctgaggatgcaggcatttccatacatcttaaagatctaggtggaggttcccaaacctcaattcttgacttctgtgcacccacaggctaaacaccacatggaaactgccaaggtttgggacttccaccctctgaagtcacagcccgagctgtatcttggcccctttcagccatggctggagtggctaggacacagtgcaccaagtccttaggctgcacacagcacagggaccctgggcccagcccaagaaaccactttttcctcctgggcctccaggcctgtgatggcaagaggggctgccatgaaggtgtctgacatggcctggagacattttccccaaggtcttggggattaacattaggcttcttgccgcttatgcaaatttctgcaggtggcttgaatttctccccagaaaatggatttttcttttctattgcacagtcaggctgcaaattttccaaacttttatgctgtgcttcgtttataaagctgaatgcctttaacagcaccaaagtcacctgctgaatgctttgctgcttaaaaatttcttctgccagataccctaaatcatctttgtcaggttcaaagttccacaaatctctaaggcggggcaaaatgccaccagtttctttgctaaaacacaacaagaatcacatttactccagttcccaaaaagttcctcatctctacctgagaccacctcagtctggaccttattgtccatatcactatcagcattttgggcaaagccattcaacaagctctaggaagttccaaactttcccacacattcctgtcttcttctgagccctccaaactattccaacctctgcctgttacccagttctaaagttgctcccacattttggggtgccttttcagcaatgccccactctactggtaccaatttactgtattagtccattttcacactgctgataaagacatacctgagactgggaagaaaaaaaggtttaattggacttacaattccacatggcttgggaggcctcagaatcaaggcaaaatgcacttcttacatggcagcggcaagagaaaatgaggaagatacaaaagcagaagctcctgagaaacctgtcagatcttgtgagacttactatcatgagaatagcatgggaaagaccagcccccatgattcaattacctccccctggggtccctcccacaacaagtgggaattctgggagagagaattcaagttgagatttgggtggggacacagccaaaccatatcagtgcactctcttcatttgaccatgcaatgcatgtttttaataataaacatctccatccaatatgaaaactcatactgtaactgtgatttataaaacctttggcccaatctttttcctacaactacacttctctttatctaccttttatttttactttttgcttacttgagcacatgctatacatgcccctttttatgcctctcaggaggtttacagtggtggaatttcatcactcagatagctttccactccacgccctttggatcccaaaatggactgcccatttatctctttctgtgtgaaggaagtcagggttaggagagtcatctgtatatgcctcctcgtttatctctgattctttagcaaaaccaccctgaaacccaggcagatgtcaagtcagcttgtccttgagggtctctgctaaaggagaggccccagtggccactgcagcctccataaatcgctgtggtcaagcatgcatcttgccatcagaccaaccaccacctgatatgtgaaattcacatttgttaattatttgctagaaatctaagaagctgttatttattgtcatgtagttgaaagcctctttccgcctcctccagaattcacttttctttctatctttcctctgatcattgtttttatcctttgactgttcttttgtagttcttttctttattcctgaatttatttaagttgcagatgaggattttggctatgtccacaccccagacttcaccaggaaggtaacttagggttccccaaaatccaaccaaactgttctcaaatgcaggaggagaactctccccttcccctctacccctgccccctcatttcttctcttacaggctttcctagctcttttccaccccatgccccttctgtctctccttccatcctggggtttgtggtagaggattacccagttgcggacgagtcacatgccttatccagtgaaaatattattgtcttatggatgccaagaacaactcctgaatgtacaaactatttttaatgctcatttgagattgatagatatcaggcaaataataaaagtttcacaagattgctacaaataaataattttgaaaacaaaaccaaccaaagcaaaaaacaaacaaacaaaaacaaccttttctgttgtgattagcatttttgctaaactcaccttgggcttttgactttccagacactctcattgcaggtgtttggagctcagttctgttcctccaggcttgtgcgctctccttgaccccaccttttgtgcgtgtgctgtccttgtctgaaaccagcctggagctccctatacagatgtgtcaaggtcaggccaggtcaaggctgagcacagagaaaggagctgctgtaggaggcccacaaggaattttgttggatctgtgagatcagtgtatgctccagcccctctgacatatccagaggagacagccttgagtttgggcccagtactgccacttattagctgtgtaaacttgaaaaagtcaattaattttgcataagtctagtgcaataagtaagagtcttcaagtcatcaccctgttgtgatggattacatgagatcaagcatgtaatgtgtcaccatgataactggcaaaaataagtgcttagtaaatgctgaccattcttcttcttaacaacatcatcatcatcatcatcatcatcatcatcatcaacaacaacaacactaggtgcaagcgccagccccggccaaggccaataggccctgtgtaggttgcgggctacctactcagtctggatgctggtttcctgttctcctgctcctgtctttgctcttgacctgttttcttcttgcctctgcaatggactctgctgctggttgtgccatctcctcaaggttggacccttggaagctgacgtatagctggtaccttccagctacctcttcaacacccctgcatagcttgaactcaggtgacctgctctgctccaggctccgagtcccccaggtgcattttcctgtccttgttcccaccatgggctcagacagtgagtgccttgaaggcaggaatagggggtcctcaacccattccctggcccctgacaagcagctggctgcaggatgtcctccactacttgttagtcaaatgcatgaaacattggatgaaggcaagaaggtgagatagccaggtgtggtggctcactcgtgtaatctcaacactttgtgaggctgaggcaggtggattgcttgagcccaggagtttgagaccagcctcggcaatgtggcaaaaccctgtctctacaaaaaaaatttaaaaattagccaggcatagtggtgtatgcctatagtcccagctacttgggaggctgaggttgggggattgcttgagcctgggaagcagaggttacggtgagctgagatctcaccactgctcttcagcctgggcgacaaaaaagagaatgtctcaataaataaataaataaataaataaattagttaattaattaataaaggagagataggaaccttctcctttgttgaatccaagtttagtaggatgttcctttcttttctctctctttctttttctctctttctctctctctctttctttcctttctttctttctttctccttccttccttccttccttccttccttccttccttccttccttccttttttctttctttcttgacaagatctcaccctatcatccaggctggagtacagtggtacaatcatagctcactgcagccttcagctcttgagcttaaactatcctcccacctcagctttccaagtacctgggactctaggagcaagtcaccatgcctggtggatgttcttttctattgaaagtctagagtaattcatggccaatacttaattttagcagctttgttccttttgaatgagccctcaagccaaaaacatatccatcttttaacagtttcatttatttcctttgaaatcacttcaactggattcaatgcaatgcatttgaacagatgtttacacagtgtgttgggcattgttatgggcacatgactgagaagagaatggtcaagtttcctgccctggacagaactaaaattttaccaggaagagagatgctgagcacctaactaataaatacacagggtaatttcatttttataagagtttccaaagcaattaccatcaccaccaaagaatcagggtagattactgggtctcgacaagtgtgtgtgtgtgtgcgcacacgtgcgtgcgcatgcatgtgtgtgtcttggggaagagataaggcctgaataaggagggacagctgtcctgtggagatctggagaagattattgtagtagaggaatggcaagttcaaaggcctggaagtggtagcagagtcattgtgtttcaggggcagaaaggaggccagcgtgcctgggtgccaagggaaggaggtgagggtgaggaggcggacaggcatctcaagtgcatggagagccacctcttcttgggtccccagtccagggcactttctttggacccaggatgtaggtactgacagctgccatgaatctcggagttgtcagcattcacagcaaagggcatttccaggctaaaatctaagtaaacaagctccagaacaaagaagacaccatgttcaaagtgtgtgaaaatggataacaaataggaaacatttaaaaacaagcactttgtggaaaaccatgtttccttgatgtgctttctgtcatggtatctgaaacactgcaaaaggacattgaagatctgggagggagagttgacaatcttcccaaataagatacagttatcttatttcaaataaaaaggaagcaaaattggcacaagtttgggtcaaatttctcctgtgccaagtctagaatcagcaggtagtgctgaaatcactgtcccacatcccagacatagtgagcattcttttaaggctccaggctcaagtgtgtgcaaacagagggaaattacacttgaaaaaaaagatcaaggaccgtgaattagatacaaccttggacaacaaaagcagcaaccatgaaaggttgtatgtacttaagaagtcaaacacttctgggaaagctgtggggaagagagttggtatatgggaaaaaagtggtaaactcaaaacgccttttgtatggagaaaggcattggccagctttaaaggcactgcagcatcagttgagcaagtgcttttaataaattactctcttttgtagctctgtactttttctgatatggataagctatctagcatccaaagcaaactcatcttaaaccaagaattcaaacaaatgataataaagatggtagaatgcctattccactccatttgaaagagatgcacaaaagaaaatggtaggtgttgcttgcaggagtgtgataatagtgttgctcttctaaactggcaactttatgagtagatcatcaaagccaaggtattttactttgtggaataagaaacgatcacaccgaaaataataaaattcagcactgcaggttttctgccctttataaatgtttttcaaagacggaaccgaaagaatagcttgagtgataacaagcttttcagaaggagctctggaaattaatatgggacaggtgatggagcaagactttcagcatgaagaagcccaggaactgggaaaacacaagtctttacttcagaatcaccccatagcctccaagtagtgtgttgcaggttgaatctagctgaaaatggcataaaacagaatattaatagctatatccacatatcactaaactaggtacattcttgatgttcctgaatataaggagattataaattaaaatgattctgaaaaactacagacattgatgcaagtttctagtttcaaccaggataatatcacatctcacctcaaacaaaaggcattttcttcagaaaggaactaaaaaaaaatggcctttattctatacttgcttatggttctggtttaaaaacaaaaacaggttccagaagactacttattcaaagaccctgccccacattcctcttgaggatcccagtgaatgtggcactgataatatgaatggtttaccttccgtgagattgcattgaggggggaaatattcttagaaataaaatttttaaaaagaaaatatgatgtaaattgaccaaggggtttaaaaaatctgtcaatctcatatcctatacctagcaaaaatatccttcagaaatgaatggaaaattaagacattctcagatagaagaaaaataagaaatttgtcaccagcattaaagaatgactaaagggatgtctctaaacagaaagtgaataataacaaagggaggctggaacttcaggaaggaaacaaaacaatgcaatggttaaaaattctcctcaagtgtttaaaaaattgtgttgaagcaaaaaaatataacatcatctggtgagatgttcagtgtctgtagtggaaatatttatttaacatatttgtattttaagggggagggtaaacagacctaaataaaagtcagatttctatacttcacttgaagaggtaaaatgctgatacagttagctatgacatattatgtatatatattgtaatatctagggaaattagtaaaaaactatatgatgaagagatatattaaaaatgtactatagatatgaatatatgtgtgggttagtatacatacatagttttccttactctgtcacctgagagaacaaagaagcaatgacaaccctctagcaattagcacaccggacacacagatcttggtttctaacaccattcaccaataaaacaaatcagggctccttggagaaatggctgattccaggccttgggggaaaaatatatgagatgaacctggagcattttgtagcaccagaatgtaaggaaatgtgtgtgtgtgtgtgtgtgtgtgtgtgtgtgtgtgtgtgaagagacacaggagccaaccaaaagagctctcaatggccaaacttggaataattggagcaagaaaataataaagtagtaatgtattatcacccaaaataaatatccatgagtccatagtgatataagtaaatacttgaataaataaatggggggaaaaaagacaactctctcttatgaagaactggaaatagttaatacagatactacaacctgaaggaggagaagtgtaagttcctggtccttaggtatgggcctacatagtgattttcttccaaagagtgtagaatagatagggggtgggggaaagtagatttacactggagacacctgccaagcactacttcagccaggtgatcatggtcaacacctgctgtgataaatcgtggtgtgagtatgtaccctggatatgatgtgatgaaaatgacacttcactgctttacccattacccttgtcgaatcatgaaaaaagcctcaggtgaatttcaataagggggtatcatagaatacattgaatataggataatacctaaccaggactcttcaaaattgtcaaggtcctaaaaatcaggaaaagtttgagaaactgtcacaaccaagaggagcctgaggagatgtgatgactaaacacagtaagtatcctggatgggaccctggaccataggaagatgttaggtaaaactaaggaaatctaaataagatatagactttggttaataataatgtatcaatattggctcattaattgaaacagtcgtgctaattaatataagatgttaataagatgggacactgagtgaggatgtatatgggaactttctgttctaccatctcattttttttaaacttataaaaaataaagtctattaaaacattatagcactttgggaggctgaggtgggtggatcatctgaggtcaagagtttgagatcagcctagccaacatggcgaaatgctgtctctactaaaaaaacaaaaattagctgggcatggtggcaagtgcctataatcacagctactcgggaggctgaggcaggagaatcacttgaatttggcgggatggaggttgcagtgaggtgagatcatgccacttcactccggcatgggggaaagagcgaaactccgttaaaaaaaaatcatgagtttaaacataaaacataaaaatatataatgtttagaaagaattcacaggagaaaatctttgggacctaaggctagacagaattcttagacatggcaccagcagcactatccataaagagagaagaaaaagtcaatatactatacttcgttgtaattaaaaacttttgtggtgtaaaagactcggtgaagaggatgaaaagacaaactgcagactgggagaaattattttcaaatccatatcttttttttgtttttttgagatggagtcttgctctgttgccaggctggagtgcattggcgcgatctcagctcactgcaacctccagctcccgggttcaagcgattctcctgccttagcctccagagtagctgggactccaggcccagctaatttttgtatttttagtagagacagggttttaccatgttggccaggatggtctcgatctcttgacctcgtgatccacctgcctcggcctcccaaagtactgggattccaggcgtaagccaccgtgcccggcctcaaatccatgtcttacaaagaccttatatctacaatacacaaaaatgtatcaaattcaacagtaaaaagacaagaagaaaaatgaagaatcccatcagaaaatgaggggaaaatatgcccatgaatttcaccaaaaagactatacagatggtaaagaagtgcaggaaaggatgttcgatatcactagcctttagggaaatgcacattaaaaccaccgtgagatattactacacacctatcagagttgctaaaattgaaaacaaattataacacaaaatgctggcaagtatgtggagaaactggatcacacctacattgctgggtagaacaaaaaatattatagtcattcagataacagtttggcagtttctttaaaaactaaatatgaaattgctgtttgacctggaaattgcattcctgtgcatttattgcggagaaatgaaaatgtatgttcacacaaaaacctgtacaagaatgtttatagcagctctattcataatagctaaaaactgaaaagatgcaagatgtcctttagtgggttaaaccatccacatcatggaatactactcagcaataaaaaggaaccaactattgatacacacaaaaccctggttaatcttgagaattacattaagtgaaaaaaagccagtcctcaaaagttacatactatgttactctatttatacaacattttaaaaaggacaaagttacaggaatgaagaacagattagtggttggtgggacagcagtgaagtggggtggttgcaaaagggccacatgagggatgcttgtggggatggaattgtttcatagcttgactttctttttgtttgtttgtttgttttttttagacggacggagtcttgctctgtcacccaggctggagtgcagtagtgcaatctcagctcactgcaacctccacctcccaggttcaagtgattctcctgccttaggcctcccgagtagctgggattacaggtgccactaccacgcctggctaatttgttgtatttttagtagagacggagttttaccatgttggccaggctggtctcaaactcctgacctccgttgatccacctgcctcagcctcccaaagtgcaaggattacaggcctgagccactgcacctggccaatagcttgtctttcaataatagtgttcttgctgtgatatcatactacagttttgtaagatattaccagtaggggaaatttggttaagagcatgtgatgtttctattatttcttacaactgcttatgaatctacagttacctcaaattaagtgtaatttaaaaaatactggaaaacaacaacccccttaccccatgcagatattttcatctattttggttgtatttatttggtattgacttccacaatgtatatagtatgttttgattgctaatctatgatttattaattgaagacgattttagatagatctgtatctttatggtagagtttatttattgtagctgcattttaatttaaaacttaattactgttgctttgtttccttctggtttctgcatgatttccactgcgtctcttgtgttctgtttgtttgttttggagtttctcacattgagagatttttctcattgttgggtaaccatgactctatcttcctgtttaagaattaggggctgggcaccatcgctcaggcctgtaatcccagcactttgggaggctgaggcaggcagatcatctgaggtcaggagtttgcgccagcctggagggttggagaaactggctgttgcattagtccgttctcacactgctataaagaattaactgagactgggtaatttatgcagaaaagaggtttaattgactcagagttctggaggctgtacaggaagcatggctggtaggcctcaggaagcttacactcatggcagaagggcaaagggaaagcaagcacatcttcacgtggtggcaggagacagtgaaagaagaagcactacacacttttaaacaaccagatctcgtgaggactcactcactatcatgagaacagcaagggagaattctgcccccatgatccagtcacctcccaccaggtccctccctcagtgttggggattgcaattcaacatgagatttgggtggggacacacagccaaaccatagcagctgttacctcatgctcctaattttgtggaagatcagataacaacttagtttcagtttggtggaattgtagcatagataactctgttttgatttttagtctggttgttggggcgtagtgagggggcttagtgggggccctgtgtgttttatctggtgaccctccagtttctcagcgccatgcatttgcttgtcctggcctctgcagtcacctttgctggctgtggcattgtgagggtgtgaaggctgcagattcttagagggggcctattccaggctctcctgtgttcatgactgtcacatcccatcttgggcgaggccaggctagagtccacaggctccactcaggctctctttcccagaccccgacacctctgtcagcctcgttgtaggtcctcttttgattgctattgccttggacctggacagtttataaaccaagcttgccaagaggcaagagtgaagaggtctgttaaatagggaaagagcttggagtctcctgggccatgtgctcagtacacaagttcttacaggtgggtagtcctgtttgggatagttcagacacaccagagtagggagtgagggtcccatgctggccacctttcttcttcacctccctcttctcatgcctccctgccaccacccaacattttcagccttgagaaattccaagtaagccccttgctcagggctgggaatccagttggcagttcgggaggcggtggggtcagagttaccgcttctttccgggcctttccagaggttctgctgctcccccaatacgccttccattgtgctccagtgcgtccctccagcacattcccacagttagattcttctggggactgttgtaggcacatccctgaaattcccgagggatctccccctggctagtgtacttccttttctcaaggtatgtgggaacaggagctgtctgccgggattagcagcccacatgatttcccagtctcaggacctgtttcctgttgggagcccctgagctctgagacatgtggttgccaagtgcttgcagcgctgggtgtggtggagccccaggctgactctcctaggtggcagactcttgggggcgagctctccccagggcggggacaggctgggggtggcgggctcttgggggtgggcaggatctccttgggtgaggggtgtctctgggggtttggctctggggaaggggttctgaggagggggcagattctcctggggaggtgggctctgggggtggggagcaggttttcctgggtgggcctctcctgggaccaactctccctggccgcagtctctcttggccacgattctttcctccacagcaacatccatgtgcagaggtgctagagctgccagtactagcttaccagcgctggctacaagatcttcaggaactttttggcctggttgttaaccagagcaactattaaaaattatagaacctcaggtaagcaaattaaatcgcaaacaaaagtaatggatacacaaaacttatactaccttttttatgacattttaccatttcctgtgcccttgaggctctttacgttatggtacctgtgtggtggaaatactgtactgggcgacggggcagctgtgcttctctccccagttcctgcttgtgtgggagtatttcaccatggaaatcagcaaatcatgcttagttatttggacagctggttattaaacatttaccagcacacaccattacctgagttctatcagcttattaaattaaaaaataaatggagccctttaatcacattgttcttattttattttattttttattattttttagaggtaggctcttgctgtgttgccccggctggaatgcagtggtacaatcatagctcaccatagcctggaactactgggctcaagtgatcctcttgtcttagccttctaagtagaaaggaccactggtgcttgcaccatgtctgactaactttttttaaaaaatgcttttttgtagagatgggtccttgctttattgcctaggctggtcttgaactcctggcaagagatgcaagtgacccttgcgtctcagcctcccaaagtgctgggatataagcatgagtcatcgtgcctggcctaatcacattgttcaagcattgtgcaaatcaatggaagcctagctcacaacacttctggtttaaatgcaggcacacttcccctctgcctggccctgactcctgctgccctctcctactcagttctctggcagctcatccccctcacccactctactccattccctgcctgctttccagtctctcgacctggacaggttttctgtccctttccccattgtttctttgaagtatttattatgtaccttcctttatcctctcagctaaagggtttcccttttcttgccaaggtttgtgatccatctctctcttctcattctcctgattctgaatttatcataacatttcctgggcacaatttaaatatgcttatttgaccttcccaggctgtgctaacagcaccaccaccactgctgctgccgaaaagagttagtgatatttatctacacctgtacctgtgccacctgtgtcccatgccagagaccccggagcactccatgggcaggtcccatttaatgctgatacctccatgagaaatgagtgtttggttgaatttaagtactgtaagggaactttttagactgccctaggtggtatgtgaaacctgagggctttgtggttgtgccaaggggcttctgagtagagaagaagaagggataccagagaagatgagactcacccacagcccttctaaccccagacctagcagagcatttcactgtccagaaataggagttgaaactgtggccttcagagcaatgttttaacctggctttagtattcttactagctgagtgaccttgggcactctgtgcctcaatttcctcatctgaaaaatggggataatactattaccttataaggttttttgtgaggtttaaatgagttaatgcacataaagctcttcaaaaagtgttcaactaataaatattagccattgtcattactgaggctatgtgcaaaattgtacttaataaaataatgcttctggtaagaggttgaagaccacatatgtagctctatggcctttattttatagttgagaaaactgaagctcagagctaagaactggacacagccagtgagcagcagagtcaggactaaatccctttctgctctgaatttttcaacaaatggtattaatcctcttctttgacctggaaggggcatgacacctacaacatttgatacccatggcatttgacacccacaccactcaacacccttgtgcctttattttgattaaaggtgtgcctttaaagtgatgagaatagtgtccaaataaatatgacagaacccttctatccattttctctgggaagaaatgaatattaatatctctggtaagatttgaatattaaacaaagagaaagaactagcccctttagtggatatagcatgatctggggaacaaagagacagcccagatgggagcatgttattggagagggataaggagcgtgcaaggtaaggtgtcggtgaacaaaagttctctgtaaaagaattggaagggaagagactttattccactaagcagtttgcaaaatggggagatgtgacctgtggtctaaaatgaaggttccttccagggagcaaaaggaggtttcagttttgacagcaaaagttcctgtccgggttcccactcaagtccatttatgcaaatgaaggattcaaacttgcttagttctaattacttgatgaagctaagttctgattggttggttcaggtgagttctgaaagtcccaaagttgaacagaggtatgggttttctgttgacacagagtacatctgtgatgtctagtcaataaatgaccactaggctcaatgttaaatttaggcccagttagccactagggatccatcttgaaggactggctctttcggtttcatattcattcccatgaccgaggcaggacccatcctgcagcttttgcccagcgggtaggagaccaggcttgggaggccattaagtcaacttcagacactgttttactgcccagggtggaggaagatctctaaactaaatgcctacagcatccacagctgaatctggctggcatgtaaagaaccagcagtaagcgatgtgcctggtgtgctggggtacacgaacggaggcgagccgggccctgtagtgatagtcagtttcactgggactaccctactccagacaggaagtcctcattgctgacagcacttaggagcagtgcctctccaccagaagtgtattctcagcaggggtggatctgagagcagaatacctagtggagaagaggggtttccacttgtggggtagagctctttcaagcacccgggccacattcagagaagttcccctgcactgggctaaatgagtcaggtggcctcacttctctcagacacatctggcaacctgggcagcttttggggtgacactgcaggaccacaggagggactccttctctctggcattctgagaggtgaagggcttcacattccagtgatggaaatcttggcaacactagagaaaggagtgcagctcctacctaaccagtgagagaatattatacatgattttgtataatctgatttgaaacttgaaataatgcaacattttcttagttgaaaaacaacaaaaaatacataatttcaaagctgttcttgggggcgaggtgcggagcgtgaactgtctcccacttcagggggtaagcaggtagacaggaatgtcaccatccattgtctcgtgggtgtgaatcactgcttctagactcctgtgcttttgataattattgcaaagtcatttcaacttttgctgtgttatgatctttaaaacaaatagtgtattctactgcaggataggttaattgtcattaagaggtgattccagtggtattgttaaaaaaagtacacccacaatcagtaaatttagaaagaaagttaggtgagataaaatatcatgaagatttaaaaacaccaggaaataaataccagtctgctaattttatgacaagcatcccaagaaatattggagatgatgctgagaaaataaaaatagcattaaagatcctcaaacagcccctgttcctctgactttgcagcatttggaggggaaagcactcttacattatgagggcctctggagccccacctaaatccttaagtgaaaactcccagggagcatcattttctgacagttgcagctggattagcaccacgtgggccagtagcctcagagaagggagtgtgcaatatcagcttcctccagagagatgccgatgggtccattctgggcccccgtttccatacctgtagcctcttaggggacacagaatgactgggaggtgctgcctattcacctgtggaatgtgggcacttctggggtctgactttctcctatatagctctgtagcttttgaatacctataataattatgtacttgtattaatttttaaaaatctattaaaaagaaaaaaaataaaggaagaggggctgagctctgctgtggaaatcagatctatttagaaagcaagaaggtctgtggacaatccaatacaaggtggcccagcctccataccacctccagctgtccccaggctgctttgcagtaacaacctatgggcaaatggcagcgtgcgcctccgtctttctgccctatatgcctgaagtcacagcggtccttcaggagtgttatgactcattcccatggggaggtgggggcgtgctaggtgtcttagtccattgtgtttgctctcataaaataccatagactggggggctttaacaataggcatttatttcttacagttctggaggctggaagtccaagatcaaggtgcagcagatctggtgtctggtgagggctccctttctggtttgcagatggccgccttctctctgtttccacacatggtggagacagggagagctctgatcccttccttttcttataagggcactaatccatcatgagaaccccacccccatgacctcatttaaacctaatgatctccaaaggtaattacatagggggttagagcttcaacatgcaaatttggcagggacagggggtggggaacatgaacatccagtccattaccatagagatattcaaatgggggtaaatgcttctgtggaaaatccccccgtgggaggctgctctgggctgtgtgtccaccccaacttggtgctcccacgagactgtgggaaagggtggcagtcctctatccccagtatggccttcagcatgtgcagtccctggcctggctacctgcagaagcccacaggaaaggggcagccaggggttgaaggagaaaagaggagagaggggtggggatgagacactccattctgaggagaggtccccaggaagaggctacgcagattctttggaactggaattgcctgagaaggcttaggacagcgctgctcattagaccactgcctgggaaatggccatcagctgagaatgtgggaccttagtgtccctgtgtctgggggagtccaagagagagagatggatactgaagattttgcaaagtggcatggctgggtgagtgggccctccaccaggagacactgactacaggtgcttgctgggcataaccgaaggagggcccggcagaatccagaccctccccattgccgtgagaggctcagggggctagcttatgaggaagagaactaaaaactaggggacacattctgaggatacaaaatgcacaatgagccctcatttagatgaggggtagggtcttaaccaaactccagcattacaccccagcctttccttgtggttctatgttgtcatgcaccatgtgcttagctacagctctcctgggtgctgccttccagagatgggaccacctcagtgacagtgaagagattaagtgtgcaagctggggacagcgggcaagtgattaacatttcctgactctgactcgtcctttggagggtgatgctacatacagcccatcatacgcactatcatggcccaatctctctgaaagtgaaatcacttctccccactgagctgcatctggaattttagcagcttggagcaatgcaaaataatggtgcttaaactcagaccagcctcctcaattttgagctgggcaatccattacacatacattttaggcagaatgggatcctggtaaatttgctgtctgtgtatgtggcccacaaatttccattcattgaacagttgtcatttttaagagctgcagggcaaaaaggttatttgttgactttttgttttttgcaaatgatattaccttgcaaaagagcttaccctgaaactgaaaagaatgattctgtgttaccatatgcttttataggcttagctcttgtctgtgggaagtttgcaagcattccctcctctgctccccattcatttataaagaaacctcccacatggtgctattaaaataaaaacttactcatatgcttagtcaatgccgagcagaatttctttcataggttccgtatgaatgagttctgaagtaacaggtttagaaaatgaaactgctcaaaaagaatatgaaaatgacttgaaaaggtgccagaaaatactttgactgtgtgtgcatgtgtgtgcacgggggtgggggaaatatcagatcatgggaaggttccaagaccttcaggttataatggcatgtgaacaacctcaggagttggtgtgggaataaacgattcaggcttaaaatgagaaactcctgttatggacaccacgggatgttctagtcaacagatctaaacacgtggccccatgactacctgtttatgtgggtgtaatcaatgcccagctctgctattcaccagctgtgtggcctggggcaagttgctccaccaacctgatcctcagttcccttgcctgtaacatgctgataataacagcatttattccataggacataggatccccacaaccccaattccttggagctcaaaaattagatgaatcttgatccttgttcacagtactttccaccacggatccatccatgactttgtcatttatttagttatgtaactagttatttccaatattgtaatgagcacccatgaatctaccaccaaacaaaagctaagtctaggacaataacctacatcttatcagctagtccccagtatcttattaacctcttctccccacttctaaggtctacaccatcatgaatcttgtgttcctgatacccctgcttcccattttatttggttttatgcttccatatgtatttctagaaagtaggtatatttttatcttaattgttttttaactttataaaacttttagggacttacttttttccatttaatgttatattgctaagagtcattcacagtattgtgtgtcattgtaatttctttgttctgactgctgcatagtagtgtatacaaataaaccatagtgtaatcatccatactcccattgaggggtacttgggaaaggagagggtccagacttttgctagttagaacagggctgttatagtcctactggtacatgtcagcctttgtacaagtataagagtttctcttgggtatggaccttcaaggagaatcatgtcagagaacatgtgaaagttcaactttaggagacaatgccaaaacattctctaaagactctgtgctaatctacaatgccacaggcttcatcctctccagcacttaattgtgttaggctttttactttttgctaattgaatgagtataacatgttatttcattgtgattttaattttcactttttttctttaacaaatttttttatttttagtttttgtgggtacataataggtacatatatttatggggtacatgagatgttttgatataggcacacaatgcataataatcacatcatgggaaatggggtatccatcccctcaagcatttatgttttgtgttataaacaatccaattatactcttttaggtatttttaaatgtacagttaaattattttgactatagtcacccttttgtgctatcatatactaggtattcataatttttttcacttttctttttgaatcttttcataagtttattgggcatatatgtttcctcttctgtgaaatgccattggtgctttttttccccattattatactggttatttgtgctttgttaacaaaattgatttgtagcagttctacatatattcttggtactaaacctttgtggttgatattatgaatatcttgtcccagtttttactttgtctttttactttttaaaggtatctcttggtgaacaaatgttctttattttgacatagttaaatttatcattttatagtcaacaatttaagtgcttaagaaaaactttagctgcgtgtattagtccattcttgcattgctataaagaactccctgagaatgggtaatttataaagaaaagaggttaaatgactcacagttctgcaggctgtacaggaaacatggttgggaaggcctcaggaaacacaattatggtggaaggtgaaggggaagcaggaatatctgcatatggccagtaggacagagagagaaggggatggtactacacactttaaatacagaactagggggatggtgccaaaccactagaaaccacctctatgatccaagcacctcccaccaggcctcacctccaacatttggaattacaattcaaaatgagatttgggtggggacacagagccaaaccatatcactactccaaggtataaaatagttacctgtattttactataaattataaagtttcttttttgacatttaattcctgaatctatctagggttatttttcggatatagtttgagagagatattcaagttcattttttcccatatgaataactacttttttccacctccatttgtttatcagcctcctctcctcactgacctcctgtatcctctgtaataaaccaacattctttatttgcatccatctttttctgggatcttattcataccccatggtctgtttttctgtctctgcaccaaaactacagggttttaattgctccagcctcataaaagtccagacatcaataagggaaacccctgatcactaccttttcagaaacatcctatttttggtcttttatgctttcacataagtttagaatcattttttcaggttctatttttaaaaaaattattaggaatttgacaagaattgcactgaatatatagatcaaattacactattaaattatataatccatgaacacaatatctctctccaattacttagccctttttaatatctcttaaagttttacacttttccttctagaggtcttgaaaatgtgtccattgttaggtttattctaggagacttgatattttaatttttttttttttttttgaggaagggtcttattttgtcatccgggctggagtgcagtggtacgatcatagctcaccacagcttcgaactcctaggtccaagtgatcctcctacctcaccctcctgagtagctgggactataggcacatgccactgtgccccactagatacctgatgttttctgatgctgttgtaaagaatattgtcttttagcctgggcacagtggctcatgcctgtaatcccagcaccttgggaggctgaggtgggcggatcacttgagatcaggagttctagaccagcctggccaacatggtgaaaccccgtccctactaaaaaaaaaaaaaaaatacaaaaattagccatgtgtggtggtttacacctgtaatcctagctactcagggggctgaggcacgagaattgcttgaacccggaaggcagaggaggttgcagtgagctgagatagcgccactgcactccagcctgggtgacagagtgagactctatctcagaattaaaaaaaaaaaatattgtcttttaattaaactttctagctgtttgatgtatgtaaattttatatcttcactaaatttaattgttcttaatcatttgtttatggattttgggcattttctatataagcagtcataccttatgtgggtgataatggtttctttccctcataagatgattttaaaagtgaatggggttatataaacaaagcaaacaacacagtggttggcagctagtcagtgctcagtaaatgcttgtgactactgatattatcgtcattactcattaacagaagaattttagaaatttctttaacaaattccttcatgttgaagaaagaaacagaggcccagaacaagtccatgatttgcctgggatgacatgacaactcaatgccaggactgcacctggaaaacctgggtctttgggctacaaagtcaagtgccctttcttttaatccccaacaaatgcaggcttctgtctggcataaacttttgcaattgtagtgtttacatgaatggggctttctggcacatccatgaaaaaaaatctattaaatcagcagcatgaattaagctctttctgtgtgctgggcttcccacattgcacacgcttctagcagaggaagaatttacaccctgcaactcagaggggcagaaaatgataatttatttccttttaaatattctctatatggatctcatcatttcctgttgatggcagaggaaggagggagaaccttaaacttgcccattgaaagcaacttagactcttttggtctaactcactttcttttgggtaaatacacagttaaataaaaattaagatttccttctcaaaggatgtctcttcactctctatgtcccaggttggcagctggaagagggaaacaattatggattctcacagtgtggagtggtgcctctgaactcatcctgcctttgagacatagcaggtgctgattgagctgggcctggcctgatcatgtctttgagcatccaattctggggccactaggtctagctgtctctgctggtgctttgggacctccactgctcagatcttcctggccccaaagatctctaaatctcagctttgtctgtcatctgtctctaggctctgcaaaggtgacctctcagcagtctggctcgcagctacaccctctgggggcacgtagaacactgagacccctttctggccacagtgtagcagaggaagaggcaggctgtggggcacatgtgaggtattctcagatactagctcagccttaacttctctcatcttctcttctctctgcatccctccctccccaacttgcctcttggccagaagagtgtctccttcctgttgggtggggtttccctaacttgatgtcctctgtcttctctttattcaggcttatagcaagctccacagtcacactggcaaggcctagctctttgaagatgaagggaactttcagaatctagaataatgtgtgtcctctttcaacaaaacttgacattggaaacctgtttctccatggcctctaaaaatgtcagttttggcatgcaaatattttctaaatattatcccaattacccatggttatggctgcctttgggattatgatgaagactgtagttgtgtagaacatgtcatgctcctgactcccctctcgggatatggaggccactgtctttgtgagtggatggagctccttcctctgtccatctcttaactaatgaaagccaggtctgtctgttctcagcagtctttctctgcctagccactgtacaggacactgtcactaacacgtcctcaaggaatgacctctgacttctggcctgaagatctctgtggcctctattcaacctttattgagagcttattatggttacagctctgtgctcgtgagaacccagagagagcgagacagaattgtcttcaagctgctcaaagagtaaaatccatgcataaagacctggctgtatcacagctgtgcttatgatattagcaaaatccagtacaactaggaagaacatgtacagagaaggaaggaaaggcaaaactgttgggtctagttttcttggttcctacatgaaagaaggctgggcaatatttaccctcgataaagttcattatgccttgggtatagtaaaaatctgaagttttgcctctgtagaccactattctgccagggctgggtgccagagtgtattttacaatgctgacgcctgtccgagacagtgggttgtggtttctgttccactctccaatgcacttttgggaaggcaggtgactgggatggacctgctctagtcatcaaatgtggcaggcccactttccattgccaacaaaagttaagtaaattaaatagggccccaaaggagctctctaggagttggtgtatcatgaaatgtgaagtgggcttgcccctatgcaagaactaaaagaaacacaatttagttatctttggcttctgaggcatcggcagagttttctgctgccaatatgagatttcagtggagagtagggtttcccaaatcatgttgaaacgtgacattgttttccttaggcccacagggccttggcctgacactgagcatgtattcgtgtgtgcacacacgactgaccactttctgcacgcttcttacacatccgccatgtgtccgcctcagccagtggaagccctgtgccactcttgagatgcaggtggctgtttcttgctgctgtcactgttactgctgctgccgcttgcagcctaattcctcgctggtttcaaaatgtgtctcagagatttccccaaatccatttctccaaattctgagttgttcatccatggataacaacaggatggcatggatgtaggcactggtaaagaagcacagaagcatgtactgagggtgttaattctgaacatggagagactgcatgttctgaaacacatcttagcatttctgtgtccacatatgtgtattgcatttcaagcatttttattattattattattatttttgctgggtcgtgtcaatagaactgacagcatcctgtgaccatatcttcacctttagtgctttctaagtaaaactcagtgtcttaatatagccaaagggaagaaaatcctagtgagagaatgaactttttctgacattcctggttggtgaaatgcaatcctcttttcctggcatttggtgaggataattgaatttatgtctggtaactaaggggatgctcgggagcctcaggaaccatgagcaggaatgaggatggtcagaaagcacattgggttatgtggattcagtgacacaaaccccaagaaacctggtggcttttggcactgcatgtgattagagacaaatgatctattttcatcttctggaaaaatcaataaatacatatataaaagagtgccttcaagtcctttgagctattaagaatagctaacgttttgattgcttattgcatgtctattgctgttctaaaggctacatatgtattcactcatttcttcttataacgtccctgtgtggcccacggtcatgttattttcattcccattttacagataagaaaatggaggtcacgagctggagaactccttgctcaagttgcatagctaataagggacttagctgggattcctggccagcaatgtggctccaggcctggtttctaacttccccttcttggcaaccaccttcacagaggaatgcaagaggtgagtggatttgatgtgatattttatatcatgcctatttctatccactttctctggagtccactaagattaaagaaggagagaaattctctagttctacaggaagtgcgggctgtttccagtgggtccttgaagtcctttgtctgtttccagtttttccttcaggtcttttgagcccagcttccctctggccagctcaggctcagggagacgggcatacaccggtggcctgggtgacagtgtgcagctgatgagccacaggacttgggcaggccatagtgggtcaggagagactggacgcttcgtcttttatgcttctgggatttctgttgtggcttctgttttcaccgcatttcaaatcctttaagttaggtcatatggggaaaatgcttgtgcttctcatttatctccctggaggctagcctggatctctgatgaggaggagcaccaggccactccataaccaccgggctgcaggatctccagggccacccaggaagccaaaatcagaacagagctccttgctgtgggggctttgctcaccctagttctgggagccagccagctctatcttggggatataactttccagggacaagagatgcctgattttgtgcagacacctgtgtcatggagagtatttcttatgttccaagcagagaagttcaaatttaccagtcttcctgtcactccacccccaaaatctggcgaccccactcagctgtttttcagggcccaccctcatggcaccttctggggactccctctttgctactgaggttgagacctagcactaggttttgtgctagaagcgccttgggggcagaaacccccatatgccagctgcccaggtcaggactgcatgttttcctactcaccgccaccttgccttgtatagaagaggtgtggccacgtgcggaatccgcgggcacaggcagcgaggccaatgaatggtatcttgcctgcggtctgctcttgggaagggtcctctagtcccggtgtccagggacccacaggctacgtcacatagtctccatgtcttcttgtgggaaggtaccgtgtgagtctttttaaaaagtaatcttaaaagagaacatctttgactgggcgcagtggctcacgcctgtaataccagcactttgggaggccgaagcaggcagatcacacggtcaagagatcgagaccatcctggccaacacagtgaaaccccgtccctgtcgcttggaatccctggaagaaagcagaaccgagaagagaagcccgggtttaacgctgtggtttcttttttgcaagataaaaccatgtgatttagatatatgcaaacaaatcttgagttaaaggaaactgagtttcaaattagataattgtctctgagaaaggcattcatatatctcatatttcatttctaactttttatcatagaacatcttaaacatacaccaaaatagagaaaattataatgagctcccatctgtcacttgccttcaacaatgatcaacttatggccaattatgtttcagctacaacccaatctcgccccattctaatttttttaaagcatatcctaaacattgtatcattttatctgtaaatattttagtatatatctctaaatatatatgaactcttatttttaatagacataatcgtaatcatcatgattttaggaaatgattttaataaaaatcacacccaattcacgaagttaaaaaaccctcccaatattcacacccttctcattactcttggttttaaatgacttttcctgttgtttgaagcctgcgttgcagtctgactctgatccttccaaaaactgctcctagagaagctagaggtacactctgagattaagctacctcaacttcaagcctctggattctgggaggagttgagtccaccctctgatctagagtttccaggcatggctttgtgaatgcacctaccttcttcccagatttttgcccgtctgaccctcttacatgagaacatccccatacatggctgtggaaaatcctcaagtgcaatgaaggcaagactgaaaacagagccgctgccaaacagagcagcaagttgaagggcaagtgcctgtcaacacaatccccttgaaagactataaagagctgccaaaacatgagatgcatctgacatccagatagtattagctgactgcttcccaaatgggttagctgtctacagaaacgccctaggtagctgatatgaatcgcaaatgtgctgtgacttgattaatttgtaacagtcagaaattaggtagttcagtgctagtcatgctcaagcttagtagtagctggtttagttgttttttgttttttgtttttttctgtgggtaattggatctaggatgatagtgtaccatcccccagcagtcatagaagacatggtaaaaactagctttacacgggtcctggacttgaggtcacgggtgtggaaggtgattcactagggagttggctcttagcttagtgggtcatgtatttctgagaagcttctttcctgaggtttacagtcagtttcagaggtgaatgaactgcttcagatgatcagaaagatacactctgtcattattcccccaagaataatctttgcttctgtagttacattaaagctaaattttgctgccagagtaggagccatccattatattataatcgatgacatgaatgttttgctcaagttcagatgtctaataagagtcattttctttccgagggagtgttatcagtttcatgaatatgcgctctgtatttcattagcattcttctagcaaaacatgattctgagtcatttctgaaatatctgctctcgcctgcaacttgtttctcagtttttacaaaaattgccttttctacttactggcagaaaagtttgataccacacgagcctaaaatgggtatgctgagaaaaaacacagcacacctatggaaccgtgaccacaacagtgcatcggtctctgtcccaccgtctcattcgaggttaatccctctccacagggcggcacctcagcagggaagggcgagtctgaggactgagggtaaacagtcatgacatgggtattcactatcatggctttcttagatttttaagccagaatgaagttcagagagcttgtcagaggatgttgaatgaacagaaaaggaaatttggaacccatatgaaaagagctgctttatgaatcacagagagcttttgagttccagcttacagtaattcaaataccactcacttatattcaactgagagcagctctggcccagccttgtcccctgaccccggggacactttctctaggatgaacaagagaaggtgttctccactgtactagctgccagtgtgtttctttcaaccaaggaagtatccatgtctcttattctatgtcattattgtaagaatggtctaccttgatccttagaagccaaccaggatggagtcccattttgcagagtctgctgtgactgccagccacccctgtaccatggacttccacagcaatgatgctgtgctgcatctccatccaaagggattgcatctgttttaattgcttgactttcaaggacactcagggacaggtactcttccataattctacgtcatcccagtttcacaggggcgtgaattccccatcccctgcaaggtctactgctctccaaagtgtgtgtctttgagatggaggctcttcacagggttcaccacctctgcaagtagggctgtgacaactcagccttgtgcactgccacaaaaggcccttcaagagcttctagaaatttctggctcacagaagccactggaatactgtaaatggagttggttttggtggctctgtcctttgatgggaggctctgtctcctgaggccaagattgaaggcaggatctgaagattgtgcgcctggatcaactctaatcctttccagcccaagagagttgttcttgcttcttcttggactgttgtgagaaacttccacactgactgcttggaagtgtcacatgttggacctcttggtaccagtgtctctgacagactcataccactgggagctcagagcgagtggctgaggccagcagagctgaacacttagtgccctgtccctgcattctgtgggatcaagaatgaactggaagtaggatgccgccctagaggaggcacaggtgctacagaggcagctcagctcaggaagcggacgtgaaccccttcctaccccccattagtgctgtggccatgaggccccctcacctgagggggaacacctctgtcagcctggctatctgccaccaacaaacacttttcctgggaaggggcctggattcctccagttgagcctccttagatgcacaggttgcaccagggtggaggccacagccaaaaccaaacagtgtagcatgaacaggccaggctcccagagtgggaagggaggactggctggaggcagcaggaggctggagccacatttgcctgcaaaaagtcttttcagacgcacatctcaggccagttacgcaactggctcctggatccctctgcccaggcccagtccctcccattgcctctcagtgtaaagcagggaatgctgcaggatggagagtcctaagccttaatcgtggatcttgggattcagagtccagagaggataaagaagcaaattcacagtcaacacttcctttttttggatgtttaccatagtgaagttttgtgcaaagtgctatgcggacatgatctgacacatcatgttcccccaccctcccggcccaggatctgaaggtccagcaggagaggcaagccaatgctaaccaaggctcaatctgatacagggacacagactgctctggacttccgtatatgcctttaaaaatatatatatatctttaggctgggcgtggcggctcacgcctgtaatcccagcactctgggaagccgaggtgggtggatcacttgaagtcaggagttggagaccaacatggtgaaaccgcatttatttattttatatatatataattttattaataaataccctggaaggaccttgttcctttaacgtgctggcacctatagcagggaccaaatttgtacttttacaaactgtctgtactggtctaaggaggagcagaggcgcacatacaatagctgcttatgcagaatcactggaaaacaggtgattcctgaacgttgctagatgaatataactcagaaataacccacagcctagattagtaatctgtgaaagttggagaccaaatgaaatttgtttagcaataaaatgcttttgaagagaatttctctttctttgatgttcttgctcattactgtacactctaatggtgttgggctcagaactattgctcaatagaggtttgataaatgaatgctccagaagacacacagaggctatcagtgtggtcgttgtcaatgagtgtcccagacattaaataagagcctgcaatgcctgagagccatgcgcagagatcatgggactgacacctggggagaggttctgaagggacctaagcacacagacaggagggaggtgtcatcagcagattcatccagccccatgttttgtagatgaatagttccaagacactttttaatagttatccaatcctgtatctcctgagcatgctcagtgccatagagcctcagtttccacatttccaagcagacttttctgttctctcataagcacatttgagaaaggacttgtttccccttgctgtcataaatgcccttgctttcaagttcaagccaaaaagaagcagtgcaattgttcttcaagctgatccggtgcagaggaaccgcaaatgccagctccagctatggtttctaattgaatatgactttctttgtaaatgcctgtccttgcccccagcagcaaactgacaactaggacttgcctttgtgagctgaaatgatgtcgctgataaccaacagcttgtattaatttttcctgataatctcatagtacttttaatgagattggtggcaaacatgccattctggggcaaattaatttgtccttgcaaaacagagtgtcagcgatttttatttcctttgtctgacgtgtaaatgggttgtttccaatggcaattgatacaacctagtattttcggctgcactgaagggagaacaagattttgccaagagcaacaaaatcagcacaaccacaattaaagcagatgatcgacatttggaaaatggtctgctgatgtttcttccttcgttttccatgctgaaataggttgtgatttagacaagggccaaagagatgaacaaggcagccagcggctgctcagcctccatgtagcctggtcatggagaagcaaaatcgacatgaaatgtgaccctctctcttttatgtgctttcacatgctgtggtcaggaaccaagtactgtatttgcattcactgctcaggcactgtgcggtgacctgcttttatgccactttgcattgctgaagtgatgtgggtgaaaactggaatcctagttagaaggaaacatggcatccgactcttccattctctcatttccaatgtattgtgttgcctctctcacccgccaaagaaatgaaatgtgattttctaccagagttggaagagttttggccacaatataagtcattatggcagtttccattttctttgctatacattttgaacaaggaaccacagttcatggaattgcattgaaaattaacagcttttttttttctttttttttttttggccaagctagccagaaaggaacttgcatgagaaattcactaatgctaatgcagtttttcaagtggtaatatttctagaattttaattaggactttttttttgctttgaagggtcccatcacagaagagaaaggaatgctaatatttgtctttgatggccagcagggtcctggaggacattaacgttttgcaagctgaatgaggtcttcccactgacacgagcataaagagcaggtggatttaacagctttcattccattttctatttagtttaatcaagataccagttaagaacaaggggaggctgctcccagagcttctctgtccttttaggggttgaccctactggctcggctggctgtggattagaccacacctgctacaaatcaacaaataatgaacttcggatgctgagaacctgaaacactacataaaagagggcataaacaaactcttctttttcaacatatgatgggcgattgaagcggtcagtggaagatagctgtgcacaagaatgtgggcctcctcccttgagccaaggtctcagttttatgattcctaacttagagttaaaagaagcaagccatacaggtaaatgattatcaggcagagaggcctagaatgcattacagttatgcaaaacctgggtttttcataggtgtttttaatgttggtgtgaacagtggagccaaatagcatcttgtagcccctacgtgggcacgattctttcctgggcgacaccgtctgcatgccccatggtgacattcctgtgcgcttgctacagttggctagtaatcctggctttgaagaaggttttccagtgccaatcaccatgttcaagacaatgtgtgggccagtattctgggtcatgcgtcttccccaggagctttggttaaagtgagtttgaggaaaatatgggtgctctcagatgctcacagaccacgtggatgtgaaatttagacttttatttggatgataataaagacagactttaaatgttttcagagtaactggacagctctatctgtctcaataactgcaggcagttcaaattcagcaggaaactactcaggttcctcctagccctgccccattctttataacatggaaaccctgattccccccgccgaacactttccttcaggtagcaggatttttgcttcaccgtaaacacaccaggatcacggatgatgatagcatttattgcttggaataaaaagtgatttgcggccctgtaaataggacagcaaatagttttgcttttgacctaaggctcccatgtcacttcatgatttcattcatcttcatattcaaaagaaggataaataaactgctttcctgcttagtagcttggtcatctgaaatccagtatctgacatcaattcccagtgggagaaattgtgctttgctgcgtgtgtcttaactcagtctctgatgttctggttctgactcaggatgttggtgacagctgcaccacatatgccacgtctttcatgctagactaagaccagacatcttttctggtgcgcatggagtcacactgtgacctagaagacagtgctttgaaataatgacaaagcacagaggcaaggaatgaagttgacattgcataccaacggcatcatcaaatttgtcctcaaatgtcactgtgtaatgctgagtgatttttggaatctccctagtttcccccaagcaaattacatatcttcataggcacatcgatatcaatgttttgaatgtaatatattttaatgaatatgtaaacatgtacaaataaatataatgaatataacaagtatgactgtcctatatgagacatagatattttcaataaatgtatatttattatgaatatatatttataatataaatatcaatacaatgttgttgaatgggtgaataaatcctttaaagcagcctcaatgttataagtagtcactgtgattcattcatctcatacaagcattctctttctatggatgtaattaatacttatggcaaattgacttttcttgagtctcatgaaatagaaaaattcctttctgacattttgactattctaatatggcacaatattataattttagtgcatgtaatcttttccacccagaaaattggcactttctaaattcctggtttcttatttgaaaacaaaaaagacaaaaattatgacaaatactaccaaattaatatttaaattatatttgaatggcaaattaatacttaaaattacattgctaaaaactaattccagatacggagcaaacttaaatgagaaagataaaacaatttaaattttagaagaaaatataggagggcaacttcatgattttggccaaggcaaagatttcttaattaggatgccaaaagcaccattaaaaaagtgggtaaaataaggcattgaaataatattgggggctgggcacggtggctcatgcctgtaatcccagcactttgagaggccaaggtaggtggatcacctgaagtcaagagttcgaggccagcctggccaacatggagaaaccctgtctctactaaaaatagaaaaatcagtcaggcatggtggtgcatgcctgtaatcccagctactcgggaggctaaggcaggagaatcacttgagtctgggaggcggaggttgcagtgagcagagattgtgccactgcaccccagcctgggacagagggagactctctcgaaataataataataataataatattgggtacagataataatttcctccacatgtgtgaaaaagaaggttatgagaatcagaaagcaggaatttagacaatatgtaggggcagcagatttcccttgttttgtaaaacaggcctcagagaggagtatcaacttgcaaataggtcaaaaaccctttgagggaaggaagtttctgggcagcagaagctttaccaccatccactgtcacatggatagggattgcaacatactggcccttcactaataacatctcgtcccatttggatggcaaccctgtgaagtacatatgatcatgctagggaaactgaggttgagtgaggcctggtgccatgcccgaagttgggctgctgtccagtggtaaggcacgggctagctgtgtcagccctaaagggcaccccactacatatccccaagatacaggccacggggctgcaccctcagccacggcccagcgtccccaaggctcagcatgagtttgcatctgctccttccctaggaagtcatttatttacataaatgactaatgatcctgggcaagggctcctgttgggccacatgttctgctttttaaaattcagagcctaggtcaactgtttgatagaaaaatgaaaacataatgtaaattctaaataaagctgatatgcaaagaaactgccctgttaacttaccttacttgtagatcatattttcggtggaagtctgttcagtttaaagataaacatgacatgattagaggagaaagaggatagcccctccctttaagctccaagataattcaagacatcagttaactattgagcgattagagaaggtgttttgggagctgaccttgacctagtattctcaaatctccttcccctccataaggcctggtatacttcatgttgctggcagtcaacatctgtctggcttatgaagaacgagataatcacactcattttggggcctcaggctatgagcacctgagtgtgttaatatcaattaaaaaccccagtacccatctgttgaggtcaggactattaaaagtcaggcgtggctgggcgcaatggctcatgcctgtaattccagcactttgggaggctgaggccggtggatctcttgagcttaggagttcaagatcagcctgggcaacatgatgaaaccctctctactaaaaatacaaaaaattagccaggtgtagtggtgggcacctgtagtcccagctacccaggaggctgaggtgagagaatcacccgagccccagaggatgaggttgcagtaagccatgatcgtgccactccacttcagccttggtgatgggagtgagaccttgtctcaaaaaaaaaaaaaaaagaaaaagagtcacgagtcaggagtcaggtgtaaatgcctgtatatcagactgtattttagaaatttgcttttaaaagttacccttgtgactgagactcaaaaagaaacttccaggatgaatgttcaagctttttttttacttaataaaaatacagctttaaggctgggcatggtggcccatgcctataatcccagcactttgggaggccaaggtgggaggatcatttgaggtcaggagttcaagaccagcctggcaaacgtagtaaaacctcgtctctactaaaaatacaaaaattagccaggcacagtggcatgtacctgtaaccctagcgactcaggaggctgaggcaggagaatggctgaaacccgggaggtggaggttgcagtgagccaagatcacgctattgcactccagcctgggtgacaaagccagactctatctaaaaaaaaaaaaaacaaaaaaaaacaagtaaaacaaaaaattttgcctgtgatacgataatgagtttcttttaaaacttctgagattagtgtcttagagatttaactgttgtgttttgctgctttcagcttgttctccctttaaaaaggcctgggatcattgctgtctccttttcctttttcatcagctcctgtgacgttttcatctcaacactttgggaggctgagatgggcggatcacttaggccaggagttcgaaatcagccttgccaacatagcaaaaccatatctttactaatattacaaaattagctgggcatggtggtacatgcctgtaatcccagccactcaggaggctgaggcatgaaaatagcttgaaaactggaggcagaggttccagtgagcccagccaagattgtgccactgcactctagcctgggcaacagagcgagactccatctcaaagaaaaaacaacaacaacaacaacaacaacaacaaaatgatcccccaagaatcaataataaccagaataaggagccattatcagatattctttattactcttaattactgttaggcttcaggaagccactagttgggtacagctgcccaggactaaacctgtttcttacaaggtcctacagccacaaaaggtggacaccacaacctccatttataaaacagaaaacttaaggctgttgttttgcaaacacatagattaataacatggttctgtaggtggacctaggagcattaatttttccctctcttccaattataattttcttgtttaacatcctagtaaagtttatgtcttctaaatttcatgtaaagatgatacggtctgtcataagtcttccaacccattctgtcttctgaccccacaaatgaatgcatcgtgccattgggccccttagttcaggtaccaaagatttttactcctcaaaggctagggaaggcctgcccccataaagtcagcaggaagcacttacagaaaagggactctgctcttctgcagtccccttaagattaaggaggagtatcgaatctctgagggagcaatgagataggaggtaggtgggactcaacccaggaccagattgaagactggctgacacaaggaagagacactggaagcacctgtccataacacatgcccaccagtgccatatcagtttaccattgccatggcaacacctgaaagttattgcccattttctagctatttctgaataacccactcctttattagcatgtcattaaaactggggataaatatgagtgcaaaactgcccctacgctactgctcttggcacaatgcctatgtggtagctctgtttcacaagaacagtcacaaagctgtaacactgccacctcagtaaagctgttttcttctaccaccagcttacgctgcattccttcctgagtgaagccaagaacctgccctgcaccacttttgtcaagtcagttgacataaaattactcataatatcctctctttattttttgactcctgtaggctgtgtaatgacttcttcctttccatttatgatattgtgttttgtgtcatttttctttccctcttctttttttttgagacagattcttgttctgtcacccaggctggagtgcagtggtgcaatgttggctcactgcaacctccgactccccagttcatgccattctcctgcctcagcctcccgagtagctgggactccaccacgcccagctaacttttttgtatttttaatggaaatggggtttcaccatgttagccaggatggttttgatctcctgacctcgtggtccgcccgccttggcctcccaaatctttccctcttctttatacacccttcatcaagtagtcacaggtttcaattcagttctttcttggtggtagtatggctcatgaaaaaagctgattcttctgtgtttgaggccattcaccatgtttatatgtaatactgtaaaaagtcctgtgacataagcctctgcttcacaaactgaccgctgtcaaacatcatctccccaccaatagataatttttttgttcctcaccagtataattcacataggagtagaaatctcaagtttaaagtgtggatttgcactttaccacttggtgtattcaagaagatgaataatattaatacatcagtagggccaggcgcagtggctcaatcctacaattccagcactttgggaggccgaggcaggcagatcacctgaggtcaggagtttgagaccagccgggccaacatggcaaaaccccgtctctactaaaaatatgaaaattagctgggtatgttggcacacacctgtaatcccagctacttgggaggctgaggcaggagaattgctttaaattgagagatggaggttgcagtgagccaagattgtgccactgcactccagcctgggtgacagagtgagattctatctccaaaaaaaaaaaaaaaaaaatcagtagctttgaattttaaacatctatttgacaagaaattcacagttctttctctcttaaataacgtaataattctttcagtaatgagcctggtttgatgcctctctccccaacatgataaaagtatcacataaatctatgaaaaattcaatttccctgttcctacaactgtctgggatggaaaacttcttcccttgctctagtcctttcttctacacctagtttcacctaatctgtgactcaaaacaatacttgtcaggaaacattctggaaagagcaaaaggcttctaagaggtgtcagagattcctggaccaacatctgtccatctctagagggggttgtgagtatgaggaagagcagagcttgtaaatcttctccttgctttcactcccactgtatttcctaacaacaacaaccacaaccacataatatcatagaacaagcatctactacttccaaggctttggtctcagtaaatcttctctacctctatcacagcatctagaaggtttgatactcatacaaatagtgctgtagctttcttttcataactggaaaagtgggcaagactcagtgtaatgcaggcattccttaagctacttagcattcagtttttagattatcattgcacacatatacccagcatatgtctaatatacatgtaaaaatccatgaagcaagtgttatattagcttgtgttttctattgtattaaatttttctcttatatcgtcttctcctttttgtcattaaaaatctgttcaagtcagtcaattaattattggatcataagtagataaagtcttttatttcataacacattgactcaatgaatatgtttctttgcaagacacagtcctcatttccaagaaaacaagcctgaaaagattatactggagcaagtctacaagtaatgatggtagtttttccttattgtcagtcctggggcaagaataacataaaagataacaaggtagaataaagattacataagaaagaaggacagcaacaggacatgggaactatttatagggtaacatttaaataatggatgatgagaagtaatgcgttagacagggatggatgggaatgattgaaggtctgagtactttagcacagattaagatcaaatcattaggattttaagagttgtgtacagttactgaagaaaatgccttagaatttaatttgactgtggataaaacattcttggattagatttaagactattttccatggtaagtatatttataatgatgatgactgtagtgctgaacatttaaacaatgaaaacaaaattaattgccacacacataatgtcctgaatactactgtaaatgttttatcttattttctttaaactgtctacagcactgtaaggcaggtaccactattgtcacagttacacagatatggaaaccgagacacagggaagttaagttacttgattaatttcaagcaatcgggaagccatggagcatctatgtcagggctgccaggacatgtgactgtaaacagaagtttttaactcaaagagggtatgtgtctgggttaatggaaagcttcaggaccctcagaaaacattactaataagcaaatgaaaggtgtatctgggccgggcgcggtggctcatgcctgtaatcccagcactttgggaggccgaggtgggtggatcaccaggtcaggagatcgagaccaccctggctaacacggtgaaaccccgtctctactaaaaatacaaaaaattagctgggcgtggtggcaggcgcctgtagtcccaggcactcgggaggctgaggcaggagaatggcgtgaacccgggaggcagagcttgcagtgagtggagatcgcaccactgccctctagcctggaagacagagcgagactccgtctcaaaaaaaaaaaaaaaaaatgtgtatctggaagattaagttctaacagactcttcatttccatagatccaataatgcacttagggagatgactgggcatattgaggacaggaagagagaaatgaaaacacagccttttatattgttcttaacagacttgtgccaaacattatacgggtgtatttaggtgattgaagagaagaaaggcacaggagtgaaattctgtgagcacaagggaggagttctacactcagactgagccaacagacttttctgacctgacaaccaaggcggcgcaggatgctcagtgcagagaggaagaagcaggtggtatctgcagctggaagcccagctcccaccccagctgctttgcatgtccctcccagctgccctaccttccagggcccatatcaatgcctgggtcagagccctggggaggaactgctcagttaggacccagacggaaccatggaagccccagcacagcttctcttcctcctgctactctggctcccaggtgaggggaatatgaggtggttttgcacatcagtgaaaactccatcaggagttttctctgatcagcaagaaatataattaaaattcaaagtagatcaacaattttggctctactcaaagacagctggtttgatctagattacatgagtgcatttctgttttatttccaatctcagataccaccggagaaattgtaatgacacagtctccagccaccctgtctttgtctccaggggaaagagccaccctctcctgcagggccagtcagagtgttagcagcagctacttatcctggtaccagcagaaacctgggcaggctcccaggctcctcatctatggtgcatccaccagggccactggcatcccagccaggttcagtggcagtgggtctgggacagacttcactctcaccatcagcagcctgcagcctgaagattttgcagtttattactgtcagcaggattataacttacctcccacagtgattcaacatgaaacaaaaacctcaacaagaccatcagtgtttactagattttaccagctgcttcctttacagacagctaatgtggccactcagttttagcgtctctgctctatttggacattttgcagttctaaaaaaaaatcattgaataatttggactttgattcttggactctcttcaactgaggcaccagaatcccaggtttccagaaatagtgactcactgtatgaatccttatatagcctcagtggttcttaactttcccagtagaggtagctcagtgcatgctacactgctccatttgaattttgcaacattctaagtagtagaaaattctatttatttatccaaatagttgactcagtaaaagctgttcatgtgaagatactaccatggctgaataaatcccattctttttctttcttcaggctatcaacatttcagtggcaaatggttattatggaaacatttgccatttaaaagtgaactaaattatttcttcaattttctctgtgatgcagtagactgtaaaaagattaaagtttgttaaaataaagtacatattcgataaggaagaaatagattattcctaatgacgtctgcaatgacctagtagaaggagtgatagaagcagttgttttcattatttttgtccaaaacttccttccaaatgggatttcattgatcatattcatttattaccacctataagacatgttgacattatgtaacatctgatgtgaagcgctgaggatacatctgtctgtattattcttgccaaaaattaatggtgtgaattgaatcagtagtaaacatcatatacaaacccaactaggaggacattcttcaacatacctggacagtaaacttcaaatgtttgaaggccatgaaagagaaacaaaagtgaaaaactatcacagatttaaagatattaaggacaggataaccaaataaaatacagaaacctgaattttatcttgtaacataaaaaaagtcatcaacgggaaaaatcagtgaaatccatatggtattttaaatgagttaacaaataacattatatctatgttcatttcatggttgtgatacttatgctgtggttatttatgatgctgacattagagcaagctgaaagaggcacatatgggaatcatttttactatatttttcaaattttaggtctaaaagtatttcacctctctcctgcatcctgggattgcctccaattaactacctgcttacaagacttttctttattttctttttgccttttattctttacatgtaaaagatgagtccatctggagcttattttaaagcacagtatgaggactgacattgacctgtttttttaaatgaaataactagctgtcccaaccctgcttgttggataacactgctctgtttcaggagtacccccactgtcatacacccgtgggtccatacccctgggctctccatctgggcactcccctgcctgtggcacctccttcctgagggccggcctcacccagggcccagctgccctctccatggcctgtgtcttcctttcctgatgcctcagatttcccccattctctggcactctttccatcctcctggcctcactctgcacctcccctgaggtgcaggactgccctgccccagcccccagcttcctcactcccaaagccttgtgccactgaagcacgagctccagagtgcacctggatggcagcttctctcctggccaacaaacgcctggtgctggctgccctcccagcatctcccctcaactcctcagctccaccccagggccttaacacacacatgcatagcacacacacatacaaacatatgcacacacagacatgcacacaaatgtacatacggacttacacagacacatacaaatgtgcacacactcgtgcatacacagatgtgttcatgcaaacacacacgtgcacgctcacaggcacgtacacatgtgtaggttatgctaagaaatccattttgtgtggaagacactcaggctcaaatatgtgtccaaagtcacacagctatggagcggcagaactcaggtctctagtgcacacagccccgacttaccgcagttccacttaacagttttcaactttatagtgatgcaaaagccatccacagtcagcagaaaccctcgtgtgagtcccacacggccagtttttcgctttcagtacagcagtcaatgattacatgaggtatccgacacttgactacaaaacaggcttcgtgttgatgcttctgcccaccgcaggctcagggcagtgttctcagcaggccaaggtgggcccccccacgctgtgctattcggtagtcaggtggactcagtcattttccactcgcagcggccttatcgggccgcagccaggggtaagttgagcagtgtctgtacttttagctccaccctgggtatttttaagtggcagatttacaacaaaaaataaaaataaaaatgaaaaaatacagcgttccaaatagtaggggcataaaaggagagaatgcacgttgcggtcagcccatgcctgggagcataagcacttcagaggcatcaccaggcgtgactggctgttgttcctgctcttcctggcagcagcggcctgggcctgagagggatcgccctggccacagctgtaggcaaggctgctgggagccaggagccgccgcgctccgcggtagcgagtctgcggcgccacctcgtgggtgctgcgtggaactccccgtggtgcgggccgggaaggccgggtccccacaaagccggagcccgagcacagcggtgcgagctcgccccaggacatcccacagcacccggagacgggggctggtcccccaaaaccctcaggggtgagaggaaggaggtccccagcctgctgagagctgtcctctgagcacgcactcgcgcacactcacacgtgcatgtgtgcatcctcaggcaccctgacgcgttcacatgcacgtacacgcgtgtgcacacgcacagtctttcacaagagtatgacgcattcacacaagagtgtgacgcgttcacacgcacgcacactccctctccctcgagcctggaaggtgcactgggctcataggggtggaaacctctaccgcggcagaggcacagcaccagggccaggatgctcgcttttatttcagacgtgaaaaccgaggcccgaaagagacagccagtgtccaaccctgtccaacgtctctgctgattgcgcctcctgtgtgtggccggggccggtgtgagggcagcgggcccaccgcatgcctggcccgccccagggcctcgagccacttcctcaggagctgctggcagctgcagcgacggcgcacccagagcccgagggtcccatggagccaggcttcccagcacacaggcacggtggagcctcggggtgggcatacaccccgcgagctcgcgggggctgggcactgcgggtcctcgggtggggactctggagttcagtcttgaaggacacagtcactgagggtcagggaaccaggagggtagggagggtagggaggggtgcctaggcctagtgggagaagcatgtgaaagttccctaagagggctgggggtgaacaagctctcggcccggcctctccgggtagactgctctggtgccctggagcctcccttctccaaggccccatggacgcccccagaggggtgacgccctcgcccacgctgagctctgagtgctgcacgagaactcccagagccgtgtgcacacgcactccccttgttataaccggcattaagtgcactcacattgtcgcatatcccctaccaccgtccatctccagaacttcttcatcttcccaaaaggaaaccatacccactgaacaccaactccctccttttgttaaccattgctctttctgtatttgaatttgcccattctgggcccctcatgtaagtgaaatcgcaatgtatttgtccttttgtggctggcttattccatctagcacaatgtcctcaaggttcatgcgtgttggcacacctctcagaatttccctcctggctgggtgatattataggctcacgcctattatcctagctgttagggagacagaggtaggaagatagcttgaacccaggagttcgagacctgcctgggcaatatagcgagaccgcattttccacaaaaagaaagaaaaaaaagaatctccttcctggtaaaggttcagtaacagtctactgtatgcataaccacatttcgcttgcccatccactcacccatagaccctcagaatgcttctaccttttgactcttgtgaatcacgctgctttgaacatgggtgtgcaaatatctgtgagagagcctgctctcaaaaaaatccatattcttggcaccatgaagaatcacctctcacagacaccagcgaaaagcaagtctgtctgagagcagagggtgaggaggggaaagccgggctgcggatcacagtgggcggaggaaagcccacccttgtgctcccatgtgtgggaggagagaggagagatgccctctagtgaaggaactcttgtagcagccagctccattcctgcttggcctgtggagggccagctcaggaacccagaccaggaagaagtcaaatgaccgacaagatccatcaggaagcagaagtgtgctgtgtctcatcggcaacaacaaacagagctaggaccagccacccaccccccaacccaggggaaatgcatccaccacacaactaccaccgctgcgctcatgacactctcagagacaggcacgggagctcctggcaaggcacaaccagggcaagtgacagtttgccagtcctgggcaagcagacacttatcctctctccagtccccaatcccaccagcctgcacaagcagagaaacatcctgcataaattaaaagatcatccggatcatcaaaagatctgagcaaacaaaacgactgagacaaaaaacaaacaaaacaaaacaaacaaaaaacagaacaacaacaacagaagaacactcatttttacagagagatttgagcccatcccaacagagtacaatgctctttccaagctcatggatggcgtttgggaaaatttagctgtgctaaaggagcaggaagcctcagcccctttcccaagaattgctgttacacaaatcacattctctcaccagggtgcaacaaaattagaaacatgcaataacaaagaccatgttaaaagtgcattttggggccgggcacggtggctcatgcctgtaatcgcagcactttgagaggctgaagcgggtggatcaccccaggtcaggagatcgagaccagcctgggcaacatgacgaaaccctgtctctactaaaaatacaaaaaattagccaggcatagtggcaagagcctgtaaacccggctactagggaggctgaggcaacaaaatcacctaaacttaggaggcagaggttgcagtgagatgagattgtgctactgcactccagcctgagtgacagagtgaaactctgtctcaaaaaagaagaaaaagtgtgttttggaaacaaagttagttttcacaatgaaaattataaaatgcctggaactcaatagcaatagggtattacatattaaaattatgaaactcaacaaaattgacatttagggagaaatttatatcctcagattaatttgtcagaaacaggataaaaggagaaagctcatgataatttgagtaaaagagaaaataaaaactaaaatgaaaaacttttcagaaacaaactacaataagtgtgtgacctatcaaaatctctggatgtgtccaaagcagttctcaggggaaacgttatagctggaagtgtttgttaatatgcttcaacagaagacatataaaattatataaactaagtaaacatacaagaagcttttttaagggaaacaagaaataaatgtatttaattttaaaacagccataataaaagtagacttgataaataaaacccaaaaccacttctttgaaaagaccgttaaaaaaacctctgagaagtcaagcaaaagagaaagaaaaggcacaaattttaaaatgttagatttagaaaaatggcataataaccaacgtggagaagctgcttcaaatcaaggagacgggaggccagcttcattccatgggaggccagcttcattccagtaggttccgtttcacctggatgaaatggaagattttcttggaatgtataaattggcttagcaggaggcagaaaacctgaacaaacagaacaaacagaaatggtaagcaggtgctcgaggggctccatcagcctccagggatgggctgctgtgttagggagggccagagcacaggggaagtggagtgtaattctttctacaagattagcaagctgaacttgaatctcacacacgcacacacaccacagtgacgtggaaagaatccacaggacacttatgagaggtaaaaatagaaagtttctgcacaaaacaatcgtgtgtgtttaaaagataccatgtggcagaaaatagtgatgtttgtttgccagtgtctaggaagaaaccttgaaggcgcacgccagactggcggctgggttggctagggaggagacgatggggtgggagcagctaaggacgacacacactcttttaactctgttcctgcgttgtcgggacgtttacaaactgaagatatatatttttaattaattatttttttttttaaaattttactttaagttctgggatacatgtgcagaacatgtaggtttattacataggtatacatgtgccatggtggtttgctgcacctatcaatttgtcatctaggttttaagccctgcatgcattaggtatttgtcataatgctctcctttcccttgcccccaacccctggatagaacctggtgtgtgatgttcccctccctgtgtctacgtgttctcattgttcagctcccacttatgagtgagaacatgaggtacaaactgcagatatttatacattactttaaagtaattaagttaaactaaactaaatgtaagccaactacatgtaaataaataaaaccaataattaataacaagataaaaataattaatacttaaataattactaatttatttctcagctaaaaattaaaaatttagaaaatgtggaaatgtgtttcataataggaggatatttaaaatgaaagggcatttctgtagtcaaaggggtaggagactcacccaaacaagacacaacctcaaaaccaaaaggaaaactatcaggtttgattatacgaatactgaaaacctctgaatacatgaaaggcaaattctatatcccatgaaactacccttcagaaatgaagagagaaataaagacattctcagaggaagagaatataggaatttgtcactggtcaatttagaaatgctaaaaagtggctacggaaatatgttctgtcatttccacaatacaaaaaattaaaacaaaaaaatcaaaataaaaaaatggctatagaaagttcttatgcagaagggatgaatatgggactatgggaggagggacaaaggaaagacgagaaatgtggatacatacgcgagacaatccacagttcttaaaatcacatctgacgactgaaacaaaaactataccaccacctaatactcaagccagtgatttatacaagtggaaaaggtaaagagacataaatgcaaggcaggtttccacactttgaagtggtaaatactggtaccagtagactactatattacaatacacatattgtaacatccagagcaaacactttaagactatacaaagagatacacgcaacaacattttacagaaatagatcaagatggagggaaagaaaaaggaaacaaaaaagcaaataataaaaacatcaggcataagcaattatgtaacaataagcaccttaaatgtaaatggtctaaataaaccaaaagacagattgatggagagcctataataaacacatggcccaactaaatactgttcatgagaaacttcaaactcacttaaggacctaagtaggttgaaagtaaaagaatggagaaagatatcctgtgaaatcattaattttttaaggaagcaggagtgactatattaatatttcatgaagtagacttcaagcaaaataatttaccagagctggagagggtcttcgctgaattttaagatctaaaatttcctatgctgccttgacatctttgagcctcacagggccccaaaggcctagccgtgggttttcctgtttctaccagacaccccctaccccgccacccaacaggaaaggctccccacctggctagttcttttatcagccagaacagttgcacctcagcctaagaagtttcgcttcacctgtctgccagcccatgaatttattcaaacaagccaattgcattccccctcgggaaccattggtcatcgtgtgctcttgttactaccaagcccgcctgcttcctcagcccgcagccctcactccactacagagtgcggtgcccatctgaccctgtgtggcatgcagtgtcctcctccgagctgtgggtatatgcgactaaaacactgctgtcaatctcatccatccacgccaggtgtcatgttcggccatctcctacactttagggcagggacccctccttcaccaatggggtgaaaaggaagtgaccataacaactgcttaatgacaaaaggattaacccaccaagaagacatctacttcaacatcctcctcttagcaactgttaaaactaggcagaggccgggcacagtggctcatgcctgtaatcccagaactctgggaggcaaaaacaaaggatagcttgaggccaggagttcgagcctgggcaacatagcaaggcctcatctctccaaaaaattttaaatttagccaggtgtggcggcacacacctatagtaccagctactcaggagattaagccagggggagtacttgaccctaggaagtcaaggctgcagtgagtcatgttcgtgccaccgcactctagtgtaagtgacagagtgaaactaggcagaaaaggagcaaggatttacaaaagatctgaacagtcaaccagcaaaatctgacatccgtataacaccccactccccaacagcaaaacacacacatttttaaagccaatagaaatctaccaagatgaggtacacttggggcaataaaagaactcacagcaaatctcgctgtgtgcccctctgcgccggcgccgtgcccctctctgcgccttcttttctcaccatggggaagcgtttgggggcctcttgagggaccccctagatgcttctactcagagcccccaaagccggggagcctccactcctctgtctgcagcctcccctgtcggttctcgctacccagggttcagtggcctgggggtgacggagggggtcgcctctgccaaggcccctcccggcgcctccctggctcatctagcccaccttcctcccacgctggctcacgcaaagtgctctggtcaccaggagcccttcctgaccagccccagccccttcttggccttcgcccacctggcctcccctggagccctgacctgggtgccgggcctgctgggtccagagcccaccccgccctgaacaaccccgagtctcagccaccctcggttcttaccctttcacagctggggagtggagcctgggcctgcacctctccgcgccagagccggcgccagcgcctctccgcgcctgcgccgccgctgcgcgcctcgccgccgctgtctgcctctccgccgctgtccgtctctccgccgcgccgccgctgtccgcctctccgccgcgccgccgctgtccgcctctccgccgctgtccgtctctccgccgcgccgccgctgtccgcctctccgccgctgtccacctctccgccgctgtccgcctctccgccgcgccgccgctgtccgcctctccgccgctatccgtctctccgccgcgccgccgctgtccgcctctccgccgctgtccgtctctccgccgcgccgccgctgtccgcctctccgccgctgtccgcctctccgccgctgtccgtctctccgccgcgccgccgctgtccgcctctccgccgctatccgcctctccgccgcgccgccgctggccgcctctccgccgccgtccgcctctccgccacgccggcgccagcgctgtgtgcctttgcgagggcggagctgcgttctcctcagcacagacccggagagcattgcgagggcggagctgagttctcctctgcacacacttcggagatacagcgaaggcagagcaatgttctcctcagcagagacccgggcgggcgggccggtggcaccgcgagggcggagctgcgttctgctctgcacagaccttgggggcactgcctcgctttgggacaactcggggccgcatggacggtgaataaaatccttcctgtttgcagccctgtttgtggttggtggcagcgatggacactgcagccagccagagcgtagaaaggcgtcggggtaagtgcgctatccaggctgcactgtgggtggcctgggacgggttgggagccctatctcaggcgtcactgcccgtcttgggtggccggttgggtgtgctatctggggctgtgctgcctgcaccgggcggggggtggggggtggtttgggggccaaaccggggctgcactgcctttggtggggagccggttgggggcactatcccagactgtattgctggcaacagtgaggtgggctaagtgtgctatccggggctgcactgtgcggctgtcgggggggtggcggtttcgggttgagggcgctatggggtgctgtaatgcccatggtgtggggaggcggggcagtttgggtatgttgggtgtgctattgggggggtgacactgctggtggtagggggcagggtgggttgggggccatatcaggggctgcactgatggctttagctaggatttctggtactatgttaaacaacagtggtgacagggggcatccttatcatgttccagatcttagaggaaaagctttccatttttccccattccatatgattctagctgtgggtgtctttcctgtagtttttattatgttgcggtatgtttcttctgtgcccgtttctttgaggatttatagcatgaagggatgttgaatttcatcaaatgctttttcggtttcagttgacgtgatgatactgtttttgtcgtttatttggttgatatgatgtatcacattgtatgttgagtgacccttgggtcccagggatacatcccacttgatcatgatgaattatctttctaatgtattactgaatttgattcactggtattttgttgaggatttttgcatccatattagagatcctggcctgtagtttccttctttgatgcttttgtctgattttggtatcacagtaataatggtctcacagaataagtttggaagtattccctcctgtttttcaaaatagtttgagcaggattcgtactaggtctttaaattgtttggtgtgaagccatcagcagtgaagacatcagttcctgggcttttctttactgggagactttttctgatggcttcaatctcattacttgttaccaatctgttctggtcttggatgttttcattgtttaacctaagtaggttgtatgcatctaggaatttgccaatttctactaggctttccaatttattggcatatagtagccagttatgatcctttgaatttctgaagtattagttgtaatgtctccttttttaatctgttgattttatttatttgaatcttgtctcttttcttagcctggttaaaagtttgtcaattttgtttagctttccagaaaaccaacttttcatttaatcttgtatgttttttatttcaattttgtttgtgctacgatcttatttattttcttattttcggtttagtttgttctttactagttctttaagatgtattatttgaaggttttcttttgtttggatggtaggcacttatagctgtaaatctctgcctttgtactgctttctgcataacaagttttggtatactgtgttttcattaccctttgtttcatgaaatttttgaatttctgtcttagtatcttcattgatccgctagtcatttattcaggagggtagtgtttaacttccatgtgattgtattgtttccaaaattgcttttcttattgatacctagttttattcctttgtagtgaaagaagatggccacggagacagacagcagcgtggtcagagtggtaggagccggccatcagcgagagctgctccatgcctggctgctgggtcctagagcctgtggcccactggcttgcctcactgtggttggtggtggtggtgacagagactgcaggacgaccagatggtaggacaggggctatccagggctgcacctttcgcagtgtggggtgggttgagggcgctatccagggtgtcattgcctgcattaggggtactggttggtagcactgtacagggctgcactgcccacggcagggagggtgggttatgggtgctttctggggctgcaatgcccatggaggaggacaggttagggcactatcggttatacgctactggcggcattgggggacggaggtggggggcgctattgagggcaggactagcagtggagcgggggcgagttcggtgctatcaggggctgcactgctggtgtcggtcaacagagttggcatcccaggaaggagtggttctcctctccctgactccacactccagagggcgacccactcttggtcatactggagtgcagcagggcacgcagcgtttgcgtgggaatcctgagcatggcagagcccccacacccaccgtggttcctggttcctgggcctgtgtactgtgggtctgtgcctcagaggctgccaggcacccctggggacaccacgggggacagggccctgtgcgtggaggcgtccggaacaggaattggcacctgggtgtggagggctggctgggtctgaatttttctgcttctcctgctccccgaggagtgcagccccagtgggcccaatggttcctgtggagtggggagctgggtgctgtggtgtctccagcacccaccccagaccccagttcctgcccagcttgggccaaaaggagaggctggactttggagggtgggtgtgagtgcctttgctgaaactggcccctgccacccagtggccggcatgacaagttgaggctctaacccttccacccctcacgtctttctctaggcttttctggctttgcccgcccagctgctctgtgccaggaagaggaggagacacctagagcctgcgacaccatggctcgcctcgctgcgggtgggcggcagtgacggagactgcagtgcgccagagcggtaggagagcggctgcgctaggagggcaggcggctgcagccagggttgggggtcaggcttagagcgatggacgggctgcagcagtggccagatggtaggagccttgtaaggagggctggtgcattggcaatgggcctggctttgccctgcgcctgccgtggatctggccctgtactgccctgccttgccctgtacctgccctactgttacttggactctcggccctgtcctgctctggtcccatcctgaccctgtcttggccctgtgctaccctgtccctgccctggtcttgccctggcactggctctgccctgaacctgcactggcctgaccttggctctggccgtggctctggccctgcctcttgtcctgaccctggtcgtgtcatggcactggccctgccaatggtcatggtcctgctcctgttctggccctgacctggccttggacatgtcctggccctgctttggcccatccctgccctggccccaccatgggcctgcctgttctgccctctcctggcactgaccttgccctgtcatggcccagtggtgccattgccctgccttaccctgcgctggttgtgacttggccccgcttggtgctggccgctccctggacctgccctggacctgccctgaccctgcccttggcttttgccctgccctcactgtggcctggccctggccctagccctggtcctgccatatccctggccctgcccttatccaggccctgcccctgctgctgccctggccctggcctggaacctggtcctgtcaaggacctgccctgactctgccatggccctggccctgctctgccttgttcctggccctgacccagacccagaccctttcctggctctgcactggactttccctggccctgagctggcaatggtctgcccctggtcttgccatcaccctgccctgctgcgctctggatgtgtcatcaccctgccctggccctactctgcctttgaccctgccctggccttaccttggccctcaccctagtcttcgctagaccctgctctggagctggccctagcacagacctggccctgatcctggccgtggtctttgtcctgccatagccctggccctgaagtggacttggaggtgtcctggccccggcataacatggctctgcattggcctgtccctgccctgccgctaccatctccttgccctgctctgtcctgtcccagtactgtcccggccgtgctatttcccttccctaccctgccttggctgtgccctggctcggttctggccctggccccggccctgccctggacatgctctgacactgcctcagcctcggcactagcctggctctttcttggcatcagctctgctctctctgtggaccggctcttgtcctgtcctgcactggccataccatgccctgccctgccctgccctgactcagtcctggctcagccctggcccaaccttggccttggcattgcccctggtcatgccatatttcttgccctgtccctaccctggccttggccctgacccttaccttgctgtggccctgcccttgccctaacgcagcccctggccctgtcatggccctgccctggacctgtcctggccctggcccttccctgcttgagaacttgccctggttctcccctggccctgaccctgaaatgcctggccctaccctggccttgcactgctctggcccttgccctgactctggtcctgtcactggcctagccccagccctgttgctggtcttaccatggcccagaccctgccttggccctgccctgacactgtcctggaccctggctgtgccaagaacctgcactgtccttgccattgttttgctcctgccccgaacctggtcttccccaggccgtggccgtggccctggccctggccctgcccaggtcttggcactgtcctggccccgccctgccctggccctatgctttcctggccctgccttgccggccctggccctgccttggccctagcctggctttgaccctgccctggccctaccttggccttcaccctagccttacctgggcactgtgttggacctggccatagcacagacctggttgtggccctggtcctgccgtggccctgtctcagaccctagccctgccaggtacctgtcctggcccagctctgggcctggctttgtccctggttcttagatgaacctggtcctgctcctgcccttgctcttgccctggaactggccttggacatgtccatggtcctaaccctggccctgcccaggagctgccactgtcttggctgtgccctggctctggccctgccccggccccaaccatagacctgccctggttggtcgtgaactaccttaaccctgtgctaccctgggcctgctccaccctgccctggccctgccctccctttggccctgccctgaccctgccttggccctcacactggccctagcacagacctggtcctatgtgtggccttggcctggcattgacccctgctcctgaccccggtcctgccatggccctggccctgccaatgaccctggcagccctggccctgtcttggccctggccctgaactggccctgccctgaccctggccctgaagtggatttgcaggtgtcttgtccctgatgtaacctggtcttaccatggccctgtccctcccctggctctgtcctggccttctgctgaccctgacccagaccttggccctgccccagccttgtcctagatctggccatggccctgcgtctgccctggaccagcgctggcactggcatggaccctggccctggcccttcgctacttaaggccatgccctggcccagccctggtcctgaccctgtcctggccctaatttggcgtggctctaccctggcatgctattctggccctagccctgaccctgtccctgtccctgtcctggccccagccccattgctggtcctgccacggcccttgtcctgacattgccctttcctggttctggccctggccctgtcccagccctgctctggccctggtctgaaccctggccctgcaatagacctgccttggtcctgcccagaccctggctctggccctacctctgccctggccatacccttgccctggcctggaccccagtcctggtccttgtcctgccccagccgtggccctggccctgccctgcctgtgccctgttctatcctgggctggccctgccatggcctggtcttgccattgccctgccctagcctgccctgcttgtgccctagacctgccccggcctttgcccctgtcttggttctagccttgactgagccctggaccttccctgatcttgcctcagccctggcactaccctggccttgccttggcatttgccttactctctctatggcctggctctggtcctgccctgctctgctcttgttctgtcctggcacagccctggccctggccctggccctgccgtatcactggctctggtcctgcccttatgcagacctgaccctgccactgccttggctttggcctggaccttggccatacagtgaccctgccatgaccctttcctggccctggcctggaacctggccctgccaaggactcgccctggctctgtcatggccctggccctttcctggatttgggtgtgtcctgtcccttatttgccctggcccttccctggctctgccataccccttctctggggtagggccagggtcaggaccagaccagggcagggtcaggaccagggtagggccatggtaaggcctgaagatgggaagggccagggcagcggctggaccagggaagggtcagggccagggatgtagtaggactaggggcagagccggcactagggctgagccaggacagagcaggagagattacattgggctattacgtaaaatttttattttagatttttaagataactatagtagtagtaatgtctatactatattgtttgtaatagtaataatatttgcagtaatcactaaattttaactaatactatctttgcttccagtagtgttctatgagtataattttatcaatatgttaatatgtgaggcattgattctcacaataattctatgtgctaggtacttaaagcatccccattttccaaatgtaggaaacaggcataaagaagttaaatacttggccagattactcctgtaatcccagcactttgggaggccaaagcaggcagatggcttgagctcaggagtttggaaccagcctgggcaacattgtgaaaccccatctctactaaaaatgcacaaaaagaactaatttaagtttcttgtaggattctggttacaaaacactggtcaaacacacagggcatggatagggcagggccagggacaaggtcaggccaggaaggggccagggccaaggcagggccagagatggacttggaagtgtcctggtctgatttgccctgccccaacgttggcccagccctgctctggcacttcctgtcatgccctgtccctggcctgagcactggccctggccctgtcctgcttctggccctgccccggagttgaccaggcactgccatggcccagtcctgcattgccctgccctcctctgccctggtgctaccatggccctgcttgggccctagctctgcctctactctggacctgccctgactctgctcagccctggatctaccctgactctgccttggtgttgccctcccatctctatggcctggctctggctgtgccttgcatagatcatgctctgccctgcgtgtcccagcctgggcccagcccttgtcctaccatattcctgaccccagccatacccttcttctggccgtgaccctgccgtggccctctcctggcccttccttggtcctgccctgcccttccatgccctggccttgccctcaccctgcattggccctgcactggtcctgccctgccctggcactgccttggccccggccctgccttctccctggtcttgcctttgccctgccctggcctgaccccaggcctaccgagtccatgaaatggccctggacctgccttgccatcgtctgtcctggccctgtattgtccccaccatgctctggtccagcgcttgccctggccctgttgctagtcctgccactgttatggccctgccctgtttttggccatgccctgtgctaccctagccctgccctgccttggccttggccctaccatggccttctcctaccctggcctggccctacactggccttttctaccctggccttgcccttcccctggtcttgccttgccctggccttgccctgccctggccttggctttgccttatcctggtcctggttctgccctgaccctggccttgctctggatcctctctggttctgctttctccctggccctgcccttgctctggccctgtccctggcccagccttgaccctgaccctggccctgacaatccccaggtctgacactggccatgcttggccctggcccctccttttggccctgccctggccctgccttggccctgtgctatcttagtcctgccctggccctgaactcaccctggccctaccctcaccctacactggccccgccctaccctggccttgccctgccctggccctgcctttggcctgctctggctctggttctgccctggccttgcccttgccctggaccctccctggccatgttttttccatggtccttctctggccttgcccttgccctgtcccctttctggtcctgccatatttctggccctgtcctgtccatgtcctggacctgactctggccctggacctccctgtccctgccctgccataccctggcccgttccttgctctacactgaccctgccctgccttggccctgtgctaccctagccttgccctggccttctgctgaccctgatcctgccatggccctggccctgccatgtccctgccctggccctggttctgccctgcttctggccctggccttggtcctctcatgtccctggccgtgaccctgcccctggtttttctctggccatgaccctgcccctgttctgtcctatccctggccctgtcttagttctgtcctagccctggcttttcacagtactttatgcttagtaagggctccatggtgtctgtgagttgaatgttgtgttcatagtatctgccaaaacagaaagaaaaaaaacaaaatattttgataagaagttaaagctttgtatataatatgccttgaattgtaaatgcctgttattagttgtattacatataggtcatggttttgtacacataactccaaaccattgatactgttaaaagaatatatgaatatatgaaagaatgtgtaaatgtaagaatgtatcagtatctaattacctttccaaattaatttttatttttagctctattagatttttctcagtgtaacaaatgtttattcctatgtaattaagggcgtatttcctgtacagaatattcatattacctaattgaaaattatatgatacaaaaatataatactatttttaggccaggcatggtggctcatacctgtaatcccaacattttgagaggccaagtttggagaatcatttgagtccaggagttgaccagcctgggcaacatagtgagaccttgtccttattaaacaaataaataaataggttgggcactgtggctcatatctgtcatcccagcattttgggttgccagtgcaggaggattgcttgagcccaggaatttgagaccagcctgggcagaatagcaagactccatctctacaaataataaaatattaaccaggtgtggtggtgcgcacctggggtcccagctacctgggaggctaatgtgggaggttttctcgaggctgcagtgaactgtgaatgcaccactgcattccagcctaggccacagaacaggaccttgtctatgaataaagaaataagtaaaaatataaataaaaataagtaaaaagaaatattagtaaatataaatataaatacatataaacataaaaatgcatgcatgaaaagaaacaatttttaaatttaacatcactgagggcatcctatccatttcatttcatgattccattatgtcatttcacttagatgaaatgataagatgacttgagatgagatgaaatgatgagatgaaatgacaaaatgatgagatgagatgagatgatgagatgaaatggagagtggaaatgagatgaaatgatgagacgaaatgacaaagctgaaaagaaattgaaaggagatgagatgagatgaaatgagatgaaatgatgagatgatgaaatgatgagatgaaacgagatgaaatgatgagatgaaatgaaatgaaataatgaaatgatatgaaataatgaaattgaaatgagatgagatgagatgaaataatgagataaaatgagatgaaatgagatgaacgatgagatgacatgatgagatgaaatgagatgaaaaatgatgagatgaaaaatgagatgaaatgaaataatgaaatgaaataatgaaatgagatgaaatgaaataatgaaaggaaattatgaaatgtaatgaaattgaaatgaaattgaaatgagatgagttgaaatgatgagatgtaatgatgaaatgaaatcatgagatgagatgaaatgagatgaaataatgagatgaaatgagatgatgagatgagatgaaatcatgagatgaaatgatgaaatgaaatgaaatgatggatgaaatgatgagatgaaatgagatgaaatgtaatgagatgaaatgaaatgacataatgaaatgaaataatgaaatgagatgaaatgaaataatgaaatgatgaaataatgaaatgaaaatgaaatggaaatgatgagatgagaagaaatgatgagatgagatgagataaaatgagatgaaatgatgagatgaaatgaaatgatgagatgagatgaaatgagatgaaatatgatgaggtgaaatgacataatgaaatgatgaaatggaataatgaaatggaaatgagatgagatgcaatgagttgaaatgagatgaaatgatgaaatgatgagatgaaatgatgagatgagatgtgatgaaatgatgacatgaaatgacataaaatgagatgaaatgtaatgatgaaatgagatgaaatgatgagatgagataaaatgatatgaaatgatgagatgaatgatgagatgaaatgatgagatgagatgagatgatgagatgaaatgatgagatgaatgatgagatgaaatgatgagatgagatgagatgatgagatgaaatgatgagatgaactgatgagatgaaatgaaatgaaataatgaaatgaaattgaaataaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaagtgatgagatgaaatgatgaaatgataagatgaaaagagttgatgagatgataagatgaaatgatgagatgaaaagatgagatgaaatgaaatgatgagatgaaatgagatgaaatgaaattagacgaaatgtaatgagatgaaatgaaatgacataatgaaatgaaaaaatgaaataatgaaatgaggtgaaattaaatgagatgatgaaattaaatgatgaaatgaaataatgaaatggaaatgatgagatgagatgaaatgacgagatgaatgatgagatgaaatgagatgaaatgatgagatgcaatgatgagatgaaatgatgaaatgatgagatgagatgtaatgatgagaggaaatgatgagatgtaatgaaatgagatgaaatgaatgagatgaaataatgaaaggaaattgaattgagatatgagatgaaatgagataaaatgagatgaaataagaaatgatgaggtgaaatgaaatgctgaggtgagatgagatgaaatgaggagatgaaacgatgagatgaaatgaaaggatgagatgaaatgatgatatgagatgagatgagatgaaatgagatgaaacgagatgaaatgatgaaatgatgagatgagacgagaagaaatgatgagatgaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaaaatgatgagatgaaatgatgagatgaattgaaatgaaatgaaataatgaaatgagatgaaatgaaatgatgaaatgatgaaataatgaaatgaaaatgaaatggaaatgatgagatgagaagaaatgatgagatgagatgagataaaatgagatgaaatgatgagatgaaatgaaatgatgagatgaaatgagatgaaatatgatgaggtgaaatgacataatgaaatgatgaaatggaataatgaaatggaaatgagatgagatgcaatgagttgaaatgagatgaaatgatgaaatgatgagatgaaatgatgagatgagatgtgatgaaatgatgacatgaaatgatgacataaaatgagatgaaatgtaatgatgaaatgagatgaaatgatgagatgagataaaatgatatgaaatgatgagatgaatgatgagatgaaatgatgagatgagatgagatgatgagatgaaatgatgagatgaactgatgagatgaaatgaaataatgaaatgaaattgaaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaaatgaagtgatgagatgaaatgatgaaatgataagatgaaaagagttgatgagatgataagatgaaatgatgagatgaaaagatgtgatgaaatgaaatgatgagatgaaatgagatgaaatgaaattagacgaaatgtaatgagatgaaatgaaatgacataatgatatgaaaaaatgtaataatgaaatgaggtgaaattaaatgagatgatggaattaaatgatgaaatgaaataatgaaatggaaatgatgagatgagatgagatgaaatgacgagatgaatgatgagatgaaatgagatgaaatgatgagacgcaatgatgagatgaaatgatgaaatgatgagatgagacgagaagaaatgatgagatgaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaaaatgatgagatgaaatgatgagatgaattgaaatgaaatgaaataatgaaatgagatgaaatgaaatgatgaaatgatgaaataatgaaatgaaaatgaaatggaaatgatgagatgagaagaaatgatgagatgagatgagatgaaatgatgacatgagatgatgacataagatgagatgaaatgtaatgatgatatgagatgaaatgatgagataaaatgctatgaaatgatgagatgaatgatgagatgaaatgatgagatgagatgagatgatgagatgaaatgagatgaatgatgagatgaaatgatgagatgagatgagatgatgagatgaaatgatgagatgaactgatgagatgaaatgaaatgaaataatgaaatgaaattgaaataaataaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaaatgaagtgatgagatgaaatgatgaaatgataagatgaaaagagttgatgagatgataagatgaaatgatgagatgaaaagatgagatgaaatgaaatgatgagatgaaatgagatgaaatgaaattagacgaaatgtaatgagatgaaatgaaatgacgaaatgaaaaaatgaaataatgaaatgaggtgaaattaaatgagttgatgaaattaaatgatgaaatgaaataatgaaatgaaataatgaactggaaatgatgagatgagatgacatgacgagatgcatgatgagatgaaatgagatgaaatgatgagatgcaatgatgagatgaaatgatgaaatgatgagatgagatgagatgtaatgatgagaggaaatgatgagatgtaatgaaatgagatgaaatgaatgagatgaaataatgaaaggaaattgaattgagatatgagatgaaatgagataaaatgagatgaaataagaaatgatgaggtgaaatgaaatgctgaggtgagatgagatgaaatgaggagatgaaacgatgagatgaaatgaaaggatgagatgaaatgatgatatgagatgagatgaaatgagatgaaacgagatgaaatgatgaaatgatgagatgagacgagaagaaatgatgagatgaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaaaatgatgagatgaaatgatgagatgaattgaaatgaaatgaaataatgaaataatgacatgagatgaaatgaaatgatgaaatgatgaaataatgaaatgaaaatgaaatggaaatgatgagatgagaagaaatgatgagatgagataaaatgagatgaaatgatgagatgaaatgaaatgatgagatgagatgaaatgagatgaaatatgatgaggtgaaatgacataatgaaatgatgaaatggaataatgaaatggaaatgagatgagatgcaatgagttgaaatgagatgaaatgatgaaatgatgagatgaaatgatgagatgagatgtgatgaaatgatgacatgaaatgatgacataaaatgagatgaaatgtaatgatgaaatgagatgaaatgatgagatgagataaaatgatatgaaatgatgagatgaatgatgagatgaaatgatgagatgagatgagatgagatgatgagatgaaatgatgagatgaactgatgagatgaaatgaaatgaaataatgaaatgaaattgaaataaataaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaagtgatgagatgaaatgatgaaatgataagatgaaaagagttgatgagatgataagatgaaatgatgagatgaaaagatgagatgaaatgaaatgatgagatgaaatgagatgaaatgaaattagacgaaatgtaatgagatgaaatgaaatgacataatgaaatgaaaaaatgaaataatgaggtgaaattaaatgagatgatgaaattaaatgatgaaatgaaataatgaaatggaaatgatgagatgaagtgacgagatgaatgatgagatgaaatgagatgaaatgatgagatgcaatgatgagatgaaatgatgaaatgatgagatgagatgaggtgtaatgatgagaggaaatgatgagatgtaatgaaaggagatgaaatgaatgagatgaaataatgaaaggaaattgaattgagatatgagatgaaatgagataaaatgagatgaaataagaaatgatgaggtgaaatgaaatgctgaggtgagatgagatgaaatgaggagatgaaacgatgagatgaaatgaaaggatgagatgaaatgatgatatgagatgagatgaaatgagatgaaacgagatgaaatgatgaaatgatcagatgagacgagaagaaatgatgagataaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaatatgatgagatgaaatgagatgaattgaaatgaaatgaaataatgaaataatgaaatgagatgaaatgaaatgatgaaatgatattgaaatgaaattgaaagatgagatgaaatgatgagatgaaatggtgaaatgttgaaatgaaatgatgaaatgaatagatgtgacatgaaatgagctgaaatgatgagatcaaatgaaatgaaatgagattaaatgatgagatgaaaaatgatgagatgaaaaatgatgagatgaaatgctgagatgaaatgagatcagatgaactgagatgagatgagatgaaataatgaaattaggtgaaataatgaaatgatatgaaataatgaaattgaaatgagatgagaagaagtgagatgaaatgttgtaatgaaaggaggaaatgatgagatgaggagatgaaatgatgagatgaattgagatgaaatgagatgaaaaatgatatgaaaaatgatatcaaaaatatgagatgaaatgaaatgagattatatgaaatgacaatgaaataaatgaaattagatgaaatgaaatgaaatagtgaaatgaaatgatgaaatgaaataatgaaaatgaaatggaaatgcgatgagatgagatttggtgaaatgatgagatgaaatgatgagatgatatgaaatgatgagatgagatgggatgagatgaaatgagataaaatgatgagatgaaatgatgagatgaaatgatggggtgaagtgatgcactgtcacgtgtgtgtctattctttttcccaagcaacaaaaattataattcattaattttaattttattatttaagaatattcttaagagttgaaggaaaaataatatctgtacattatgggttacaatctaagtataaataatacataaatatattaaaacttacaaagaatatgttttggaatcgaatataccatgcttctgtgatgacagttatttcatgctggttgtcacaattttacatgaaaaactaatgaaaaaatgtttttaactgtttctaaaaataacagtttccaaaacagttttacattcgaaatatgaaaaagttgtctttgtgttccttaatctgatgagattttcacactctgcacatgataattgttagatttttattgtgttgataaattgtatatcaaataaaaaatgttattacctcttaaattaggatttttaggtgatataggcagaaaggacagcaagtttttataactttgtctaaatgaactttctaaatgcctgagtattaaaagatagcatgtctataaatcacaatgtatatattactgtatgacctaggaccaatcaaaaccgttacctctgataacattatattgtgcccagtataaaatagatataataatacctcaaacttaaatccgggcattgtcattgaatatcttaagaatatgcaacaaaggtgcttttaaaaatacaagctagtgattgtaccaaatttgtaaatcacataggatagtgggtcattttaagaatattagttatttcaatctataaacgtggatgtctttccttttttgtgttttctttaatttctttcattaatatttgtcatttttgttgtcgaaatcttttacttccttggttaaatttatttctaagtacatttttgtagctattgtaaaaggaattgctttcttaatttcttgtttcagctagtttactatcaatatatagaaatgctactgatttttgtatgttgatttatatcctgcaactttattaatttcatgtatcaccctaagaagcttttggtagagtcttatttttttccatgtataagatcacattgtctttaaacagggacaatttgactgtctcctttccaattcagatgtcctttatttctttctctcacctaattgtcctggctaagactttcactatgtgaaatatgattggtgagaataggcatccttttcttgttccagtaaaatctttttcttgttcacagtaaaagctttcaccttttccacactcagcatgatcttagttgtagatttgtcctttatgtccttctgttttaaggcatatattttctatactaaattgttgagaggttttttgtcatgtaagaatatttaattttgccaaacgcttttattgtgtttattaatttaatcatatggttttcagtatatatccaaaggaaagaaaatcagtatatcaaagacttacctgcacccccatgtttattacagcactattcacaatagccaagatatggaatcagcaaaagtgtccatcaacagatgaatggataaagaaatgtgatatacatatataatggaatactatttagtcataataaagaacaaaatcctgttatttgtggcaacaagaatgcaagtggagggtattatgttaggtgaaataaacctggcatagaaacataaacaccacataactacgtgttctcacttatgtatggaagctaaaatttttaatctcgtagaagtagatagtagagttttggttaccatatcctggaaagagtaggagaaagaagagtataagaaaaatgtggttaatacatacaaaattacagctggagagaaggaagaagttctagttctctacagcactgttgggtgactgtagttaacgggaatttattgtgtgttttcaaataactaaaataaaagattttaaatattctcactgcaaagaaataatacatgatttaggtaatggatatgataatgactctgacttgatctttacgcattgcataaatatatcaaaatatcactctgtaccccataacatgtacatttattatatgtcaattaaagtaaatttaaaagagaaaaaatgaggtaaaggtaaatatacataatttaattactttttcttctataaaacccgagtcagtaccaagaagagtcaatttattagttttctaaaataaaaaaaatcaaaatcaccaaaaaagagcaatatccaagaaaacattgaaaatgaaacacaacattcagtaagaatagaaaacttgggcaccgtatcaccctgttcctagataccgatttactgatggccatttaaatagaattttattctatctaattcatttatactcccagagttcgaaattacattttacctacaataaatgagataacacttgtaaattatatggtactctgcctaacacacgttaataactcaatacatgttagcaataagcttttaatatagtagtcaaagtattaatttctcacattgcaatttccttcaaagacatgaatacaacctttctaatgactccttgttcatcaagatacctcttcaaattattctatttgtttcattcagtatattatctgtgtataccgatattacactcttttctttttttgagatggaatctcattctgttactgatgctggagtgaggtggcatgatctcggttcactgcaacctccacctcccaggttcaagcgattctcctgtctcagcctcccaagtagctaggactacaggtacataccacgatgcctggctaatttttgtatttttagtacagtcaagagtttcaccttgttgtccaggctggtctcgaactcctgacctcaggtgatccacccaccatggcctcccaaagtgctgggattacaggcataagccaccgcacccagcctgatattgcactcttggattttgaacactgaatatctttttgaaagattacacctctttactttgtgcttcagaaattattttccttcaagtgttctaagagtctaatgaagaatgaagtcatgttttatcacttttgtccttaaagatttcagacatgctgaaactgattgaagtatcatttgctactagatagattaattatctccagttgtaggagtggatacatctttaatggtatattttgggttattgtcttatttttgatgcagtattctataaataatttattaaacctggcatccttgggtgagcacagatttttcaactttggtgttatattgtgtttgcttttaaaaactgcttctgaggccaggtatggtggctcttgcccatacccagcactttgggaggccaagatgggtggattacctcaggtcaggagttcaagaccagcctggtcaacatggcaaaaccatgtctctactaaaaacacaaaattagccaggcatggtggtgcatgcttgtagtcctaaccactcgagaggctgaggcaagagaatcacctgaacctgggaggcaaaagttgctaggttgctgtgagccaaattcgcaccattgccctccagcctgggtgaaaagagcaaaactctgtctcaaaaaaaaaaaaaaacccaccaaaaactgcttttgaatggagttgtacatataatttttatgaaaaaaattaacaagtgcataagttcataatagaaaaaccaataatactccaggcacaagttagtactaaaaaaattatgttgaatattctctaatacaacatgctttttcccttcatgaacaatttgtgttttactgagaagagtcactgtttatggtagacattagactacagatgaatatgtactttaaacactcttagttgctttcttaattttatatctgctgctttatgcttctgtttattttcattctttccaatgtccacattctagtaaatttgaatattttaatccaagtttatatactatttaatattgcttgtatagtttagtatttttaagactcaaaaaggtttacagaaagaagaaaaagatcaacatgttattaatcatttaaagatcattttgaaatctttgacctttatattttaatgaataaaatattagtagttattagtataaaataatttatgtcttttggacttagcatccagtatttcttttttaataaagaaaataattattctcttgcaatgtactatgtttatctgggttttgaaaagtgatgtttcctaatatgagaaagccatttacagttttaaatctacaaaggcaaatggaatggtactaaattatttacataataatgtttagatggtggcccttataacattctttctatacttcctacagagttggggatatgcaatcctagaatatttctgggagctaatcctttagcttgatgaatgaaacaagacttttaaataaaattaaactttcaaattatccaggtaatgggcctgtcttttaattcaatggatatggagcataatgaattaacccctgttcattgggtaataagttctcattcttataatactcaaaatgtcctttaatttttaatttttgatagtcatatcattatccctaggtattttagcttctatcttaaattctaaaataattttgaaataggagaaagtattctttattactatatgtattaaacatcatggttttcaaattgaactgcaaatgtatcttttcattgcttcttgatgacacccttcaccctatccatattgtcactaccaagtggtgattacttttcaggttcacatacttattcttcagaaaaatcttctctgtgccttataaagaatatgattgttggcattcaaaagccagcgaagtatacattattagcctgttgcctaactcatttctttaagaaactacactaattacccacatacttatgtttttatttcctcattatttctggagaaaacaaatactgctaacatgatatttgtaagagagaaaaaagtcttttcttgaaaagtgctgtcattgtagtactaacttatagtatcaacttctttataaactccttagacactttttattctgagagaaataaaaaagctaaaagtcaaatgactttttttactctccttattataagcacccatcttggtaatttagggtctttatagttagggtaagttgtgtcataccgaggttacaaaataaaaagtattttgtctttttgggcctttccttattcagtaatactgtcagtttggctttttttgtaggtcaacttattgaactcagtattctgaaataatatgtttactatcttttgagaagcacttaaaatattagatttattgttactcttctgcctttattgggctggaagaataattgtttcactccacaaaaggcaagttgcggagaaaaacacatagacattcaaccgcaaagcagagaaacttgactattttctgcaattttaaagtgtatattgaataaaaccatctttttattttcttttttgctcactggcaaatattaacaacatcaagtgtattattataatgttatctagttaaaaatctcaaaaagttttcataattaccattttaaagtatataaataggtgacctaatgttaatttttattgtctgagaccatgtctgttatttcactctttaaattcagttagtagtgcagaacctagcacttagtagatactcaaaaattatttgctgaataaaaaaaggttaaacatgtaatatatacaaaatgtactggaaaaaaatgcaccaaacaattttgttataccagtttaatgtaaatattgcctttaaaagataatatagttttcaggtgtctacagtgattttgtaatatttgtgcacatataaaataatatttccaaaaatgtaatccagtggggaaatatactttctaaattctagatttataatttagggtttaaattataaaatcattaaataagacacaagtgaaatgtagtcaaatatccccttggaaaaaaattaagtggcctctaaagtgaggtattcatatatgtaattttacaatcctctagtgatagaattaattaaatacaccaccaaattgattaattcctactgtgttaaaagagaagcactaacaatgccagttaccatgtaacatggatttaagctacaagtcatagaaatgtgatgagaagcctcagcgctgtaaaacagagggtggaggaaagcttttcctctctcaaatgagctttgcgaggtatacttcttgaaggataggaagttgaagtgttcaggacttttatgtctattctactttggcttagtttacatgattcgtagtttattagcctagaaatggccaagaaaacttaaggttcaataattagttataaatatgaaatatccccgatttttaagataaaaacaacttataaatgtatttgtctgtaaaaattgtgtatatttttacagaacatctatttctttttttatttttttatatttatttattatgctttaaattctagggtacacatgcacagtgtgcaggtttgttgcatatgtatccatgtgccatgttggtgtgctgcacccattaactcatcatttatattaggcatatctcctaatgctatccctcccccctccccccaccccacaacaggccctggtgtgtgatgttccccttcctgtgtccaagtgttctcattgttcaattcccacctatgagtgagaacatgtggtgtttggttttttgtccttgcgatagtttgctgagaatgatggtttccagcttcatccatgcccctacaaaggacatgaactcatcattttttatggatgcctagtattccatggtgtatatgtgccacatgttcttcatccagtctatcattgttggacatttgggttggttccaagtctttgctattgtgaatagtgctgcaataaacatacgtgtgcatgtgtctttatagcagcacaatttataatcctttgggtatatactcagtagtgggatggctgggtcaaatggtatctctagttctagatccctgaggaatggccacactgtcttccacaatggttgaactagtttacagtcccaccaacagtgtgaaagtgttcctatttctccacatcctctccagcacctgttgtttcctgactttttaatgatcgccattctaactggtgtgagatggtatctcattgtggttttgatttgcatttctctgatgggtctatttctttaaaacaaagggaggggagtctctcatttgcattagtttttttcatagccttttgaacttcacaatttctatgtttcagaacctatttcttacagtttttctatgctaaactctgtcctagtcagttctagagtgtatgaagaaccaaatgatgtaatagtatgccacctggctgtagtggaacaaatttgactcttaagtatgcaggctctaattttcctgtctggttttggcaagtattccttacataggttttttctttgaaaatctgggattgagaggttgatgaatgaaaattaatcctttcacttttttgtatataggtttgcaataattaggtcagagtggagttttaaggtcacggaggggtctgatgacttacaaataatgggctctgattgggcaactactcatctgagttccttccatttgacctaattaagcttgtgaaatttacactaagccatgagctcatctttaaaaagttttattaaaagattttcagctgttccaaatgggacttattactggaatgtgttttaaaggatcatatcagatgaatgaaaggtatttgatccttcgtttccttaataataaaatgatggtttggaaaaataggctacagtctaaccacagtgctattattaggctttcttgttaaacataggtctaagcctaagtatgtcaatacaacaaatacttactgtttcatttctagtaatgaaaaaaaaaaaaaaaacaagtctttctggcataaggatgattttcatctggttattttgaaacatttttgtaaaataaatttccatctataaagaacatttttatttgtaaggaggggtatgtctctgtgcactggaagagagggaggactaaatcactgggaagtcttatgataaagaagccattggcttaaatcagcgaagcaagccgtcccttggtttaaggtgtttttcctggccatcctgtcttgactagaactttacctacaccttcctttttggtttaggcaaattatagtatctaaaactaaagtctcagctctgtgtctttgacatataaatgttctaccatgtcttctctggaatctgataactatctatctctttaaaatgcaagtctagggagatgactcatcagaaaaagaagaaaaaagaggtatttggaaattgtgcaaattaaagcagcccctgatgtcaaagtctacacattcctgagtgagtcagttctggccagttctagctggatcaagagagctcttctgggcaggcctgaagagcacctgaatggcagccacctgaggagccaggtgcctgaaacttccttcacctgcttgaggagcgccaaagcccaggtgctggctggacaaccacttctggctgcctaagcagatggcagaagaaggaaacaaggtcagaggcagagtattgaaccctgcctcccaggtgggtggaagatgcctgtcgccaaactagggcccagcttgccgggtgagatgggtgaactggtgatcccccgagagagtggacgtcagaactacatgttcctggacttcacctcggccagcgaaggagagagagggttaatgttaactgcacgaggcccactctagccttaaattctgtaattcaaacccttcccttggagacaaaacaaacatgacaaggaattctgaggtcaggggacaagaatcacaaagtgggagattgaggaggcagtgtccttcctgcccttggtctactggctaagaaccttcctcagcctgacctttgcacattgcactttcagctctgtttgcaattttcctcctttagtgctgagggaatcccagtgttccatcctgaaatctataggttcctaatgggtggttaaaaaaaaacctcagcgagagaagcagaaaatgtttcctcttcctgaaaaactgtagaaaggcaggcaccattctgggtgaggacatggtccttgcaaatgtctttgtgttgtttttgtttttgttcttgtttttgagatgaagttttgctcttgttgcccagactggagtgcagtggtgtgatctctgctcattgcaacctccgcctcctgggttcaagcagttctcctacctcagcctcccgagtagctggaattacaggcacctgccaccacacctggctaattttttgtatttttagtagagatggggttttgccgtgttggccatgttggtctcgaactcctgacctcaagtgagccacccgcttctgcctcccaaagtgctgggattacaggagtgagccaccgcgtccagcctgcaaacgtctttaaagacagcgtgtttcagaggctgtgacagtgccctgtgaacatgccaattctcacagtcccgggagctctgaggagcaggcccggctccttgccaggctgatggtactgaaactctgctctccaagacataacctgatggccatgcaagatttcttaatcgactgtggaccgtgagagtctgcatctcattttaattaagatgggaaaagaaagaacaaaagagcaactcccaggttatagagaaagtggattttagtataatattcaagtgtagcattgctaataataacaaacctttcccctcccaaacggtaaacacttgcactgcctattatacaaaaattcaaccaccctctctgttaccccgatatctcctccccagtgaccccccctctcatgcggcctcatgagcctggccagtggtgaatggcactttcatgggcatgagactccacgtgagtgggactcagctgggacccctctccacgtgggagctggggaagccaccctagtagcagctcaaagtgtccgtgatgtccctgctgctgaggtaggggccgcctctgagctggtctcggggtgtgagctgctgctggtagtgggctctgccctgagggcctggtggctggtcagaagggcaggcacacatgggtgactccccaggaactcaggccacctccccaccacagccctgcactgtgtgctccaggcatgtgctgagtgcctggtcaatcaccagtgccctattgatcccagtctccagagagagcatttagtgtcactccacagaggggaaactcggcccagagaagtaaagtgactctccccagtcacagggctggtcagcagtaggatgggaggctagtcccttgctgtctgactccctgagcccacccatatcccaaggcagccaacctctgcccgccctggttcaggccccgactggcccctgtggtgggtgatgtctatcttcctggcctttgtgctcccagccaactgggatggagcctccagctggcatgacaggttgtagctacggacagaagagtggctgtgaggctgccaggaatctcaccagggccccctcccagggcctgtccagagtgaggtctgggtaccccaggcattgccagaccacaggatctgatgttggccaagaggccatggccacaggctttctgaggctggcccccagggagagttcaatcctactatcccaattcctgtcctggccttacctctcagtctcaccgagccacttcatggtcccaaaccaggacccaaagtgctgcttgggctcaaggttgtaattatttgcagccaactggagcagtggacctccttgcttactttgaattcctgggtccagagggaaaaactgggtgatgacagggactggacagggatgccacaggggccctgtgggggtgttagatggggtggtggccagtctttgctcataggggaccccctcctcctctccagtcctgtccccacctgttctcagagctggctcaaacagcagctcctccaggaatgtgtccttggtttcaacctggtactcccacctgcaggtcttcctggagtgtctcctctttctctctgtctccccataaatctaagacgagggggatggatctgcccactgctactcaccgtatgactcttgtgaggttgatcagtctcccctggaaggccaacagctgaagtccatcagaaagggtcctctggcccagagccagcccctgcccacccctgtcttgctgcacccagggtgcaagacccagatcaggtctgggtgacaggaggggtatagaggggctgaggctcaggggccttctagcctaacttgtctggagacagttggggaaactgagaccccaagcagggaggtatggctccgagagattattctcattaatctggaacatttttgcaagctgttaggtataggaagtctgtcacaggtaagagaaatgctttttaagagcatgagagacagcagggttgtgacaatattgaaacaccaccgtgcagattcaccaattgccaccaccgggagccccctgagagtcattgcagatgcacagccctcccctgcaacccctggacctccccgtggtctggcacctaaagggttatgcctcatggcaggaatcaggaccctcagggtgccctgcccactccaaggtctgcctctgctctgattggtcactgacattcagattgtcacccaaatataaggacattagcagaaagactcattcaatacaagtggactcagacatagataggaattgggttgcaagaagccccttttgtttcttttattttattttggaaaaaacttttattgtgaaaattcacatatatatatatatatatatatatgtatatataaactcaatcaatgcaaaaggatagacaatgaacaaatgaattccccttccactccagatccccaactcagatccagacctcctgagcccacttcccccatctcatcacagatccagacctcctgagcccactttccccatctcatcacagacccagacctcctgagcccactttccccatctcatcacagatccagacctcctgagcccactttccccatctcatcacagatccagacctcctgagcccactttccccatctcatcacagatccagacctcccccactttccccatctcatcacagatccagacctcctgagcccacttccccaactcatcaccagtgatttcttgggctctgcattagttttctattgctgctgcaaccaacagctacagactcagtggcttccatttctgtcttatagttctggttgccaaaagtcctaagaggatctcactgggctaaagtcaaggtgctggcggggctatgtcccttctggaggctcaagggatgaatcgggtccctgccttttctagcttctaggggctccagcttctaggtttgtggcctccttcctccatcctcaaagccagcaacagcaggtgaagtcctcgcccatcatgcatcactctcccttcttcctccttcaacttttttttttatatttagggggaacgagtaccggattcttacatagtcaaaaagctccttatagagaagctcggaactttcaatacaactttgccttttctgccattttaattttccatttaatttaaatgtattctctcatttgaccttcatactctgtggagaaatattcctatttcggcttgtattgacaagctgttttcacacagcccccacatcacccaaccaaccagcaagaaacagataaagaaactgaggcccagggaggctaagagtcctgccaggatcattcacctttcaaggtaaggagccagttccagacctgggtttgtgcagctccaagctcccccgtctttctacaatgctagatttagactatagcaatctagcaagtgtggccacacaatgatcaagttggatttagatgatgttccctataaatccattctcctctcccgtgtaagcaaggcaaagtcctccaggccatggggagtccctgaagactcgatgaactgcagtggccacatcaggaggttgcaggttgaccagaactcaccgacacagcaggagagcagcttggaacctgcaacctagccaaaacctagtgccttggattgggggagaaaacaggcagccattcctctctctctgctggctagaggggattctggcttttcctgccagagccacccctttccctcctcctaaagttgatggtggttctttaaggaaagggagaagtgcacggtgtgatagggcaggaagagaagaaaatggaggagaggaggggactttcccataagcaggcagaagaaaaggcagctgtggtgtgtgatggacatggatgcagtggtgtccaatgtggggtcagccctagaggagagacagagagagagacagaaaagtgagagtcctgacccttacgattaacatgggatctgcctgcaaatgctgtttagggccatcgcctcttcctgtactgctatttttgagagtgatgctcctgagccccatgacccagtcaaatttgatgtcccctcgagccagattcagtgctgggagtccagtgtgatctgcctggatcttgctgcattgagaacaggccagtcttgaccccaatacaggggctggatatgaacaggcaacagctgggtttctgagtcagaaagacttggttaattgctaattgcttaggcgagtaatttaattttgttgagtcagattcttcagctacaaaatgcagatgacagtacttattcctccaggttgtggggaaaatggagattctaagcacgatgtccatttcacagaaaggtaccaatttggtggcttattttcctttctaccttcagaagtggctatccctgccacccaaacagacccttgactctcaagtggacggggtcccatttgcacagggggagaccttacagcctacgttgagtctatacttaccacttagtgagcattgtgtccgctcaggggcctctgtgggcatccgtctcctctgcagcatctttcctccccactgctgggtctgcacatgaccccctccttgggttaggcctctgatcagtgatgaccttggtatggtggtgatggtcagtcttggcatcaaatgagccagtttatatcatcagctattcaataaaatactaatctaggtgtcaccgtgaaagtattttgtgacattgttatgtacgtgttgttacaaatgtgcatgatgcatttactacagcatagaattttgcctgggtgccagcctgaagtctgtccgacagatcatagccatgttagtcccacagtcacaggggccaattgattaaattattttatctcccttgaaaactaaaaataaaatcctaagccccccacccgacttaacagaccccctgttggccaacggaacctcaaataaatcttaaaattcagttcttggccatgacaggacaggaggtcagacatacctccctgtacctccctccctcttatggtttagaccccacaactgaacagcattaatgttaaaatagagatcatgagactgacagaacagactctttgtggcaataagacctcaaattataaacaggagctagggccatgccaggcgagcgttaagtcttgtaccctactcttaaagaattaactagattctaactaccacgtgggttttatttttctctagcaaccaagcaagcactggctgtgagagaagcaagattaaaacaattacaactcacccagttcacagacgctgagtaactgatctcctgccccactaaccttaatgacagctttctctggacaagggactgatttcagtaactttctcctgataagagaccatcctccatggactggttctggccagttttggaggctgtgcctgtacagaggctgagtaccttcatgtccctgcttcactttttgatgtgtagggcctaattataatacatttaaatgtcaagtctccaccccagaatgaacatgcatgtttatggaatatgcatgcattaggacctcttttatgagtattctcataaaatgatatagctcctctgatatcctattgagtatgtatatgtagccaattcatttggctcaaattcctgtcctctccttccctccctggaaatgcctgcctctggccttggctgtaggccacacttcccagcctgtcataatggccaccttgcagactgcaaacctatataagaaataaagctctcttttctaaatttataaaattgtgtgatttttcagttgatgctctctttctacacacacacacacacacacacacacacacgcaatttatacagaaggaaatctggagaatatatgtgggaatggatattaagtgtgtggcaccgtggtggaagtaacataaagttggattaggctaaatttattaatgttggcccactaaacagagattctggactcagggttgtaggtcaaagctttagaaagggctccaagggttggtttgatcggttacttggttggttgcttgcttggttggttggtgcttgcttccttgcttggttgtttggttggtttgttgcttgcttgcttgttggttgattggttggctgtttgcttgtttggtgacttggttggttggctgaaacagaatcagagtttacctaaggtacataaagttgagatgccacaacttccttggtttatgtgtacagaaaggtatgcaaaaactcagggagactggatttattatgtcagacctgctcactcacactggagggtctacggaacatactcctcacaacgatcatgagaaagaatattgtgagaggagcccagtatcctggaagagctttgagcttgtgctctcagtaggcaaaatgttacagcaggaactgcagccactggactgggatctttaagtaaaatgaggataattgaatcctggggtggcagggaacatgggctgtccttaatcaccaaagatgaggtgggtgtggtcaccacagtggaaagcagtgtcaaagcagcagtcagaatggtttgactcacagacacccacggcattgtgtagtccatggtatccacagggagagctaatgggctgtaccaaagtcttagttgttctttaaaaaatgaagaattctaggtcaactgaataaaagactaactcaaattaatgaaacacagatctaaaaccctcaatcaattcccagacttgagccagttcacaggcccacaaccccttaagtgaaggggaggctgggtgatcttggggaagtacgctgctacgttgccaaaaatttacattgttaatctttttcccagtcttccccaaagggacttacagccttctgccaggatgactgtgacttaaagaaaagaaaattctcagatatttggggaattactggacactggctctcatttgacactattatcactatgttgcctaggatggattcatgctcctgggttcaagcagtcctcctacctcagcctcccaaagtgctgggattacagacatgagccactgtggccagcagagctttgaaactagaacatggaggtccagtggtaaagatttgacaagtctgggaagagattgggccaaggcaatgttgatgattcttttttttttttttttttttttttttacaacagagtcttgttctgttgtctaggctggagtgcaatggcgcgatctcggctcactgcaacctctgcctccggggtccaagcaattctcctgcctcagcctcctgagtagctgggattacaggtgcccaccaccacaccaggctaattttttatttttttgtgttttttgagacagagtctcactctatatcgcccaggctggagtgcagtggcgcaatctgggctcactgcaaaccccgcctctcaggttcatgccattcttctgcctcagcctcacgagtagctgggactacaggtgcctgccaccgtgcctggctaattttttgtatttttagtagagacggggtttcatttcaccatgttagccaggatggtcttgatctcctgacctcatgatctgcccgcctcggcctcccaaagtgctgggattacagggatgagccaccatgcccagccacaccaagctaatttttgtatttctttttttagttgagacagggtttcaccatgttggccaggctggtccctgaccttgtgatccacccgcctcagcttcccaaagtgctgagatgacaggcatgagccaccgtgcctggccaatgttgatgattctaaacagcagccgttaatgtgaaaaccatccaactggaagccctggccttgcccagaggacacagtctgggtggtgggcagagacttcagctgccttccaaggcaagcagctccttgctgcccgcttgctggggattttacttacagggcagaagctggcaggtgatttgggggcaggaattgcttcctggatggtataggatgaaccacactccccaggaaggcactcatcctggtggcctaacagaagcagccctcaccccaaaaggcaatgctgctccactagttttatggggtgactccttcctgtaggttccttccagctttaccagaaacacagaacatctttcctgacagggcattggttttgtttttgaacagagagatccttcttttaaaaagttagttttttgttttgttttgttttgttttttgtaatggaatcaacctaggtcctaagcctagcaggttgttattattatttttatgattattttttgagatggagtcccactctgtggtccaggctggagggcagtggcacgatctcagctcactgcaatgtctgcctcctgggttcaagagattctcctgcctcaacctacagaggagccaggattacaggcatgcaccaccatgcccggctaatttttgtacttttagtagagatagggttttgccatgttggccaggctgatctcaaactcctgacctcaggtgatccacgcacctcagcctcccaaactgctgagaatacaggtgtgagctgccatacccagccacaggttatttttgctgatcttctccctcctcccaccctcaaagaaaacgcggtacatctacaccatggactactacgcaaccctgaaaaggaacaaaatcacggttggtttttttttttttttttttgcagcaacatggatgtagctggaggccattatcttttttaattatttttattattttttttctattctactttaagttctggggtatatgtgcagaatgtgcaggattgttacatagatatacatgtgccatagcggtttgctgcacccatcaacccatcatctacattagatatttctcataatgctgtccctttcccagtcccccacccctgcagtaggccccagtgtgtgatgttcccctctctgggttgatgtgttctcattgttcacttcccacttatgagtgagaacatgcactgtttggttttctgctcctgtgtcactttgctgaacatgagggtttccagcttcatccatgtccctgcaaaggacatgaactcatctttttcatggctgcatagtattccacagtgtctatgtgctacattttctttatccagtctatcactgatgagcatttgggttggttccacatctttgctattgtgaacagtgtggaggccattatcttaagtaaattaatagaatgctgcgtgttctcacttataagtgggagctaaatgttgtgtatatgtagacacagagaagggaacagatattggggtctagttagggggagagaggaaggtagaaggacaagagttgaaaaaaccaactgtggggtattatgctcactacctgggtgatgggatcactcataccccagacctcagcatcacacatcgtacccatgtaagaaacctgtacatgtacctcctgaatccaaactgctccatcatttgcaccagcaattccaagactgggcatctacccaaaggaaaagaagtcattctaccaaaaagacacatgcatggtaaagttccttttttttgtttgttttttgagatggagtctcgctctatttcccatgctggagtgcagtagcaatctcggctcactgcaacctctgcctccagggttcaagtgattctcctgcctcagcctcttgagcagctgggattacaggcatgcgccaccatgcctggctaatttttgtatttttagtagagacagggtttcaccatattgaccaggctggtctcgaactcctgacctcaggtgatctgcccaccttggccctccagagtgctgggattacagtgcctggccctgtaaggttcatcacagcacgacttacaataggaaagtcatggaatcaacctagttgcccatcagtggggtaccggataaagcaaaagtggttcttctacagcatcgaatactacacagccatgaaaaagaacaaaatcatgtcctttgcggccacatggatgtagctggagggcattatgcttaatgaattaacacaagaacagaaaatcaaataccacatgttcttgtctggataaagcaattgtggcccttctacaccatggaatactgcacagccatgaaaaagaataaaatcatgtttttgcagccacgtggacacagctgaagggaattatgcttagtgaattaacgccaggaaaagaaaatcgaataccacatgttctccactagataaagcaaatgtggtctttctgcatcatggaatactacacagccacgaaaaagaataatgtcatgtcctttgcagccacatggacacagctgaaggacattatgcttagtgaattaatgccaggaacagaaaatgaaatactacatgttctcaactggataaagcaaatgtggcccttctacaccacggaatactacacagtgatgaaaaaaataaaatcatgtctttgcagccacatggatgcagccagagggcattatgcttagtgaatcaatatgaggaacagaaaatcaaataccacatgttctgcactagataaagcaaatgtggtccttctgcatcatggaatactacacagccatgaacaagaataaaatcatgccctttgcagcaacgtggatgaagctgaagggcattatgcttagtgaattaacgccaggaacagaaaataaaacaccacatgtttttgcttataggtgggagctaaacattgcctgcacctggacacaatgaaggggcaccacagaccctcaggactaatagagtaggaagcaggggcgggggtacaagggttgaaaaactaccctgagattctttgaatttcaggcagaaggcagcaactggagagatctttgggtcacggatttttctgttgcattttcttgcttgtttgttttctatctctctctctctcttttttttttttcttttttttgagatggagtctcactctgtgacccaggctggagtgcagtggtgcaatctcggctccctgcaacttctgcctcctggattcaagcaattcttctacctcagcctcccaagtagctgggactacaggcacctgccaccacacctggctaatttttgtatttttagcagagacggggtttcaccatgttggccaggctggtctcgaactcctgacctcaggtgatctgcctgccttggcctcccaaagtgctgggattacaggcatgagccactgcacctggccctcttcttatatatttctagaactcctctcgaatttggggtttgtttttcttaattacaaggaatcaagttgaatcattagtgcatatataaatatacattttattttagtacacattatatacctcaggaatgtacaatgctcagcgcctgggtgacgggattattcataccccaaacctcagcatcgtacaatatccccaggacacaaagctgcccgtggatcccctgaatctataataataataattaataataataataataataaataaaaagtgactttgtcattcgcagggaaatgtgaatgacattcactctgcctctcaggcccttggattcccaaagtttgttttcctcacgcccaggggacactcagaatgtcgtttgcagaacacgggttgtttttcttagaaacgccttgcaaaacaaaataggaagcaaaatctttctcactccttccactccataatagacaaaataaaatgagggggcaggaatccagagactttgaccacagttggcagatttattgtggtacagacatgaaggcaagcagtgttctctctgattctacgaaccgtacagcccgggccagctgccttctgctttctggatggtgcaggcgtgagctccaagcccaaatttcactggagctccaagaatcgagcctggcccaggcactcactgcacgggggccaagcgtgaaaccagtgatcgctccagcaaggtaacaggacagcttggtgatccttcttgccggccacaaaaggttatagccagaattccaccgaatgtggtctttctgtgtctctccccagatagtgaagctgcacaaacctgggggtggggggtggggggtgctgacctcagtggggtgtcctggagaggcaggaaccagagtttacagggtgcagatcctactgaagcaaatggacgtggcatccgtgggcagagctggctgtggctggccttccagcctggatgtctcccccccccccgcctggggtgtcaccaaatgcacccagagaccccttctaaacctggggggatgtgctgacctcagtggggtttcctggagaggcaggaagctgggtttccagggtacatatcctactgaagcaaatggacgtggcatccttgggcagagctggctgtggctggccttccagcctggacgtctcccccactgcctggggtgtcaccaaatgcacccagagacctctcttctgaaagcccattcatgggaagcctccaggtctcctcagcaggcagcatcacgtctgatttcactgcgttatcaggtaatgcaggcctgttctacctgtgtgcgtgagcgcgtgtgtgccgtgtgggagtgtgtgtgttgatgtgggtgtgggtgtgtgcttgtgtggctgtgtgtgtgtgcctgtttatgtgatgatgagtgtgtctgtgagtctgtaagacaacgtgtgtttccatgcgtgtttctgtgtgagcgtgcattcctgtgttttatggaagtgtgtttttgtgatggtgtttttgtgtgcacctgcgtttatcgtatttgtgtgtttgtgaatatgagtgtatgtgtgtgaatctgtatggcaatgtagaaattcttttttttttttttttgagacggagtctcgctctgtcacccatactggagtgcaaaggctcaatctcagctcacagcaacctccacctcccgggttcaaacgattcttctgcctcagcctcctgagtacctgggattacagacacccaccgccacatctggctaatttttcttttttgatatggagtctcgttctgtcacccaggctggagtgcagtggcgtgatcttggctcactgcaacctctgcctcccaggttcaaatgattctcctgcctcagcctcctgagtagctgggattacaggcataagccaccacatctggctaatttttgtatttttgagtagagatggggtttcaccatgttggccaggctggtctggaactcccgacctcaagttatctgcccgcctcggcctcccaaagttctgggagtacaggcgtgagccaccttgcccggccccagtgtgtgaatttttatgtttgtgtgtctacatgattatgtgagtctttttgtgactgtgtttccatgagtgtgtgactgtatttatgtgtttgtgtgtgcttgtgtgattctgagtgtgtctatgagtgtgtatgacatatgtgagtgtctgtgtgggtgagtagccatccacgtgtttatatgagagtgttttcatgattctgtttatgagtgactttgtatgtatacgtgtttgtgtgctttgtgagaatgtcaatgtgcatgtgcacccacgtgtgcaaaaaacccacacatttttgtaattgtgtttgtgtgtgtgtccctgcatttgtgtgagtgtgcatgtcttcgtgtgtccatgtgtttctatgagtgtgttttgtgattctgtctgtctttgtgttgatgtgtgtttgtgtaagtgtgtggttgcatttgtgtcagtgattctggagcaggtgagctgatcacaagtctgagccgagaatccatggagctcatttacaacagaagccgggaccctgtgcaaatccttctgaaatatccccggtttacagagctcctaggggtggggaagaaaaattccctgacttttcggcctcagggaaagagagagacaccccgctggccgtacacctctgctgtttctcagaaaacaggtggggtatcactctttcctaaatgacggtgattttaagaacggttcaccttttgaagagacgtttctgccctggcgatccatacatattgaacccaaatgaatattttttaattaaaaatttttatataaatatacattgtgcatactttatattaatatattgatataaatatattttaatataaacatgatttttatagttcatataaataaagttatatatagtgtatatgtaaaatatacttttatttgtgatacataattttatagattaaattttatatactaagcaaagttacatgtgatatatacatgccatataacatcatttatataatatatctttatgtaaataagtatataataaaattgatcttatatttgttaatacataattatgtatatatactatgtaaaaataaaattatatattgtatgtgcataattatatttctataaatacacgcttatgtgtgtatttatacatgaatgcctgtgtttgtgtgagtacatcagtgagtgtgtgaatgtgtgtgcatgtgtgcctgtgtttgtgtgagtgtaagagtgttgtacatttatacactcacattttgttttctggttaataacaagatctatctttgatttaggatatgaagaattcttataagcaaccccccacacaaaatttgtatttattttaaaatattcttaaaatatgggttcttttatttttgcacaaacagacaagagtgttttttctttccaaaacttttatttcaaattctgaccctgaggagcagaaaaagaagaaaacattgtgtaaccttatatacattagaaacataagtagttactaaatgcaatacagattttgacaacatgcatttaggaaaaatgaggaattcaaactcgtagctgcctcaatattgaactttctaaagtttaattttttttaattaaaaaatattcatttgggttcaatatgtatggatctccagggcagaaatgtctctccaaaaagtgaaccactctgaaaatcaccgtcatttgggaaagggtgatgccccagctgtcttctgaaaaatagcagaggcttccggccagtggggtgtctctctctttccctgaggccgaaatgtcagggaatttttcttccccacccctaggagcccagtaaatgcagaatatttcagaaggatttgcacagggtcccggcttctgctatttatgagctccatggattcttggctcaggcttgtgatcagctcacctgctccagaatcacttcccatcttagcttctgggctaagacacctcaaaaccagcaaaggaaagtcctcactggtcaacgcgtccatcccaactcccccatctccccttagggtgggtttggggttcgggactgctttactgttcctttcaaagcagactgggaggtaagattttattctgcttccagaggttcaggatttctgcagacggtcagcaactctttgcatcctactggtaaaagttttatatactttgtatttatagaaatacgcattgtgtatattttatatgaatagattgatataaattattttagtaacttaaccatatgacttttatatttttatataaataaagttatatgtagtgtatatgtaaaatacttttatttctaatacataattttatagattaaatttaatatattaagcaaaaatatatgtaacatatataacatataacatcatttctataatatataacttaatgtaaataagtatataaaattgatattatatttgttaatacataattatacatatatactgtgtaaaaataaaattacatattgtatatgcataattatatttctataagtacaattatatactatgtataattatgtataaaataattgtataataaaattatataataaattttgaaacgttataaattattatacatagtattttattgtattaaatttagaaatgtgttatatgtaataaaattttattataataaatgtagattatataaaatcttatttataataaattaccttatgtataattataatatgagaaaataattacatatcattgtattataataaatttagagatgttatacattattacatataaaatttcattatattaaatttagaaatatatgtaataaaatggtattatgttaaaatttttatgtaacattttattatacatgtataattttatataatgttttataatatatagaatataagtacacagaatataagtacaaaaatatttatatacagctacacgtaatataaatacatcagtgtaagatgttttgtgtgtgtgagatggagtctcgctctgttgcccaggctggagtgcagcaacacgatctcgtctcactgcaacctctgcctcctgggttcaagcgattctcctgcctcagcctcccgagtagctgggattacaggcatgcaccaccacacccaatcaatttttgtatttttagtagagatggggtttcactgtgttagccaggatggtctcaaactcctgacctcaggtgatccacccgcctcggcctcccaaagtgctgggattacaggcatgagccacagtgtaagatactagctattaaaaaataaatatatatatatactgcaacagctgatttgtctggaagagtttggtcagaagacagtgtattaagaagactgtgagttcccagaggaatataagaatatacatcatgttgatatattatatataacataaatagctaactacatctgtgtatatagtataaacaaaagtacaaaaatatttgtatataactatatgtaatataaatatatcagtgtaagatattagctattaaaatatatatatatatagagagagagagagcaaccggtgatttgtctggaatattctagtcagaagacagtgtattaagaagacagtgagtccccaggagaatacaagaatgtgcatcatgttaatatattatatataacataaatacctaacaacatctgtatatatagtataaacttaaagtacaaaaatattagtatattactatatgtaatataaatatatcagtgtaagatattagctattaaaatatacatatgtgtgtatgtatgtgtatatgtgtatataaatattatatatatatatagtaaccgctgatttgtgtggaagactttggtcagaagacagtgtattaagaagacagtgggtcctcacaggaaaataagaatatacatcatgtttatattatatataacataaacaactaattacatctgtatatacagcataaacataaagtacaaaaatatttgtatataatcgtatgtaatataaatataccagtgtaagatattagctattaaaatatacatgtgtgtatgtatgtgtatatgtgtacatataatatatatacatatataacatatataatatataagatatagcataataatataatatattatatataatatgtaatatgtaacatatattatataattaatatattctatgctatataatatataatatattctatgcaataaaatatatagcatatatatatatatagcaacagctgatttgtctggaagaatttggtcagaagacagtgtattaagaagacagtgagtccccagagaaatataagaatatacatcatgtttatattatatataacataaatagctaactacatctgtatatatagcataaacataaagcacaaaattatttatatataatataaatatatcagtgtaagatattagctattaaaaaatatatatatatagcaaccggtgatttgtctggaagactggtcagaagacagtgtattaggaagacaggcagtctccgcaggaagcatggtgcaggtgggatctggaggtgactctgggctgccagaagacgccccactgctttgcggcagacacaggtggagaggtcctctctgtagcttcagcatggacagtgtgtgtgtcttgctgtgggaacacttctttctgcttccctctccactgtgaccccatcacactcactgacctgccctcctccttcctctcgctctccggggcccctgtggaaagagggtcttccctccgtgcagcaggaacccccaggaccatccccatgctcctgggttctgaacttcagggacatatgatcctacctgaccgggcacaggctctgttcaccctcaggaacccctgtcctcccaggccaccgtggactggagaactggcctcctgaaaatccagagagaacttagcactcacaacttctttctttttttcttttttctttgagactggatcttgctcttttccccaggctggagtgcaatggcatgatctcagctcactgcaacctcctcctcccaggttcaagcagttcatcctgcctctgtctcccgagtatctgggatcacagtcatccacccccgcggccaactaatttctgtatttttagtagagacggggtttcaccatgttggccaggctggtctcgaactcttgacctcaagtgatccacccgcctcggcctcccaaagtactgggatgacatatattagcatgatgtatattcttctattcctccggggactcactgtcttcttgggcagtaaaccactgtgcccggacttctctgtccacatctgcacacatctaaacctctgtagattctgaattgtttttccttttgcacagaatgagaggaactgaagtcgggaggcccagccccaacacggtccctgtggctctgtgctcaggtggtttatggctgagaaggacttggggggttgagggcttcctatcagcccaggagacattacctgggtctgggaagcctgctctgcacttgtgggtctcgaattgtctgttgcatttacctgcctcattattttttcttcctgtctctcttcttacatatttctttcgaatttggagcttgtttttcttaactacaatcaacttgaatcattactgcatatataaatataaattttatattgagtagacattatatactcaatctactacacattccaacacgggccatatctaagacgaatatttatatttaatgtttaaaatatgtttacatttcatatagaaaaatatatttatatttaatatatatgtgtatatttaatacaggaaatatatatttatatttaacatataaaaatatatgtttatatttaatatgggaaatatatgctttgtttaatatacataatacatgttgatatttaatatagaaaaggtatagttatatttactatgcaaaatacatgtttatatttaatatagaaaatatgtttatatttaatgtacaggatacatatttacatttaatatagaaaatacatatttatatttaacatacacagtatttatatttaatgtataaaatatgtttacatttaatgtgctgaatatatgcttatatttaatgtctaaaatgtctatatttaatgtactgtatacattaaatgtaccaaatgtattcttatatttaatgtataaaagaagtttatatttaacatataagatatgtttacatttaatgtataaaatgtttatgtttgatgtataaaagatgtttatatttaacgtatacaatttatatttaatgtaccaaatatattattatatttaatgtccaagccagccaagccagtcagccaagccagctaagccacccacccagccaagccagccaagtgagtcagctagccagccagccaagccagccaaaccagccaagccagtcagccagccaagccagccaagccagccagccagccaagccagccaagccagccaagcaagccagccagccaagccagccagccagcccaggagccccagccagccagccaacccaaacagccaagccagccaagccagccagccagccaagccagccaaggcagccaagccagccaagccagccaggcagccaagcaaaccaagccagccagccagacaaggcagccaagccagcaggccaagcgagccaagccaagccagccaagccagccagttagccagccaagccagccaagccagccagccagccaagccagcccagccagccagccagccagccgagccggccaagccagacagcgagcccagccagcccagccagtcagccagccaaaccagccagccagccaagccagccagccacccagccaagccagccacccagcaaagccagccaagagacccaagccagccagcaaagctggccaaaccagccaagccagtcagccaagccagccaagccggccacccagccaagccagacaagccagccaaccagccagacagcccagccagacagccagcccaggcagccaagagacccaagccagccagcgaagctggccaacccagccaagccagtcagccaagtcagccaagccggccacccagccaagccagccaagccagccaagccagtcagccagccagccagccaagccagccaagccagtcagccagccagccagccaagccagccaagcctcccagccagccaaaccagccaagccacccagccagccaagccagccaagccacctagccagccaggcccgccagccagccagccagcgagccaagccagccaagccagccagcctgccaagccagccggccagccaagctagccaatccactcagccactcaagccagccaagtcacccggccatccaagccagccaagccagtcagccagcccagacagccaagccagccaagccagccaagcccgccaaccagccaagacaggcatgctagccaagccagccaggcagcgaagccagccaagccagccagcaagcaaagccaggcatgtcagccaagccagccaggcagccaagccagcaaagccagccaagccagccagccagccaagccaggcatgccagccaagccatccagccagctaagccagccggctagccaagccagccaagccacccggccagccaagccagccagccaagccagccaagcctgccaagccagccaaccagccaagccagccagctagccaagccacccagtcagccagctagccaaaccagccaagccacccagccagccaagccacccagccagccaagccagccaagccacccggccatccaagccagccaagccagtcagcccagacagccaagccagccaagccagccaagcccgccaaccagccaagacaggcatgctagccaagccagccaggcagcgaagccagccaagccagccagcaaggaaagccaggcatgtcagccaagccagccaggcagccaagccagccaagccagccaagccagccagccagccaagccaggcatgccagccaagccatccagccagctaagccagccggctagccaagccagccaagccacccggccagccaagccagccagccaagcctgccaagccagccaaccagccaagccagccagctagccaagccacccagtcagccagctagccaaaccagccaagccacccagccagccaagccacccagccagccaagccagccaagccacccggccatccaagccagccaagccagtcagccagcccagacagccaagccagccaagccagccaagcccgccaaccagccaagacaggcatgctagccaagccagccgggcagccaagccagccaggcagcgaagccagccaagccagccagcaagcaaagccaggcatgccagccaagccagccaaccagccaagccagccagctagccaagccacccagccagccagccagccaaaccagccaagccacccagccagccaagccacccagccagccaagccagccaagccaatcagccagccaggcagccagccacccagccagccaagccagccaagccagccaagccaatcagccagccaggcagccagccacccagccagccaagccagccaagccacctagccagccaggcccgccagccagccagccaggcagccaagccagccaagccagtgaagcccgccagccagccaagacaggcatgccagccaagccagccaggcagccaagccagccaagccagccagccagccaagccaggcatgccagccaagccatccagccagctaagccagccggctagccaagccagccaagccacccggccagccaagccagccagccaagccagccaagccagccaaccagccaagccagccagctagccaagccacccagccagccagccagccaaaccagccaagccacccagccagccaagccacccagccagccaagccagccaagccaatcagccagccaggcagccagccacccaagccagccaagccagccaagccagccaagccacctagccagccaggcccgccagccagccagccaggcccgccagccagccagccaggcagccaagccagccaagccagtcaagcccgccagccagccaagacaggcatgccagccaagccagccaggcagccaagccagccaagccagccagccagccaagccaggcatgccagccaagccatccagctagctaagcccgctggctagccaagccagccaagccacccggccggccaagccagccaagccagccaaccagccaagccagccagctagccaagccacccagccagccagccagccaaaccagccaagccacccagccagccaagccacccagccagccaagccagccaagacagccaggcagccagccacccaagccagccaagccagccaagccggccaaaccagccaaccagccaagccagccagccatccaagccagccaagacagccagccagccaagccagtcaagccagccatacagccaagccagccaagccaggcaagccacccagccagccaagccatctagccatcaagccagtcaggccagccagccagcctgccaagccggccacccaccaagccagccagccatccacgccagccaagccagttagccagccagccaagccacccagccagccaagccagccaagccacacagccagccaagccacccagccagccaagacagccaagccacacagccagccaagccatccagccagccaagacagccaagccagccaagccatccagccagccacgcaagccaagccagccagccagccaagcaatccgtgccagccaagccatccagccagccaagcgaggtgtccggccaagccaccccaccagccaagccagccagccagccagccagccagccaagccacccagccaactaagccagccaaaccacccagccaggcatgccagccaagccacccagccagccaagcctgtcagccagcgaaccagccaagccagccatgccagccagccagccaagccatacaagccagccagccagccatgccaggacgagactccatctcaaaaaaaataaaaaaaaaacagcctggccaacatgatgaaaccccgtctctactaaatgtataaaaaattatctaggcgtggtggcacacgccagtaatcccagctactcgggaggcccaggcaggaggatcgctttaaccagggaggtggaggttgaagcgaaccaagattgcaccacctcattccagcctgggcaacagggtgagactcaatctcagaaaaagaaaaaaaaaaaggccagcctggccaacacggtgaaaccccatctctactaaatatgaaaagaaattagctgggcgtggtggcacatgaatgtaatcccagctactcgggaggcccaggcaggaggatagcttgaaccctgggggtggaggctacagcgagccaagattgcaccactgcactccagcctgggcaacagggcgagactccatctcagaaaaaataaaataaaatagaccagcctggccaacagggtgaaaccccatctctacaaaatatacagaaaaattagctgggggtggtggcacacacctgtaatcccagctactcgggaggcccaggaaggaggatcgcttgaatcagggaggtggaggctgcagcgagccaagattgcaccactgcactccagcctgggcaacagagtgagactccatctgaaaaaacagaagcattccagcctggccaatagagcgagactccatctcaaaaaaaaaaaaaaaaaaaaaaaaaacaccagcctggccaacatggtgaaaccccgtctcttctaaatatacaaaaaaaatagggccaggcgtggtggctcatgcctgtaatcccagcaccttgggaggccgaggtgggtggatcacgaggtcatgagatcgagaccagcctgaccaacatggtgaaaccccgtctctactaaaaatagaaaaattagctggatgtggtggcacatgcctgtaatccctgctactccggaggctgaggcaggagaattgcttgaacctaggaagcggaggttgcagtgagccgagatggcgccactgtactccacggtggtgtcagagtgatactacatctcaaaaaaaaaaaaaatagctgggtttgatggcacacacctgtaataccaggtactcgggaggcccaggcaggatgatcacttgaacccgggagggggtggttgccgtgaaccaagattgtaccactgcactccagcctgggcaacagggcgagactccatctcaggaaaaaaaaaaaaaaaagaccagcctggccaacatggtgaaaccccgtctctactaaatataaaaaaaattacctggatgtggtggcacatgcctgtgatcccagctgctcgggaggcccaggaaggaggatcgcttgaacctgggaggtggaggctgcagcgagccaagattgcaccactgcactccaccctggataacagaattagactctatatgaaaaaaaagaagaactccagccagggcaatagagtgagactccatctcaaaaaaaaaaaaaaaaaaaaaaaaagaccagcctggccaacatggtgaaaccccgtctctactaaatacacaaaaaaattagctgtgcgtggtggcacacgcctgtaatcccagctactcgggaggcctaggcaggaggatcgcttgaacccgggaggtggaggttgcagcgaaccaagattgcaccactgcactccagcctgggcaacagagcgagactccatctcaggaaaaaaaaaaaatatcagcctggctaacatggtgaaaccccgtctctactaaatatacaaaaaaaattagctgggcgtggtggcacacgcctgtaatcccagctacccgggaggcccaggcaagaagatctcttgaacccagaaggtatatgctgcagcgagccaagattgtcccaccgcacttccgcctgggcaacagagcgagactccgtctcagaaaaaaaaaaaaaaaaaaaaaacaagaacaggttggccaacatggtaaaaccatgtctctactaaatatacaaaaaaattagttaggcatggtggcacacgcctgtaatcccagctactcggaaggcccaggcaggaggatcgcttgaacccgggaggtggaggctgcagcaaaccaagattacaccactgcactccagcctgggcaacagggcgagactccatctcagaaaaaaaaaaaaagaccagcctggccaacatggtgacaccccgtctctagtaaatatataaaaaaattagctgggcatggtggcacacggctgtaatcccagctactcgggagccccaggcagtaggatcgcttgaacctgggaggtggaggctgcagcgagccaagatagcaccactgaactccagcctgggcaacagggtgagactccatctcagaaaagagagaaaaaaattaaaaaaagaccagcttggccgacatggtgaaacctcatctctactaaaaatacaaaagtattagctggccgtggtggcacacgcctgtaatcccagctactcgggaggcccaggaaggaggattgcttgaacctgggagtttgaggctgcagcgagccaaaattgcaccactgcactccacccgagtgagactccatctgaaaaaaagaactccagccacggcaatatagcgagactcaacctcaaaaaaaaaaaaaaaaaaaaaaaaaacaccagcctggccaatatggtgaaccccgtgtctactaaatatacaaaaaaattagctgggtgtcacggcacacgcctgtaataccagctacttggtaggcacaggcaggaggatcgcttgaacccgggaggtagaggctgcagtgagccaagattgcaccactgcactccagcctgggcaacagggtgagactccatctcagaaaaaaaaaaaaaacaaaaagagcagcctggccaacatggtgaaaccccgtcaatactaaatatacaaagaaattagctgtgcatggtggcacacgaatgtaatcccacatactcgggatgcccaggaaggaggatcgcttaaacccgggaggtggaggctgcagcgagccaagattgcaccactgcactcgagccagggcaacagggccagactccatctcaaaaaaaaaaaaaaagaccagcctgggcaacatggtgaaaccccatctctactaaatatacaaaaaaattgctgggcgtattgctacacacctgtaatccccgctacttgggaggcccagacaagaggatcacttgatcccgggaggtggaggctgcagcgagccaagattgtaccacagcacttcagcctgggcaacagagcgacactccatctcagaaaaaaaaaaaaaaaaaaaaaagaacaggttggccaacatggtgaaaccccatctctactaaatatacaaaataattagctgggcgtggtgacacacacctgtaatcccaggcaggaggattgcttgaacctgggaggtggaggctgcagccagccaggattgcaccactgcactccaccctgggcaaaatgtgagactccatctgaaaaaaaagaagcattccagcccgggcaatatagcgagactccaactcgaaaaaaaaaaagaccagctggccgacatggtgaaaccccatctctactaaatatacaaaaatattagctgggcgtggtggcacatgcctgtaatcccagctactcgggaggcccaggaaggaggatcgcttgaacccgggaggtagaggctgcagcggagccaagattgcaccactgcgctccatcctgggcaacagagtgagactctatatgaaaaaaaagcactccagcctgggcaatagagcgagactccatctcagaaaaaaaaaaaaaaagaaagaccagccttgccaacatggtgaaaccccgtctctactaaatatacaaaaaaattagctgggcgtcatggcacacgcctgtaatcccagctactcggtaggcccaggctggaggaatgcttgaacccgggaggtggaggttgcagcaaaccaagattgcacctctgaacgcctgcctgagcaacagggtgagattcaatctcagaaaaaaaaaaaaaaaaaaaaaaaagagcagcctggccaacatggtgaaaacccatcaatactaaatatacaaagaaattagctgagcatggtggcacacgaatataatcccagctactcgggaggcccaggtaggaggatcccttgaacccgggaggtggaggctgcagcgagccaagattgcaccactgcactccagcctgggcaacagggcgagactccatctcaaaacaacaacaacaacaacaacaacaacaacaaaaaacagcctgcccaacatggtgaaaccccgtctctactaaatatacaaagaaattagctgggcgtcatggcacacgaatgtaatcccagctactcgggagtcccagacaggaggatcgcttgaacctgggagttggaggctacagcgagccaagattgcaccactgcactctgctctgggtaacagagtaagagtccatctgaaaaaaaagaagcactccagcctgggcaacagagagagactccatctcagaaaaaaaaaaaaaaaaaaaaaaaaaaaaaagaccaggttggccaacatggtgaaatcccgtctctactaaatatacaaaaaaaattagctggacgtggtggcacaggcttctaatcccagctactggggaggcccaggcaggaggatcacttgaacctgggaggtggaggctgcagcgagccaagattgcaccactgcactctggcctgggcaacagagtgagagtccatctgaaaaaaaagaagcactccagtctggtcaacagagcgagactccatctcagaaaaaaaaaaaaaaaaaaaaaagaccaggttggccgacatggtgaaaccccgtctctactaaatacacaaaaaaattagctgggcgtggtggcacatgcctgtaatcccagctactcgagaggcccaggcaggaggatcgcttgaacctgggaggtggaggctgcagcgagccaagactgcaccactgcactccggcctgtgcaacaaagtgagactccatctgaaaaaaaaagaaacactccagcctgggcaatatagcaagactccatctcaaaaaaaaaaaaaaaaaggaaaaaagagcagcctgtccgacatggtgaaaccacgtctctactaaatatgcaaaaaaattagctgggcgtggtggcacacgcctgtaatcccagctactcgggaggcccaggcaggaggatcgcttgaacccgggaggtggaggttgcagcgaaccaagattgcaccactgcactccagcctgggcaagaaagtgagattccatctgaaaaaaaagcactccagcctgggcaatatagcaagactccatctcaaaaaaaaaaaaaaaaaaagaccagcctgtccaacatggtgaaaccccatcagtactaaatatacaaagaaattagctgagcgtggtggcacacgattgtaatcccagctactcgggaggcccaggcaggaggatcgcttgaactcgggaggtagaggctgcagccagccaagattgcaccactgcactgaaccctggacaacagagtgacactccatctgaaaaaaaagaagaactccaaccagggcaatggagcgagactccatctcagaaaaaagaaaaaaaaagagcaccttggccaacatggtgaaaccccgtcagtactaaatacacaaagaaattagctgagcatggtagcacacgaatgtaatcccagctactcgggaggcccaggcaggaggatcgcttgaacccgggaggtggaggttgcagcgaacaaagattgcaccactgcactccagcctgggcaacagagcgagactcccactcagaaaaaaaaacaaaatgaaaaaaaacaccagcctggccaacatggtgaaacaacgtctccactaaatatacaaaaaaaatagatgggcgtggtggcactcatctctaatcccagctactcgggaggccaacgcaggaggatcacttgaacacaggaggtggaggctgcagctagccaagtttgcaccattgcactccagcctggcaaaccaagccagccaagccaaccagccaagccagtcaagcgacccagccagccagccagccagctaagccacccaaccagccagcctgccaagccagccaagccagccagccagccagccggccaggcagccaagccaagccagccaagccagctagccagccaagtcagccaagccagctagccagccaagtcagccagccaaaccagccaagccacccagccagccaagccacccaagacacccagccagccagccagccaagccagccaagccacccagccagccaagccagccaagcaagccagccaagccagccaagccagccaagccaggagccagccaagccagccaagccagccaagcctgccaagcctgccaagccagccagccagccaagcctgcaaagccagccagccagcaaagccagccaagtcagcctgccaagccagccaagacaaccagcaagccaagccagccaagccagccaaggcagccaagccagtcagccagccaagctagccaagccaggcagccatccaagccagccagccatccaagccaatgaagccagccagccagccaagacacacaagccagccaactcagccagctagccaagcaagccaagccagccagccagtcaagccagccaagccagccagccaaccaggccagctaaaccagccagcctgccaagccagccaagccagccagccagccaggccagccagccaaacaaggcaccgcagccagcccagccagccacacaagccagccaagtcagccagccagccaagccagccaagccagcccgccaaggcagccatgccagccagccagccaagccagccaagccagccaagccagccagccacccagccagccaagccaggcagccacccagcaagccaggccagcctgccacccagccagccaagccagacaagccagccaagccagccagccacgcagccagccaggacatccagccacccagccagccaagccatgcaagccaacaagccagcccagacagccaagccagccaagcaagccagcaagccagccagccaagccagccagccaaaccagccaagccacccagccagccaagccacccaagacagccagccagccagccagccaagccagccaactagccaagccagccaagcaagccaccagccaagccagccaagcctgccagccagcagagccagccaaccagccaagccagccagccagccacttaagccatccaagcaacccagccagccaagccagccaagccaccgacccagccaagccagccaagccacccagccagccaagccagccaagccagccaaaccagcctgccagccaagccagccaagccatccagccagccaagccagccggccagccaagctagccaatccactcacccactcaaactagccaagtcacccggccagccaagcctgccaagccagctagccagcccagacagccaagccagccagccagccaagccagccaagccagccagccagccaatctagccaagccagccaagccagccaagccagccagccagccaagccagccaagccagccagccagccaagccagccggccagccaagctagccaatccactaagccactcaaaccagccaagtcacccggccagccaagccagccaagccagccagccagcaaagccagcccagccagccagccagccagccagccgagccgccaagccagacagcgagcccagccagcccagccagtcagccagccaaaccagccagccagccaagccagccagccacccagccaagccagccacccagcaaagccagccaagagacccaagccagccagcaaagctggccaaaccagccaagccagtcagccaagccagccaagctggccacccagccaagccagacaagccagccaaccagccagacagcccagccagacagccagcccaggcagccaagagacccaagccagccagcgaagctggccaacccagccaagccagtcagccaaaccagccaagccggccacccagccaagccagccaagccagcgaaccagccagacagccctgccagacagccagcccaggcagccaaaccagacaagccagccagccaagccagccaagccagccagccagccaagacaggccagccaagcaagccatggaagccagacagccagccagccaagctagccaacccagccagccaagctagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccagccaagccacccagccagccaagccggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccagggagccaagccagccagcaagcaaagccaggcatgccagccaagccagccaggcagccaagccagccaagccagccagccagccaagccaggcatgccagccaagccatccagccagctaacccagccagcaagcaaagccaggcatgccagccaagccagccagccagccaagccagccaagccagccagccagcccagccagtcagccagccaaaccagccagccagccaagccagccagccacccagccaagccagccacccagcaaagccaaccaagagacccaagccagccagcaaagctggccaaaccagccaagccagtcagccaagccagccaagccggccacccagccaagccagacaagccagccaaccagccagacagccctagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccagccaagccacccagccagccaagccggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccaggcagccaagccagccaagccagccagccagccaagccaggcatgccagccaagccatccagccagctaagccagccagcaagcaaagccaggcatgccagccaagccagccagccagccaagccagccaagccagccagccagcccagccagtcagccagccaaaccagccagccagccaagccagccagccacccagccaagccagccacccagcaaagccaaccaagagccccaagccagccagcaaagctggccaaaccagccaagccagtcagccaagccagccaagccggccacccatccaagccagacaagccagcaaaccagccagacagcccagccagacagccagcccaggcagccaagagacccaagccagccagcgaagctggccaacccagccaagccagtcagccaagccagccaagccggccacccagccaagccagccaagccagcgaaccagccagacagccctgccagacagccagcccaggcagccaaaccagacaagccagccagccaagccagccaagccagccagccagccaagacagccaagccagtcaagccaggcaagccagcgagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagccaagccagtcagccagaaaagccagccaagcctgccagccagtcaagccagccaagccagccagccagccaagccggccaagccactcagccagccaagatggccaagccacccagccagccaagcctgccaagagacccagcaacccaagccagccaagacacccagccagccaagctagccaagacacccagccagcgaagccagccagccagccagccagccaagccagccaagccacccagccagccaagccaggcaaacaacccagccagccaagccagtcaagccacccagccagccaagccggccaagccacccagccagccaagctggccaagtcactcagccagccaagccagccagccagccaagccggccaagccactcagccagccaagatggccaagccacccagtcaagccaactaagccagccaagccacccagccagccaagctggccaagccactcagccagccaagccagccagccagccaagccggccaagccactcagccagccaagatggccaagccacgcagtcaagccagccaagccagccaggcagccaagccagccaagacctccagccagccaagaaaggcatgccagccaagccagcaaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagccagccaagacacccagccagccaagctagccacgacacccagccagcgaagccagccagccagccagccagccaagcctgccaagccacccagccagccaagccaggcaaacaacccagccagccaagccagtcaagccacccagccagccaagccagccaagccagccaagccacccagccagccaagctggcaagccactcagccagccaagccagccagccagccaagccggccaagccactcagccagccaagatggccaagccacccagtcaagccagctaagccagccaagccacccagccagccaagccagccaagccactcagccagccaagccagccagccagccaagccggccaagccactcagccaaccaagatggccaagccacgcagtcaagccagccaagccagccaggcagccaagccagccaagacctccagccagccaagaaaggcatgccagccaagccagcaaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagccagccaagacacccagccagccaagctagccacgacacccagccagcgagaggcagctaggcagctagccaagcctgcccagccagctcgagccagctaagccaggccaagcaagctagccatccaagcttgacaagccagccaagcatgccagccaagccagcgcagctggagccagccaagccagccaagccagccaagcctgccaagccagccagccagccaagcctgcaaagccagccagccagcaaagccagccaagtcagcctgccaagccagccaagacaaccagcaagccaagccagccaagccagccaaggcagccaagccagtcagccagccaagctagccaagccaggcagccatccaagccagccagccatccaagccaatgaagccagccagccagccaagacacacaagccagccaactcagccagctagccaagccagccaagccagccagccagtcaagccagccaagccagccagccaaccaggccagctaaaccagccagccagccaggccagccagccaacccagccaccgcagccagcccagccagccacacaagccagccaagtcagccagccagccaagccagccaagtcagccaagccagccagccagccaagccagccaagccagccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccagccagccaagccggccaagccagccagccagccaagccagccaagccagccagccagccaagccagccaagcaagccagcaagccagccagccaagccagccagccaaaccagccaagccagccagccagccaagcgctttacccgaacgtccgtgaggcagtgagagccaaagcagcctgccagccaagccagccaagccatccagccagccaagccagccagccagccaagctagccaatccactcacccactcaaactagccaagtcacccggccagccaagcctgccaagccagctagccagcccagacagccaagccagccagccagccaagccagccaagccagccagccagccaagccagccggccagccaagctagccaatccactaagccactcaaaccagccaagtcacccggccagccaagccagccaagccagccagccagcaaagccagcccagccagccagccagccagccagccgagccggccaagccagacagcgagcccagccagcccagccagtcagccagccaaaccagccagccagccaagccagccagccacccagccaagccagccacccagcaaagccagccaagagacccaagccagccagcaaagctggccaaacccgccaagccagtcagccaagccagccaagccggccacccagccaagccagccaagccagccaaccagccagacagcccagccagacagccagcccaggcagccaagagacccaagccagccagcgaagctggccaacccagccaagccagtcagccaagccagccaagccggccacccagccaagccagccaagccagcgaaccagccagacagccctgccagacagccagcccaggcagccaaaacagacaagccagccagccaagccagccaagccagccagccagccaagacagccaagccagtcaagccaggcaagccagcgagccagccaagccagccaacccagccagccaagccagccaagacagccagccagccaagccggccaagccagccagccaagcaagccatggaagccagacagccagccagccaagccagccaacccagccagccaagccagccaagccagccaagccagtcagccagaaaagccagccaagcctgccagccagtcaagccagccaagcctgccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccggccaagccacccagccagccaagccggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagcctgccagccaagccggccaagccagccagccagccaagccagccaagccagccagccagccaagccagccaagcaagccagcaagccagccagccaagccagccagccaaaccagccaagccagccagccagccaagccacccaagacacccagccagccagccagccaagccagccaagccacccagccagccaagccagccaagcaagccaggcaagccagccaagccagccagccagccagccacccagccacccagccagccaagccagccagccacccagccggccaggccagcctgccacccagccagccaagccagacaagccagccaagccagccagccagccagccagccagccagccaagccagccaagcctcccagccagccaagccagccaagccacccagccagccaagccagccaagccacctagccagccaggcccaccagccagccagccaggcagccaagccagccaagccagtcaagcccgccagccagccaagacaggcatgccagccaagccagccaggcagccaagccagccaagccagccaggcccgccagccagccaagacaggcatgccagccaagccagccaggcagccaagtcagccaagccaggcagcaagcaaagccaggcatgccagcccagccagccaggcagccaagccagcaaaaccagccagccagccaagccaggcatgccagccaagccatccagccagctaagccagccggctagccaagccagacaagccacccggccatccaagccagccagccaagccggccaagccagccaaccagcaaagccagtcagctagccaagccagccaaccagccagccagctaagctggccagcctgccagccaaccaagccggccagacagccaaggcagccaagccggccaggcagccaagccagccaagccaccgacccagccaagccagccaagccacccaagccacccagccagcccagacagccaagccaggcagccagccaagccagccagccagcaaagccaggcagccagccaagccagtcaagccagacagccagccaagccagccagccagccaagcgagccaagccagccagccagccaggccagccagccacccagccagccaagccagccagccacccaaccagccaggccagcctgccacccagccagccaagccagacaagcctgcgaagccagtcagccacccagccagccaggccagccagccacccagtcagccaagccatccaagccagccggccagcacagacagccaagccagccacccagtcagccaagccatccaagagagccagccagcccagacagccaagccagccagccagccaagccagccaagcaagccagcaagccagccagccaagccagccagccaaaccagccaagccacccagccagccaagccacccaagacacccagccagccagccagccagccaagccagccaagccacccagccagccaagccagccaagcaagccagccaagccagcgcagccaggagccagccaagccagccaagccagccaagcctgccaagccagccagccagccaagcctgcaaagccagccagccagcaaagccagccaagtcagcctgccaagccagccaagacaaccagcaagccaagccagccaagccagccaaggcagccaagccagtcagccagccaagctagccaagccaggcagccatccaagccagccagccatccaagccaatgaagccagccagccagccaagacacccaagccagccaactcagccagccagccaagccagccaagccagtcagccagccaagccagccaagccagccaagccagtcaagccagtcagccagccaagccagccaagccagccagccagcccagacagccaagccagccagccagccaagccagccaagcaagccagcaagccagccagccaagccagccagccaaaccagccaagccacccagccagccaagccacccaagacacccagccagccagccagccaagccagccaagccacccagccagccaagccagccaagccagccaagcctgccaagccaaccatccagccaagcctgcaaagccagcccgccagcaaagccagccaagtcagcctgccaagccagccaagacagccagcaagccaagccagccaagccagccagccaagccagctagccaagccagccaaggcagccaagccagtcagccagccaagctagccaagccaggcagccatccaagccagccagccatccaagccaatgaagccagccagccagccaagccacccaagccagccaagccagccagccaagccagctagccaagccagccaaggcagccaagccagtcagccagccaagctagccaagccaggcagccatccaagccagccagccatccaagccaatgaagccagccagccagccaagccacccaagccagccaagccagccaactcagccagccagccaagccagccaagccagccagccagtcaagccagccaagccagccagctaaccaagccagctaaaccagccaagcctgccaagccagccaagccagccaagccagccagccagccagccatcccagccagcccagccagccaagccagccagccacccagccggccaggccagcctgccacccagccagccaagccagacaagccagccaagccagccagccagccaagccagccaagcctcccagccagccaagccagccaagccacccagccagccaagccagccaagccacctagccagccaggcccaccagccagccagccaggcagccaagccagccaagccagtcaagcccgccagccagccaagacaggcatgccagccaagccagccaggcagccaagccagccaagccagccaggcccgccagccagccaagccaggcatgccagccaagccagccaggcagccaagccagcaaaaccagccagccagccaagccaggcatgccagccaagccatccagccagctaagccagccggctagccaagccagacaagccacccggccatccaagccagccagccaagccagccaagccagccaaccagcaaagccagtcagctagccaagccagccaaccagccagccagctaagctggccagcctgccagccaaccaagccggccagacagccaaggcagccaagccggccaggcagccaagccagccaagccaccgacccagccaagccagccaagccacccagccagcccagacagccaagccaggcagccagccaagccagccagccagcaaagccaggcagccagccaagccagtcaagccagacagccagccaagccagccagccagccaagcgagccaagccagccagccagccaggccagccagccacccagccagccacccagccagccagcccagccagccaagccagccagccagcccagccagccccgccagccagccaacccagccaccgcagccagcccagccagccacacaagccagccaagtcagccagccagccaagtcagccaagccagcccaccaaggcagccatgccagccagccagccaagccagccaagccagtcagccagccaagccagccaagccagccagccagccaagccagccaagccagccaagtcaactgagccagccaagccagtcagccaagccaggcaagccagcaaagtcagccagccagccaagccagccaagccagcccagccagcccagccagctaagccagcccagccagccagccaagccatccaagccagccagccagccagccagcccagccagccaagccagcccagccagccaaccaagccagccagccagccatgccagccaagccagccagccatccaagccaaccaagccagccagccaagccagccaagccagccaagccagccaagccacccaggcagccaagccagccaagccagccaagccagccaggcagccaagccagccaagccagccaagccagccagccaagccagccagccagccaagagagccaagccagccatccagccaggccatccagccacccagccagccaagccagcctgccacccaaccagccaggccatccagccacccagccagccaagccagcctgccacccaaccagccaggccagcctgccacccagccagccaagccagacaagcctgcgaagccagtcagccacccagccagccaggccagccagccacccagtcagccaagccatccaagccagccggccagcacagacagccaagccagccacccagtcagccaagccatccaagagagccagccagcccagacagccaagccagccagccagccaagccagccaagcaagccagcaagccagccagccaagccagccagccaaaccagccaagccacccagccagccaagccacccaagacacccagccagccagccagccaagccagccaagccacccagccagccaagccagccaagcaagccagccaagccagccaagccaggagccagcccagccagccaagccagccagccacccagccacccaagacagctaaaccagccagcctgccaagccagccaagccagccagccagccaggccagccaagccagccaagccattcaagccagccagccagcccagccagccaagccagccagccagcccagccagcccagccagccagccaacccagccaccgcagccagcccagccagccacacaagccagccaagtcagccagccagccaagccagccaagccagcccgccaaggcagccatgccagccagccagccaaaccagccaagccacccagccagccaagccacccaagacagacagccagccagccaagccagccaactagccaagccagccaagcaagccaccagccaagccagccaagcctgccagccagcagagccagccaaccagccaagccagccagccagccaaaccagccaagccagccagccagccacttaagccatccaagcaacccagccagccaagccagccaagccaccgacccagccaagtcagccaagccacccagccagccaagccagccaagccagccaaaccagcctgccagccaagccagccaagccatccagccagccaagccagccagccagccaagctagccaatccactcacccactcaaactagccaagtcacccggccagccaagcctgccaagccagctagccagcccagacagccaagccagccagccagccaagccaaccaagccagccagccagccaagccagccggccagccaagctagccaattcactaagccactcaaaccagccaagtcacccggccagccaagccagccaagccagccagccagcaaagccagcccagccagccagccagccagccagccgagccggccaagccagacagcgagcccagccagcccagccagtcagccagccaaaccagccagccagccaagccagccagccacccagccaagccagccacccagcaaagccaaccaagagacccaagccagccagcaaagctggccaaaccagccaagccagtcagccaagccagccaagccggccacccagccaagccagccaagccagccaaccagccagacagcccagccagacagccagcccaggcagccaagagacccaagccagccagcgaagctggccaacccagccaagccagtcagccaagccagccaagccggccacccagccaagccagccaagccagcgaaccagccagacagccctgccagacagccagcccaggcagccaaaccagacaagccagccagccaagtcagccaagccagccagccagacaagacagccaagccagtcaagccaggcaagccagcgagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccagccaagcctgccaagccacccagccagccaagccaggcaaacaacccagccagccaagccagtcaagccacccagccagccaagccagccaagccacccagccagccagccggccaagccactcagccagccaagccagccagccaggccagccgggcaagccattcagccaggcaagatggccaagccacccagtcaagccagctaagccagccaggcagccaagccagccaagccagccaagacctccagccagccaagaaaggcatgccagccaagccagccaggcagccaagccagccagcaagcaaagccaggcatgccagccaagccagccagccagccaagccagccaagccagccagccagccaagccaggcatgccagccaagccatccagccagctaagccagccggctagccaagccagacaagccacccggccagccaagccagccagccaaggcagccaagccagccaaccagtcaagccagtcagctagccaagccagccaaccagccagccagtcaagccggccagcctgccagccaaccaagctggacagacagccaaggcagccaagccggccaggcagccaagccagccaagccactgacccagccaagccacccagccagccaagacagccaagccagccaaaccagcctgccagccaagccagccaagccatccagcctgccaagccagctggccagccaagctagccaatccactcacccactcaagccagtcaagtcacctggccagccaagccagccaagccagccagccagcccagagagccaagccagccagcccagacagccaagccagccagccagccaagcctgccaagccacccagccagccaagccaggcaaacaacccagccagccaagccagtcaagccaaccagccagccaagccagccaagccacccagccagccaagctggccaagccactcagccagccaagccagccagccagccaagccggccaagccactcagccagccaagatggccaagccacccagtcaagccagctaagccagccaagccagccaagacctccagccagccaagaaaggcatgccagccaagccagccaggcagccaagccagccagcaagcaaagccaggcatgccagccaagccagccaggcagccaagccagccaagccagccagccagccaagccaggcatgccagccaagccatccagccagctaagtcagccggctagcccagccagccaagccacccatccagccaagccagccagtcaagccagccaagccagccaaccagtcaagccagtcagctagccaagccagccaagccacccggccagccaagccagccagccaacccagcccagccagccaaccagccaagacattcagctagccaagccagccaaccagccagccagtcaagccggccagcctgccagccaaccaagccggacagacagccaaggcagccaagccggccaggcagccaagccagccaagccaccgacccagccaagccacccagccagccaagacagccaagccagccaaaccagcctgccagccaagccagccaagccatccagcctgccaagccagctggccagccaagctagccaatccactcacccactcaagccagccaagtcacccggccagccaagccagccagctcagacagccaagccagccagccaagccagccaagccagccagccagccaagccggccaagccactcagccagccaagatggccaagccacgcagtcaagccagccaagccagccaggcagccaagccagccaagacctccagccagccaagaaaggcatgccagccaagccagctaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagcaagcaaagacacccagccagccaggttagcaaagacacccagcagggagccagccagcaagccagcgagccaagctgggcaaggccaccaagcgagcccggcagctcagtcagtcacagaggccagcagaccgtggtcaagccacccagccagctaagcagatctacgcacaagctctccaagccactcagccagctaagctagccagcagtcaagccggccaagccactcagccagccacggcgccaagccacgcagtcaagccagccaagctagccaggcagccaaggcagccaagccagccaagacctccagccagccaagaaaggcatgccagccaagccagccagggagccaagccagccagcaagcaaagccaggcatgccagccaagccagccagggagccaagccagccagcaagcaaagccaggcatgccagccaagccagccaggcagccaagccagccaagccagccagccagccaagccaggcatgccagccaagccatccagccagctaagccagccagcaagcaaagccaggcatgccagccaagccagccagccagccaagccagccaagccagccagccagcccagccagtcagccagccaaaccagccagccagccaagccagccagccacccagccaagccagccacccagcaaagccaaccaagagacccaagccagccagcaaagctggccaaaccagccaagccagtcagccaagccagccaagccggccacccagccaagccagacaagccagccaaccagccagacagccctgccagacagccagcccaggcagccaaaccagacaagccagccagccaagccagccaagccagccagccagccaagacagccaagccagtcaagccaggcaagccagcgagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccacccagccagccaagccaggcaaacaacccagccagccaagccagccaagccacccagccagccaagctggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccaggcagccaagccagccaagccagccagccagccaagccaggcatgccagccaagccatccagccagctaagccaaccagcaagcaaagccaggcatgccagccaagccagccagccagccaagccagccaagccagccaaccagtcaagccagtcagctagccaagccagccaagccacccggccagccaagccagccagccaacccagccaagccagccaaccagccaagacattcagctagccaagccagccaaccagccagccagtcaagccggccagcctgccagccaaccaagccagccagacagccaaggcagccaagccggccaggcagccaagccagccaagccaccgacccagccaagccacccagccagccaagacagccaagccagccaaaccagcctgccagccaagccagccaagccatccagcctgccaagccagctggccagccaagctagccaatccactcacccactcaagccagccaagtcacccggccagccaagccagccaagccagccagccagcccagacagccaagccagccagcccagacagccaagccagccagccagccaagccagccaagccacccagccagccaagccagccagccaaaccagccaagccacccagccagccaagccacccaagacagccagccagccagccaagccagccaactagccaagccagccaagcaagccaccagccaagccagccaagcatgccaaccagcagagccagccaaccagccaagccagccagccagccaagccagccaagccagccagccagccactcaagccatccaagcaacccagccagccaagccagccaagccacccagccagccaagccagccaagccagccaaaccagcctgccagccaagccagccaagccatccagccagccaagccggccggccagccaagctagccaatccactcacccactcaagccagccaagtcacccggccagccaagccagccaagccagccagccagcccagacagccaagccagccagcctagacagccaagccagccagccagcaaagccagccaagccagccagccagccaagccagccaagccacccagccagccaagccagccagccaaaccagccaagccacccagccagccaagccacccaagacagccagccagtcagacaagccagccaactagccaagccagccaagcaagccaccagccaagccagccaagcatgccaaccagcagagccagccaaccagccaagccagccagccagccaagccagccaagccagccagccagccactcaagccatccaagcaacccagccagccaagccagccaagccacccagccagccaagccagccaagccagccaaaccagcctgccagccaagccagccaagccatccagccagccaagccagccggccagccaagctagccaatccactcacccactcaaactagccaagtcacccggccagccaagccagccaagccagctagccagcccagacagccaagccagccaggcagccaagccagccaagccagccagccagccaagctagccaagccagccaagacagccaagccagccagccagccaaaccagccagccagccaagccagccagccacccagccaagccagccacccagcaaagccagccaagagacacaagccagccagcaaagctggccaaaccagccaagccagtcagccaagccagccaagccggccacccagccaagccagccaagcctgccaaccagccagacagcccagccagacagccagcccaggcagccaagagacccaagccagccagcgaagctggccaacccagccaagccagtcagccaagccagccaagccggccacccagccaagccagcaaagccagccaaccagccagacagccctgccagacagccagcccaggcagccaaaccagacaagccagccagccaagccagccaagccagccagccagccaagacagccaagccagtcaagccaggcaagccagcgagccagccaagccagccaacccagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagtcagccagaaaagccagccaagcctgccagccagtcaagccagccaagccagccagccagccaagcggccaagccgcccagccagccaagatgccaagccacccagccagccaagcctgccaagagacccagcaacccaagccagccaagacacccagccagccaagctagccaagacacccagccagcgaagccagccaagacagccagccagccaagccgccaagccagccagccaagcaagccatggaagccagacagccagccagccaagccagtcagccaagccagccaagccggccacccagccaagccagccaagccagcgaaccagccagacagccctgccagacagccagcccaggcagccaaaccagacaagccagccagccaagccagccaagccagccagccagccaagacagccaagccagtcaagccaggcaagccagcgagccagccaagccagccaacccagccaagccagccagccagccaagcggggggagccactcagccagccaagatggccaagccacgcagtcaagccagccaagccagccaggcagccaagccagccaagacctccagccagccaagaaaggcatgccagccaagccagctaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccagccaagccgcccagccagccaagctggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccaggcagccaagccagccagcaagcaaagccaggcatgccagccaagccagccaggcagccaagccagccaagccagccagccagccaagccagccaagccagccagccagccaagccaggcatgccagccaagccatccagccagctaagccagccggctagccaagccagacaagccacccggccagctaagccagccagccaaggaagccaagccagccaaccagtcaagccagtcagctagccaagccagccaagccagccagccagccaagccaggcatgccagccaagccatccagccagctaagtcagccggctagcccagccagccaagccacccatccagccaagccagccagtcaagccagccaagccagccaaccagtcaagccagtcagctagccaagccagccaagccacccggccagccaagccagccagccaacccagcccagccagccaaccagccaagacattcagctagccaagccagccaaccagccagccagtcaagccggccagcctgccagccaaccaagccagccagacagccaaggcagccaagccagccaggcagccaagccagccaagccactgacccagccaagccacccagccagccaagagagccaagccagccaagccagccaaaccagcctgccagccaagccagccaagccatccagcctgccaagccagctggccagccaagctagccaatccgctcacccactcaagccagccaagtcacccggccagccaagccagccaagccagccagccagctcagacagccaagccagccagccaagccagccaagccagccagccagccaagccagccaagccacccagccagccaagccagccagcaagccagccagacagccaagccagccagccacccagccagccagtccagccagccacccagccagccaagccagccagccatccagccagccaggccagcctgccacccagccagccaaggcagacaagccagccaagccagccagccacccagccagccaggccagccagccactcagccagcccagacagccaagtcagccaagtcagccagccagccaaggcagccaagccagccaaccgaacaagagagccagccaaccaagccagccaagccagccagctagccaagccacccagccagccagccagccaaaccagccaagccacccagccagccaagccagccaagccaatcagccagccaggcagccagccacccaagccagccaagccagccaagccatccaagccagccagccagccagccagccaagccagccaagcctcccagccagccaagccagccaagccacccagccagccaagccagccaagccacctagccagccaggcccgccagccagccagccagccaaaccagccaagccacccagccagccaagccagccaagccaatcagccagccaggcagccagccacccaagccagccaagccaaccaagccatccaagccagccagccagccagccagccaagccagccaagcctcccagccagccaagccagccaagccacccagccagccaagccagccaagccacccggccatccaagccagccaagccagtcagccagcccagacagccaagccagccaagccagccaagcccgccaaccagccaagacaggcatgctagccaagccagccaggcagccaagccagccaggcagcgaagccagccaagccagccaggcagcgaagccagccaagccagccagcaagcaaagccaggcatgccagccaagccagccagctagccaagccacccagccagccagccagccaaaccagccaagccacccagccagccaagccacccagccagccaagccagccaagccaatcagccagccaggcagccagccacccagccagccaagccagccaagccacctagccagccaggcccgccagccagccagccaggcagccaagccagccaagccagtcaagcccgccagccagccaagacaggcatgccagccaagccagccaggcagccaagccagccaagccagccagccagccaagccaggcatgccagccaagccatccagctagctaagccagccggctagccaagccagccaagccacccggccggcaaagccagccaagccagccagctagccaagccacccagccagccagccagccaaaccagccaagccacccagccagccaagccacccagccagccaagccagccaagacagccaggcagccagccacccaagccagccaagccagccaagccggccaaaccagccaaccagccaagccagccatccatccaagccagccaagccagccaggcagccaagccagccaagccagccagccagccaagccagcgaagacaccgagccagccaaacaagccaagccacccagccagccaagcctgccaagagacccagcaacccaagccagccaagacacccagccagccaagctagccaagacacccagccagcgaagccagccagccagccagccagccaagcctgccaagccacccagccagccaagccaggcaaacaacccagccagccaagccagtcaagccacccagccagccaagccggccaagccacccagccagccaagctggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccaggcagccaagccagccagcaagcaaagccaggcatgccagccaagccagccaggcagccaagccagccaagccagccagccagccaagccaggcatgccagccaagccatccagccagctaagccagccggctagccaagccagccaagccacccggccagccaagccagccagccaagccagccaagccagccaaccagtcaagccagtcagctagccaagccagccaagccacccggccagccaagccagccagccaacccagccaagccagccaaccagccaagacattcagctagccaagccagccaaccagccagccagtcaagccggccagcctgccagccaaccaagccggacagacagccaaggcagccaagccggccaggcagccaagccagccaagccaccgacccagccaagccacccagccagccaagacagccaagccagccaaaccagcctgccagccaagccagccaagccatccagcctgccaagccagctggccagccaagctagccaatccgctcacccactcaagccagccaagtcacccggccagccaagccagccaagccagccagccagcccagacagccaagccagccagcccagacagccaagccagccagccagccaagccagccaagccagccagccagccaagccagccaagccacccagccagcccagacagccagcaagccagccagacagccaagccagccagccacccagccagccaggacagccagccacccagccagccatccagccagccaagccagccagccatccagccagccaggccagcctgccacccagccagccaagccagccaagccagccaagccagccagccacccagccaagccagccacccagcaaagccagccaagagacccaagctttttcagccaccagccatcactatcctcttgttttcaaacaggattgggatttgattatttcaaacccttcatgggattgaaactttgtcttaagtcagtgactactacatttccaagtactttcgaggagacatattttcatgtgtttttttgcatagctctggatttcaacttacacacccagaaatgtcacctttagaggcccctttgttgagtacatttgatctcaagtattccaggtctggggatggatctagctggaaaatgttcagacactgaagtttctagagcctgaagatgctcccctatcaggtaccaggaccagccagatctcattctctgactctacataacttctgacaaatgaaatgaagtttccgtttttggccaaccatggagcctgctccgtgtctgatattcttctttgaagactgaggatgtgacctgattgttctctgcctcctttttctagctacatttttttttttagctggttctcacacgggctttccatggcctctctctgattgtggggactggccgtttcccaggcacagcaccttggcctgggggagccgtgagaactgatgagtgtcttttgaaggagtcactgggcttctgcaatgggaggatcttggtgtgtggggagcgtgggaacttttccttttgttggttcaggaatgaaattgttgtgtaaatggaccaagagacctaaggaaagggacagtccttttggctggtgggtcctctccactgatagatccaaacaacagagtggaaaatgtaccacaagaagactacgctcgttgcctggaactcagtagcccctgtggctggtgttggcacttgccttaccagtgtgagcctggttttcccgatcatttggccttccacaataaggacaatttaagagattatttctcaatgttaactacttccttgattaattttgtgatctacctttctcctttctgaccagtagtagaatccatttatgttttcaagatgttgctacttaggatacaattatttctaagaaatacaagtgacattgctttgtagaatgggaaccatgttctacagccctgcaaagacctgtcctgagagagctggggggacgcaggcttggaggaggtgagggcaggcactgagtgggtggagggaatcaaacggctgccagaataaacatcagatggagctcctgggcttcttgaggggtagaatttcctctgagctctctacaagacctcagccacaaccattcatctacttaatacattgaagcaattcacataaaaagccagacagatttttttctctgaatttaaaactggatttagagactagattaataaatattgtctttgtcatgtgagtcactttggagagaatcatgtccccactgtatggcaatgcagcagatcctgaccatgcatatttagtgtgtccttcctgctctcttgggcagaccatcccatcaggctatagcacggagctctcacccatctccctgctctgccatgcaccctccttcttgcctgctctttcttctccctatggccagcccctccagccaacatactttttatctctctttgttttgcaaaatccttttctcctatcacttccatcataaaactagtatttggcaaacaatcacatgtcggcataaagctcttaaattgacctgctttagattaaagcacaatatgggttttatagtttgcctcaggtgaccatttaaatgtcttgaataatgaaatgaaaaactggacagactaaaataagagtcctgtctgcctgtgacagtgaagaataagagtcctgtctgcctgtgacagttaaagaatgatccctcattgcctctcacacagctgcagtcagggttcccaccaccctttctgctgattctgaaatcagccctagttcataaattatcagggaatttggtgagttttctcttttaatgtcagtctgtttatttgactggtagtttctggccttaacacatcccactaatgtgttgtttagttgagcacaataataaatagaacttttgtttacttttacatccaaagataaatgttgagtgctattaaaaacttttctaacatagtaggcctccaatgaggaattttccttcagcaaatcataaaactgggtctagaagtgccaacccaagtaaaattactgatgaactaatcatagttgttatttttccttcatcttttcctttttttttttagacaatcttgccctgtcgcccaggctggagtgcagtggcgtgatctcggcttgctgcaagctctgcctcctgggttcacgccattctcctgcctcagcctcccgagtagctgggactacaggcgcccgccaccatgcctggctaattttttttgtatttttaatagagacggggtttcactgtgttagccaggatggtctcaatctcctgacctcgtgatccgcccaccttggcttcctaaaatgctgggattacaggtgtgagccactgcgcccggctccttcatcttttctatgtgctttgtttgacacttattgaggatacagttgctgaagaccagctgagtaggacataggctctgtcatgcattaactcatccacccattcatttattcactcatctattgagcatctgctatgtgtcaggctctatgccaaactttctgttcaggagccaatatatcaataactacagtgtaagctaagtcatgcaatgaaagacttagagaatagacaccaagttgaatattaacccaagtaaattattggaagatatattagttatctaaaataggcttaaaacaataaacatttattatcacaatttctgtaggtccagaatctggacatgacttagcttgatgtttatggctcaagacctcttgaggtttcaataaaggtgttagtcagggctgcagtctcatctgaaggctcatctggttgggggtggtgtctgtatctatgtggttattggcaggccttggtcctcactacactggaactcttcaaagggttatctcatgacacagaagctagctttccccagggtgaagaatgtaaaagaatgtgagaactcttaagacagatgctatagtcttttctataacttaattttggaagtgatattccatcacttctgccatattctttgttagaatcaagtcagtaaatccagcccagattcaagtgaaaggattccacaagagtgtgagtaccaagaggtagggatattgggagccatctgagaggctgcttaccacagagggccagccagttaggaagtgggttcagctgctgctgttaacaggctcgacctaagtggcttaaacacagaagagttgttgttgttgttgttttttctaatgagaaatctggaggcagtcagttgctggccttggctcaaaggctgagggcactgtggttcttgtagcctttcgcttatggccctaagctgctggaactcttgccatcatgtctgcattccaagcagcagaacaacaagaaaagaacagggggagaagagaaagagggcaccagcccactgactatcctgttcatcctgggaagtaccactcaacaagctcaactctcatttccacagccatctccagctgctcaggagtctgggaaatgtaatcacatgcaccattatccccaagtgcaccactgcctccagcccctttccacctttcagttatagccataaacatccagttagccataaacattcagctaatgcatgtgcagattcttgatctacagaaattgtgatagtaaatatttattgttttaagtctatcttagatcactaacatatcctctacttaacatttcacttgggttaatattcagcttagtgtctattctcaagttttccattgtatgtcttcgttcgcactctcctcattgaaatattggctcctgattagaatgcttgagtactgttcttttataccaccaagcctgctcctcaagccgattttgtgccccgcaagccagcgatggctctattaatggttgtccttgtcttttatgagttcatgtgactgggtgggggagattcaacacccaccctcatgctgctcactctcaagtaaacaagtaagccaacattagagtctcagggctatgaatgggagcacagaaatcacagtgcaacctcccaagtacaggtcaggaagcctggtttaaatatttgaaagcaatttgaggaagttcccagtgggaaatgaacttgagaactaggtcattcatatgtccattcaacatctaccttctgcttatctggagtgtgcatggcactgcctggggccactgcagtgaataagagagatgagaacccaggcaactccgagagacccagtcccacctgctttgctggcaggggcttaggatgcagtcactttccattaaagtcagagtcctggagtcccatctgctttgcttctgcattccctacaatgatgagtggttaggagtccaggtctcagagaaagactgtctaggtgtgggtccccaccttgtcacttctgtgtccccttgtgtgagctgctggacatctctgggcctcagtttcctaatttataatgtggttgcctgtcagaggattacatgagaagatgcatattgcttagcgtagtgccaagggcatagtaatagcccaacacttattaaccacgttgatgatggctatggagatgatggtgatgatgacaatgatgttgatgatgacaatggtgatgattatgattcagtttctattctaagatgtggttacagtttcctaactttgggagatatgcctatctgtatatatcacggcatagtctctttctcttattgtagagaaaacaccttcacattatagatgcaccgcttggccttcctatctctcagtgtagaggagactctggaattcctcttgactggtccagatgcccacaaaattctacagacaagcagcaccaaacttaagagcatacatgtgatccaaaatattcttttaaagtcaaagctgtcattgcatttttccagaaataaaatgataaaaactgtgcacaggactgcttatcatacttaactcttaacacagctgacctttaaatggcattaagagtaccaacctgagttctgggtcctaggaaccaggaggagataaaagattaagaaatagggaaggagagcccgggtgtggtggctcacgcctgtaatcccagcactttgggaggctgaggcgggtgcatcacctgaggtcaggagttcgagactagctggccaacatggtgaaaccctgtctctactaaaaatacaaaaattagctgttctgcagacttgggtctagaggtgatcagtttttccccagccaaagcccaagggcagccttgctcctctctccctcccctggcttatgttcccctgtgtatgactgtgtccctccagcccatgacctatagagaatgcagaccatctctctgccagtgttggagaccagatcccatggaagggcactcatgtccagcctggggccccctgccttggcagacactactagttgacataatccagctacttgggaggctgggacaggagaattgcttgaacccaggagtcagaggttgcagtgagctgagattgcactgctgcactccagcctgagtgacagagtgagactctgtctcaaaaaaaaaaagaaaaaaaaaaaaagagaaagaaacagggaaggaaaaatgactggaagaagatgaatatgctgagccacattctgagattgagaagtctatctatgatcacttgcacctcttctcttctgggtagtgtctacttccccacgtccctctgccattcttttgctgaagccatgcccaccttaccatggggtgcagggcagtgaagaagcagcaagctgcgaaggctgagccatacctggaaagagtgactgctaagtgcgtgtgtccctggaggcatttgttccttcacaaggaaatggttgtgaactcaaactgggttctaattgtcaacattcaagggagttggcaaaaagagtcattattcaataaactataccaaatactacagtatgtgcctggcatgttgtagatgctggagacacaggagtgaacaaataagcaaagcccctgccctgtcactgcatttctgcagaaaagatgttttgcttcagggaagccaaatcgctcaccaggagcctggccccgagtccactcttggggtcaacacccagggctgcccagtgggctgtgtctgctgtccccccggtcctagcccacaggctttttgaaatctccagtgtgctcgccatgaggaaagcaggggtgaagtctgctgggcagcctttgtcatgtctgtgattaaggacgactcttttctggaaattaaaatgagcagtcctgctatctcaccgtacaatcactggcatagtttacttttttattctgtgtctggattttccccctggggctgcagcagtaagcctgcttccttggttcaaagccagtgtgtgtttctgcaagaaagaacttctggatcagcagggccccttaacaggctgcaagctggctcttgagagggagcaggcagccaaacaatatttggcctgtccttcccctccatgccagccttagttctggttcctgctcagtaggcaaggggcagcccaggacttcagagggaacctgataacttgtctttgtgtgattaaggctgggtagcagagcccactgagaaccagctatgcttcaccataaaaatagaacttagctctgggtaccagggagttttaataatgtggaaaaatgcttatgttgtcatgttaagtgaaataaagtagagtcctaagcaatgtatacagtgtaactacaactctgtaaacagagagagagcagaaggaaatataggaaaatattaatagtgtgtggctttggaaggtgggattaatatgctctacttggctgggcacagtggctcatgcctgtaatcccagcactttgggaggctgaggtgggtggatcaagaggtcaggagttcgagaccagcctggccaacatggtgaaaccccgtctctactaaaaatacaaaaataagccaggtgtggtggcatgcacctgtagtcccagctacttgggaggctgaagcagaagaatcacttgaacccgggaggcagagattgcagtgagccaagatcatgccattgcactccagcctgggtgacagatgagactgtctcaaaaaaaaaaaaaaaaaaatacgctctactcttctaattttctaggttatccccaggcagcatttataacttttataatcatacaaaaataaactttatattaaaatatacatattttgcatattttaatacttttccccagctttaagaatatctgataaaagaaatttatgttactctaacgagcagctgctatcttggttaattcatattttttcacaattaataatataaacattaaacagaaactggtgggagcaattgtccattgggtaatcagtgggcgaaactgcccatgaaatgaaagcaaaacaaaaaacaatatgaaaataaaaacaaaaaatccacaaactacatcagaaatgaatttcctctttgggacatgctgaaaaatatcctgggtaaaatcaaggtattttgcaattatttttcaagtaaatattgtacagagggacgcagtgatcaatgctgctttcctttactgctttgcaggcctgtctagaaactttagtggccagagaggcggcctgcaggctcagggataactgtcttgccaacaaggaacttgttaagttccttgttgcagtttcctactatgaaaatgtggggtagttttgtgggaaactgttagttccctagtcaatttctgaaagatctaagagaataaggaagttcaccaaatcgcaaattacggtggggttacagccacactgcagatttttacaatgtggtacccagagttgattaggatggggcccactgtatcaattacacttaacggttcgttgcatatagcagaaacctacaataacaaaggctcgaatacaagacattttattgtttcacataaaagaaatccagaggataatgggtctggggttacctggccactgctcatccctgctaactcaggctccttcgacctcttcaccctgcctctccccagtggtggccacccccagctgcaagggcgataacacacgtggagttgttctaggaagaattattttgtgcccagctgaaaatcaggggcttgattatcagggaagggggagaacacatgtggggttaggcaatcagcagtcactgccgtggccatgactggagcatgtcgaatgttctgaggcctccagggggtgcatggcagtctctcagtagtgtgcaacttggcctttctcgacccagaagcctataaacagataataaagcaataaattagctgccacacacagctcggtaccctacagtagaacaggggcaggataatagcaacagcaccaccattccaagaggagcagacaggaggcacacaggggcccctgcctagcaataaaccttctgagcatgcagtgggaggcctttccccctggttttctggtttatccctggggaacctctctactcactgtcctctggggcccctagcttgtgctcagagagaccctctggtctctcactctggatagctgtgtatgatatgggattagggacatgcccttagtggggtctgcacagctcctccttcccacttgctgctgctgaaggttggaggttccacagttgaatagtcgaatgcctttaaaaaaattgagatgtcgtggggcacagtggttcacgcctgtagtcctagcactttgggaggctgaggccggaggatcccttgagcccaggagtttgagaccagcctggaccatgcagtgagacctcagctctacaaaaaaataaaacaattagctggatgtggtggtacgtgcctgtagtcccagctactcaggaggctgaggtgggaggattgctttagcccaggaggtcgaggctgcggtgagtcatgaactcaccactgcactccagcctgggtaacagaaccaaacactgtctccgaaagaaaaaaagaaaaaaaagggagggcggtgaaattcaggtaacataaaattaccatttaaaaatgaacaaattcagtggcatttaggacaaccacaacatcgtacaaccaccacttctgtctggttccagaacattttcctcaccccaaaaggaaaccttgtactcattaagcaattattctcattcccacctccccccccagcccctgacaaccgctaaactactttctatctgaatggacttgcctattctgaatatttcatatcaatggaatcatgtagtgtgtgtccactttgcataatgtattcaaggcttgtccatgttgaagcatgtattaatatttcattctttttatggctgaataatattccaatttatccataaaatatatttttaactcatggtttctttgacaattcaggatccacaaaaacacagtcagcttctgacctagttgcttctcatcagctccctggctgcagtcacactgaattcttgccaagacctatgcctcagacctgctttattgcttttcttttgtgccccttccctcactctcatttgatggaatggtggctaccttgactcttcccggaacaccatatggcaaacgccagtcctttcccttcatctcattctgagccgcttcagaccttgaccactcaaaggccagcacagtctcatctctaatatttgggctttataagcagtcgacttttctgactttgcaaagccctgaatttctgaactctattcctttcctaagaacaacaattccgttgacttctaaacagcattggttgcatcaccaaggggaaaaaaataaaccaaaaaaacccaaaaaacccaaaaaccccaaacctctgccagttaaaccatgtcatgccgtataaagcaagtgccattacaatgtgaaaaagaaatatgcaccgcagagttgacgacgtgcagtaaaacagtaccgatatgaatggctgacattagttgaggttctacgctgtgtcaggcattgtgaatcttttgagagagatgtcagaattgttatctttcttttacagaggaggcagtggaggcagagtgaggttcacacccagcaaccctcactcagaaggcttctgcttgggtagagcttgcattggccaaacctcatccacttgccattcattcagtcattcagtgacaagtgtttatggtcacctgtgggagtgtgtgtgtgggaagggtggaaaatttccctcttggtgttttcaatttagtggaggagtaaagccttgcagcaaaatatgaaagatcattcaaacattagggactcaagtgaacgcaaaggagttggggaaagttccgcttaggaagtgacatttgaatctggtcttcaagacgaagaaggaatttgcttggagagaggggctggaggagaaatgagcaggctgggggtggggggagcacaggtgtaggcagggagaaaagaaaaggggcttttggtttgagaccctgcgaggaggcagcatggaggaaggggctgcagggagctttggggttggggagaggatgcagctggaggagtccctgatgtcacttgggtattattaatgtcaataatcagcttatatagaatgaccttctcactagaataaacagtcataactgtggtgctttaatcaacatgacagcattggagaatctactcaaactcacttgggtctagaggggatcagtttttccccagccaaagcccaagggcagccttgctcctctctccctcccctggctcatgttcctctgtgtacaactgtgtccctccagcccatgacctatagagaatgcagaccacccctctgccagtgttggagaccagatcccatggaagggcactcatgtccagcctggggccccctgccttggcagacactactacttgacaacagatacccctctccccttcttgcttaatttaaaaaaattctatttcagatggcattgtgtcagttgaaagatcacattttctagactagtctgcagctaggtgagcccaggtgatctagttccatatgtggaaccattatgtggaattttcagtaggctccgtcacggtgggaagagatggcgttacacatttttctgtcgtccctcacttcctcctactgtcaatatggggaatacggacttgctggctggagtgccagcaggcatcctgggctgtgaagccactttgaagatgaaagccaggctctgggatggtggatcaggaagacaggggcccaatttcctagcaatgctttggggctgcacccttggcctgtgcttcctatgccaggctacttttacatgaaagagaaaaagaagtcctgacttaatgcattgctgtatttttccagaaatgtgcagccagacctaatgataggtggtttagggtgggaagcagagtaagatgacagaactttaggaccacatgaagggaaggagagggtcccccaggaaagggtgcagtttgttagacagaacaatagcatatccgttacaaagagctgccatttgctgggcgctaagggcctggccctctgtgaacctcaccatctgcatcatctcacttcatcctcaccagggtgggggcatgaggactctctcatgaccagggctattctcaatttacaaatgaggaaacaaaggctcaggaagggctctttctcaaggccactgagttgggagctacgttccactctgggtctgtttgtttcagggacaaaccttgaagccacacaagggccccgagaaactgtgcagatgtgaaacccagagtggcccgatcagatctatgactttgtgtcatcacaaaagtgaaagaagcagttcacagaaggagtggagtgtgcaggtcagaggcaggaaggacaggcagacactgtgatgatgataggctgtgaagaggtgggcgatgcctgggatgggagggactgtgttggacccagtgctgacctgagaacctcctctcaggccctcagtcaggctggcccctgttagacatgagatttgactcactggttcccattaacagccactagagatgaatgcactctatcaagtccatgtctgattaaattcaacaactcaggagtagtggtcaggaagtgtgctgattttttttcaatacaggtaaagtttttaattatgaacttttcagagggcaaactcagattgcttagggtgtatttgtccttgtagtgtttttgagggagtcattaggggcatggaataattaagtgaaaattaagaagctatgaaagaatcactcagctaagaaacaagatggtagatcaggctccgtctgatctcttggcagtatgcattagaccaaagggttatttaggtgtcaaggattttgttttgccagttatcaagcctaagaaacttcccagttacatcaaatcaagcaaaatgatgaaggctatcatccacccttgcttacaacaaaaagaaaccacttataagttcttcccgttagccaaaactgaagaatttaaactgccttggctcttaataatagttttactttatggttttcttgctagtatttcaaatacatagtctgtcttcaccaaactagaaatagttgataccaagaaaaacgtgtttgcccggactgaatgatgtcattgcacactcacggaccatgcactctttagcagcacccatctaattccatgctgacctgccttctccatttgtaggataactgcaatactcagaagccggctggtggatcccaggcctctatcattcaattgccatcactgtacttggtggggcctcaaaggatgctccagatcccattttcctgcttctctttttgaaagcattgtctatgggtgctgcacccactccctgcagccaagctcctgtgcctcactcatggaggctgccggggccatctccctggtcaccatggcctccatgtggccaggtcagtgcatcctgctctgctcctgtctgacttgacctctcagcagtgctggcaggtggacctctcctgccttcttgatacgctcactccttggcttctgagcggtgattttcttggtgttcttccaacctcaccctcactggctgagggtgctgggttcccttctcatctttctccacatattctctctctctctctcatccaggccaggtctttaattccatctgtagaacattaactcttgaatctgcctctaatattgacttttcccaagaattctaagcctactcaacatctccacatggatatctgataggcacgtccaaattaagatggccaaaaccaaatctgggatttcacaccacccatctctgtaagtggcactcctcagttactcaaaccaaaaatcgaaggattatgcttgattcatctctctccatcactgccctcgaacccaatccatccaacaactctatctccaaaacattactcaaacaggtcctcatctttctgtctctgttacactcatcagaccccaaggggacccactgatctcccttggttccacttggtcctacacaagggcttcacacttagcagtaagagttatcctcagaggctgggcatggtggcacatgcctgtaattcccgcactttgggaggctgaggcagctggatttcttgagctcagaagttcaagaccagactgggcaacatagtgaaactctgtctctataaaaactacaaaaattagccagcagtggtggtgtgcatctgtagttccagctatttgggagactgaggtgtgaggatcacttgagcccaggagattgaggctgcagtgagccatgatcacgtcactgaactccagcccgcaacagagcgagaccctgtccaaaaaaaaaaaaaaagaaaaaaaagaaaagaaaaaaagaaaaagttgtcctcagaaaattcaagtcagatcatgtcactctcctgtttaaaagcctccagtgtctcctcatcacacctggcacaaaattcaagctccttccttgccaccttctccagccccatcccatcttctcttgctgttgcttactaagcagcagccatcctggggactcttacttgttcctttgtgtcttggggtcttggcgacagctgctctcttgtcctggaatgctgctgactggctcctggacatcattcagatctcagcttaaatggcacctctccagagtgaccttcctagatgacctgcccatctcaagtatttccctcctaccctatgctaattttttgcactgttcaattcactagcttgtacttttctcatgtacttattttctgtctcaccctcctagaatataagcttcacgagaacagggatcttttgtgccttcttcttgctgtgtcccaggacctgagttggagcttggcatctggtgtgtattcattaaagattagttgaatggttgagtcccaaacttactgtcttttgctccatgtgttctgatatcttctttattatggtctgctttgttgagtaatgtgttatgatcatcgagatttactcataggcactgagtttcaaaagatgatgcatatttagtgtatgattcatttatttaaaattctagacttttgactgcagcctgtgactcaaatactgtattggtggaaaaactttcaaatcatcaaccacacgtatttgggttttaccagctccatggcacatacgaaaaatagccagtacttagagattgttcttattatcatcctagacatttgtggatattaatttttaattcttatataaccctatgagtatgaaactcttatccccattttgtaaattggctgaatgtgtcagttctctaatgctgtgtaacaaattcctgcaaatggagtgacattaaaacaaaccccatctatgagttcacagttctgtggggcagaagtctgggcagactccactgggttctctgctcagggtcacacaaaccaaaatcaagatgtcaaaggggttgggttcatgtctggaggctttaggggaaaattgacttgcaagctcatcggagttgttggtggaatccaattccttctggctataacctagaggtatctgttttactgctggctgtcagctgggggttgctcttagtgcttaaagacctcccgaattcctgacacgtgaccttctcctgctttgcgtctctgacttcctcttctgctttcagccagagaaaacgcgctgcaattttttttttttttttttgagacaaggtctcattctgtcacccatgctggagtgcaatggcatgatcacagctcactgcagcctctctgagtagctgggactacaggcatgcaccaccatgtctggctaaatttttaattttttttataggtaaggtctcaccatgttgctagctggtcttgagctcctagattcaagtgattcttccgcctcaggcttccaaagtgttgggatttctggtgtgagccaccacgcctggccaatgccttgcttttaaagggctcacctgactgggtcaggcctactcatctattctccttattttgtggtcagttaacttggactttattatacttacaaaatcctcttgcagtattacctattattagtgtttgactgaaaaagcagagacaggaatcttggggaagtatctttagaattctgcccactgccctgaggttcaaagaagttaggtgatttatccaaggtcatacaaccagcagtggaaaccagattcaaatcaaggcattctggcccccagagtctatgaccttgaataataccctgcagtgtgatgagaatccagtgctgcattggaaattctgctgggcagattttctgacaatctgatgtagccatgcaggtgagacgcactgggctactttgttcataaggaccggaactatccatggtgccttgtctcctcactcccatcacctccgatgtaaccgaagacagacatgaccaaagaagtcaggactctgcttttcaatggattgaacccacggatgctgcaccattttccacgagtcagcagcaccatttccaggtttttgctgcccccagaacttggttacccctcaaatcctttcatcatcagcatgagtgaaatcaatgtgactcccattaacaagaatattattattgtgcacatgagaattaagcccaaaatgcaatctgtgctcacacaggtttgatgatggatggatgcagtggtgtgctggcagtgacttgttctgggttttggaactaatttgttcatctctgcccaactcactttcagtgagagcatgctggtagtttgcaattggcaattggggagaatttacactagagaaatcagcaaacactacaaatcagggtttgctttattcatttatatttgaagatgtgattgctaaacatttgccagcacacctctggatggatggatggtagatggaagcggtgagagccaagagagcttggggattccagctttcataaccagaagcatggacattcttggaatgcttatgggggtgtggagggaggacccccagcatcagcccaggagaatgagtcttgtgagctgggagatgaagtctctaaataagtgagaagggaggtgatttgagctaggaatcttggcaaatagccccagggcagaggcagaggggaggagaaaaaagaaccatcagagccaggaagatcagtggaaaactggaggcctcacagaaagcaagggccttgcttgagcagaatgatgcctcttgagtttcttaaaaaggaaaaggtaggggtaaggggctgtttaatctattaatacttcagcccactctcagcacccaaataatagggtgggtgcatcaaatcttggtagccatatacataagaatacttgtaggggttgtttaatttagggccttataaagacaataaaatgacttattgagaatcactaaaccaacacccaagtatttaatgaaaatactttttagctcatatagcttgagacaccaaactatgactatgtaaatagctataccatgtttatagattggaagacttaatgtagtaaagaagtagattctacacaaattcattgataggtttactgcagttcctttcaaaatccaagggggggacattttgtagatacaaatgaactgatactagaatttatatagaaaaaaaccaagaatagccaaaataattttgaaaaaagaagaataaagttggaggaaacatactacctgattttaagatttaacatatagctgtattaatcaagattgtggtgttgggaaaggaatagactggtagattaatggaacagaattgaaagtccaaatataaatgcacataatatggccaagtgatttcttttttttttagacggagtcttactctgtcgcccaggttggagcgcaatggtacaatctcggctcactgaaacctccctcttccaagttcaagcaattctcctgccttggcctcccgagtagctgggactacaggcgtgcaccaccatgcctgtgtaattttttctgttttagtagagatggggtttcaccatgttgcccaggctggtctcaaactcctgacctcaggtgatctgcttgtcttggcctcccaaagtgctaggattacaggcgtaagccaccatgcccagccagccaagtgattttttttacaaagtcccaaaaacaattcaatggaggaaagatagactttttaacaaatggtgttttattggatatcctcagtcagaaaactcctcaatctaaacctcacatattgtgaaaaattaacttagaattgataatatgcctaaatataaaatgtaaaactctaaaacttttagaataaaacaggagaaaaatcttcattactagagttaggcaaatattccttagaagacctaaagcactatccataaaaaaaagataacatcaactggatttcatcaaaatacttttattctgcaaaatatattgttaaagaggatgaaaagaccagatatagactgggagaaaatatttgcaaattacatatttgatctaaaaagttgtacctagaatgtataaaggtggctctaaactcaacagtaagaaaacaaagaatccgattaaaaagtggagaaaagaatgagcacacggaaagatgctcagcatcattagtcattagggacatgcaaattaaagctatgaggagacaccatgactcacatgttagagcagctaaactaaaaatactgacaataccagcaggggaaaggatgaggatcaactggtctctcatgcatacattgctggcggaaatgcaaaatggattgtatggtcactttggagaaagtttgacagtttcttataagggtaagcatacagttaccatatcacccagcagtaaattaactatttactttagacaaaagaaaaacttacatccatacaaaaacatgtacacagatgtttacagcagttgtgtttgtcacagccaatgtggaaaacaaaacaaatttccctcaacaggtgaatggatgaacaacctatggtatatccataaaatggaatagttctcagacatcaaaataaataaaatcccacaacatcaccaaaggagactttagtttcatctgtaatgttttaaggttttaagtagacagactattttcatgttctatttgttgttgaatttttaaaattgatgtttcttttattacaaagtatgaaaactacaagagcatatctctgtgcctggtcaatgtcctgtcatgtagatagattctccctcaccatagccaaaccctctctttgagcagtaggttctagccttctttctaccccaccaaattccttctcattctctcttgcatcatcaatttttctctttctaccaaattatttctatcaacaagtacacggatgggctattatttttcccatcttaacaaataaggaaatctctcttgacctcatttccccctccagctatagctttatttctagaaagcagtgtctgttctgtcttcaatttctttcccctttctctcctcactcaattcagagtttcaccccctcttccccagcaaatccttttttttgccaaatccatgtatacttttctgtctccaccttacatgacctttcagcagtgattatgcaggtgatcagtctctcctccttgaagcaccttcttcacttgcccttgaaggtcctacactctccaggcttcccttccacctcaccagcccttacttcccccactcccatctttgctggctcctcctcactccctgacctcttaaagctgcagggcagggctcagttcttgctttctttttctacgttcatttctgtggtgaactcatgcaattccctaactttacagactacattagatccaatttaagatgtcctcaattataagatgcaccattaagttaaagttccactaaggaagaagaaagcactgccaattaaactcttttcaaactctttttttttttttttttgatatggctctgtcacccaggctggagtgcagtgacagtcttgggtcactgcaacctccacctctcaggttcaagcgattctcctgcctcagcctccccagtagctgggattacaggtactcaccaccatgcccggcaaatatttgtatttttaagtagagacagggtttcaccatgttggccaggctggtctcgatcacctgaccttgtgatccacccaccttggcctcccaaagtgctgagattacaggtgtgagccactgagcccagctgccaatcaaactcttacatcctatcatcccaatttcagatgtctctttgttctcagagtccctaaactgctctggagtgagtgatgatgcttctccttcccagcacccctcttggggaacagggttcgcacccttccttctatctctttccttctaactctcttcatcacccagcctgtggaatccttatatgagcttgggatggtatcgcctgtttctacacctagctttgccacatatggttgggcacatcacaacttgtatggatttactccattgggttgtgcagtatataacctgtacaactatacattgttgcctgacttcacccattcctccaaggttttttatttttctctttataatactgtcttagtctattttttgttgctgtaactgaacacctgaggctgactagtttataaagaagataaatttatttttagcaattctggagtctgggaagtccaaggttgaggggctgcaactggtgaggggcttcttactggtagggactctctgcagagtcctgagatggctcagggcaacacacggtgagaggacccaccagagacggccaaagtggctttcatatgagacccacttttgtgataacccattaatccattaatttatgaatgggtccattcatgagagcagagccctcatgacccaatcatctccgaaaggccccacctctcatattgctccattgggatccaagtttccaacacatcaacttctgaggaacacatttaaactacagcaaataccttgtcctgaacttttgaaactttaaagcaagaaggagactctttagttctgtgcattcttccctgttatttcttgcctgaggcaatcgctgtagccttggggtttttgctccagttgggcacccctgagcttaccacggtggctagaaaaaacatgccctcactgacataggcctgggagcccatctaggagccattcacagtggcaaggggtggcccttattttgcatagccaatgagaagactcccctggctatgagggtggagtccatcttaaccaaatgtcaaggttgctgccaagggaggaggaatggaatgaatgtgggggaacccattgggtctactccacagtgtcaaaggcagggatagtattactgggatgaaagagacttgagcctgtgtttaggtctacagacaggaagcgattaaagacgttggaggaaagagcctaaatttggttaggagcaaaatcctagagaacaaatgaggtgtacgggggagggtctagatttgaaatgaaggcatgaaacttctcctggatggaggatgatgaagagacctgctttgaaggtgtaagcgaaggaagggatgtgagggcctctaacagtcttgtgtcctccaggtaggaggagcagcgcagctggagatattggtagtgtggacagcttcatggtactttctgggaagtgtccaatgtgtaattttaattggctcttttcattaaatagaattgatattattttaagagacagatcacttgaaaattaggattttgattcacttctcaaatgaagagaaagtgcctttgcctcatgtatgtgtgcagaatttgggagaatacatcatgagctcagggaatgtgtatgcgaagatgtttgaaaagtcacttgtgggaatttgcctggcttggtggttaggaatgtggactctgaagccaggaggcctgggctcacatccaggctttgcagccttgggcaggctcctgaacacctctgtttctttgctaaacagtgggcaggatatcactatttttggtatagacctactggaaggatcagaagacttaatacctgtgtgtgttttggagagttattggcacatattagatagttttactgtgaatcatcattatttataataattctctgacatgctggaatgtacactgtctttagaaatgaaatttgttttgttttcctaatttcgtgcaacctacatttttccagtgctattttctttggggaaagagcatgcagatgttccgtgttttcaatgtagcggtgtataaaatgtcatcattgtttcctttctggtggaatattaagagccagcttaaagataatctactcccagaaagttccatattagcaattatgtggggctggtgctcatatgcctcaatgaatgatttatttattagtatattgggaatggcctccctcttctcacactagcaccttttccccactttccagcccatttccaaatgagaagggctgaagtcaatcaggaattaagatttagcatttgtgggattatctttgaatgcgacactgggggggacacagtttcactcactctccatggtggcagtccaaattgctctttcgggaccctggctgtgtctaaagcctcagaatgatccagaaggctcctataacagtgccactgtggaagaaaccacttctaatatggcaggaaggtgtggccctgcttggagcccatgttttctaactatttcacatttctttctttcatccctggtgttattttttgaaattaatttttattttcagttctcctaggaattaatgagttaacttaataaaagtaaaagtcttcataaagaaggtaaaggctggctttccacatagagaacaaacataacaacccacatcctctgcagagctcctggtcaatgcattcttctagtggggctgccacacccctggggcctcaggcaagcaagccccttgtggatgacaggggctgggctcaaagcagtctctggggctgtgcctccttcctgttctccactcttttctctaaaggaaatgcactgcaatgaattgcacaatacagacattcctaaattctggaaaaccagcaggctttgaactctcctgggggaaaaaacccataaaacacaaaactgcaaggaatgagactatttggccaaatggccaatatgctacaactttcatagggaactcaccgcacttggtattgcctgatggaaaaaaatgccctgaatttcccaataaaatatttgagatgtggcaaaggaataaatattttttccctaagataaatctagctgtagatgaaaactgggtctcatgcctcggacaaaatattatttccttatttactctaagtctatatcagaatatagcctacacagcatcaggtactaagccaaaaaaggctccaagggcaccattgttcatccatgactttgactgtgtcaccccccagaaaccttgagttgggcagatgtaatcacagcagcctttggtggtttcttgagcagctgctaaggatcacatggattctgctcacacccagtgcttctcataatttaaaaatgcttgaagctgtgggaggctgcccagccctctgcattattcaaaagaaaaccaggaggcagcgacaattcttgattcttgcagataaacattctccaacaattattaagagttggattgctctaccttcatttaattccttggtgctttactatttgaatctagaatattcttgaagtctgaaagatggatagaaaagaggtaagtcatgtaaacttataaacagggcacgaaccccgctaacagacagctttgaagagatgatgattttagatcttgtgaattgttatgtcagaggaatacatgcagaagaaaacaggcaccgaaatagttattaccagagcaaagtaaatctgaacacctaaaagaataagaaaatatcttatgcttctctctactctgaactgccttgaaaagagcaagaatttcatacatgagcctgtagcacattacaaaatctgagtatgtatttgaaattcaaatgcacacaaagttcatgcattttattttccagttgttctcaagactcctaaataaagcatttcccctgtgtgggcgacccctgggtcccatgtggggtcagtgtttgggtctctctgagaggatcaggaaggctgctcttccaggaagggctgcagggaccctgggaaccggaccagtccagctcacaagtatgaagagaatgtcgggagaggaagtggtggctatgagtcagcatgagtcatctcgttccaatgagaatgaaggctgaggtgtgcgcctttttttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccttggtgagtatgtttctgtcatttttagggttgcttctgcagtttgccttggagtctgggctgtgggaaaggctgctgcgtcctggtgaggacactgcgtttctttcagactttgaagatctgtcgttttagaaaagtggctgcctctgtcaccagccccatggttactgtcctttagtgtgactgtcaggaggtgtttctcagtccttcgttgtaagaatgtagatgccggttgcaccttctgttgtcttggaagagactgcagtgcttggctggaaaataagctgctcgggactcctctgagaagccaaagtgaagctcagagatggaagtgggtatacttgtgctaacccagggttgctgaggttgggtgagcttccgcttctccgaggtggaggagaggcagctcctgagccatttctggcctcgtggtcagagctgcccaatttcagtgtgagaaataccagagaggcagaactttggctgccttctctaaaagcatatgaatgattgcaggagcgtattttacgtcctttccttttccttaacgttgaaagtcacaaactgtagtaaaatcaggaagaacgtaaaaatgctgggggccagcgctgggggtgggggactggggaggactgaggagggggccactcagtctttgaggcctgacttgatcttgataggtatttctcaggctgttagtattccgatgaagcttagctttactgtcaagtaaaatacaggaaacatttttttttaatgttgttctagttactgtaaatgaaacggttaaaatgtcataaataccttatgataaacatttttcaaatttgcttaaaaagcaacacatcagtaggcagggtatgacagggagctttttcagtacagtcatttgagtgtgtgggcttcctgagttaataatgagtcagcacccaattctaaaattggagcagctaagagaatgttcaatctgctcctcagcacagcacggtggctggccggccccccgtaggaaggcttggggttaaaatcgacttaggatgccgcccttatgtaagtgaccagctcccagcttgggtcccagctcctctgggctactgctgagagaccccctctgctaagggatctgtctctgaggcaggagctaacacatttggcttccaacctttggctaatgttgacgatttttaggttgtcttgaggcaacaggttgaacatagtttctgaaatgaaaaatctagtgtttattaaggctagggcagctgagggctgagcctgcatctggagccttgagatgttccgcttgcacgtcaccctcgccgagggattgggcgggagagtcggtcaccgagtgaacttcaaagttggcgctctgcatgtgacgtgtagcgtgggaagattaagtcagcttaaaatgagagaacaagattccaaggaagaaaacctccccagaaccttactcgtttatagataaaagaagataaatattgagaaaattaaaaaaataaaacgaaatagttgggctgcaaaccagcagctctgggaccagatgcagccctggtgaaggcatcccccaccaggttctgtttggcctgctcaggattgtttttttgtgttgagataactgtgggtggggtccacactctccggatctcaggccctgccacaccctaatgccacaaagcttggagagtgcgattacagcgaggctcagaagccaggctgagggcctgccagcctcgtggggctgctgtgtggtccccatgggttagcatctgcccggccgccggaacagggcctggatggagaaggaactccatcagcactaactctgctagactctcttattaatctgccctctgaaggcatttgggcttgtggcccttgagttagttccatggctttttcaagaaagatcctgcagttccaatgtgagcagcagttgtttccaaggctaacaatttcacgccaactagaagcctccacaagtcaggtgccaggcatttctaagccagtagagcagctccgcttgtttctctgggtgagtcctctcagggtgagaccctgtctccttgtaagcactcggagacgtgccaccttcatggagacgggagccaatcaaaggcaaactgcgttagacagctcttccatgcggtatggacaccaacattcgatcatccttgtttcagagaaggtgccgggccccagacatgtgcttatcactgggtcccatggccttcaatcctttaaagggttttaaggtggctgatttttatcccagacattgatcatgttttttttcatgcagaatttgggcagttgtctggacattaggagttgagtcacctcctacccatgaggaacaagcctgtggggggactgatattatcacttctgtcatcaagaaataaggccgcaggcatccctgaatatagagcatttattaatcgaactgtgaaaatgaaacacagacagtgatgacagctggaagttggccaatgtcctgttgtcatattgccctcagcctagggactggcctgtggctcactgaccctgtctcccactctccacctctcatcagcaactggacctggtgcacctggtctacctcatgtccagtgttttccgcagtacctgactggtatccccacccttggttgttgtgtggtgagctcgtccctatgttggcaagttacttaattcctaggtgtcccgccttcctcactgtaaaatgagaaaagtcatagcacgaatgtcatgagtccttgtgaagattttatgattagcacacaagttacaaggagacacgataactgttacgtacgtactcattcgttcggaaatataacagacagcttagtatctccacccgggtccctctgccctgtgggaatccataaagaattgattctcatcccccagaagtgagatcccgcttgtgtcatcaattacatggcatgttctgcatttacaggacatttatttattaggtaagtggggaatcctccttggttctctccaggaaaacctggagttctagttatcatcatcatcatcatcatcatcactgtcatcatcattgacatcatcacaataagaactcccattgtattcagccctaaccgtatggtagcaactttatggtattccctttaacctccccccaccccaatatccatcctggaagatgggaaggatgataggtttgttgactcactcaaggcggtgggactctccagcaggtatcaggcacagcatctgcttcaaagaacacatcggcgacaggggagccccttgcactcactcaggacaggagaatcaggaaaagcagcagatctgcagggctttgtgtgtaatccaaccagactgatgccacaggccaggaaaccgaggacggttggcttcagacctaccctggagtggaagcagctggattctgtcctcacgcttcctgtctaaagccagctagagtaaatttctagtcatctagattctggttatttggaaatcatcacagtatctggagatgactcatattgaaaaaaattaaataagatacacttaaaacttaacccagggtgaacataacatggcctttccttgtcaattctgaagaagatcattcaagtttgtgcagtgccttagaagccagatgctctcttccattctgccagggtcctaaagaagtactactgtgtcctttagatcactctgccttgatcactctgtcccgtcactctgctatttcacctgtcagtgaaatacctggtatcgtcctgccaacatgaagcattgaatgctttatacgtctccatcctgattgtttaggctttgaatgctgagaagtatctgcactttgttggtcaattgtagatggtgctaatttgtggggagtttttcctgcaaattccccctgtgccataatccagaggacctccctctgcccccagtgctgtaggctaggcagctatgggcctggctcagggctgtcgggcaaggattggactctctataggttccgtttggttctggttagatcacagagctcaggcaaggaaaagccgacaatagatcagaaggaagttgagcgctcaggaaggaggagtgggcaggatgcttggtggtgtcagaggattccttcggattaaaaaaaatagatgttattgcactttgtgtaatcagaaaagctaaggttgacagcagatcttatccactgtggttttcctgcttatcttttgttttaggagtgataaccctgcgagtgagggcttctgctacagggtcttgtagctcttctcttcatcctgccctttaaaacatttattggactaaaaatcacaggatttttaatgatgacagaaaatgtattattttagctgttctcactggacaaatcacttacggagtgttgattaatacattgataagtttctatcaattcagctagatacaagggaaaatgtataaaatagcaagggctccgaaaagagtcaggcttaatttctcttgcacagaaaaaggattctattgctctttctgttccgtcctcaaacaggaagcaggttttctgggacaagggtcaacaggcagccagttcatccatctgcctactcagccatccttagcactggcttccttcctccaagttatcttatgcttcaagaaggctgctggagctcctgccatcacttctgcattccagacagaagagaggaaggaagtggagggcaaaaggcaaagcctcctagatgtcagactcctctgcaggcctttccttgaattcccagctaaccctttcagcctagtctttcactggccaccctatctgtaaaggagctggaggaggaagatggaggagtgaggcaaggccctgagatgatgcagagcaaggggcacacaagaggggactcaggtccaaggtgaaatagcagcaagcactctccctccaaaacccaccgcctccttatgaatccctttggccttgattatgccagtagataataggtatgtgacagttttagcttctctggcctttgatcaggttgatttatgtgaatagactccatgtccttggagatgaacctgttctaaaaattctaagcaaccagccatttggctctttgctggaaagtagcctggcttttgaagccaagtctggacagtttccttgctgcacctcaggactcaaaggacatggtcctgactcaggaagagctggctttgagggaaggggtgagtcatgaacccaagcacagcagagattcttggtgtgtgctgcagaaggtgagagtagcccccatctccctgtgccagtcttctgggggaaatttatgatggccttacataattgggcttatatgtgtttcactagaaagacaaaaaaaggtgagaccttgtctgccaattcgctaccacctccttggggtctaagagctaggctgtttgttcaaagctaggctcctttgtgtattaacagtgtgaccccgggcatcatccttaacccctctttgtcccaattccacatctgaatgatggggatgataatggtagactctgccacatatggttctgaggactaagtgaggccacatgtgcaaaggatccggaacagtgcctggccccaagtcagccctcaggcaacagaacagtgtttggattgtccttgttgctttattggatacgtgataagtactggtgaaatgcatgaatgaaaagaaatcccacttgattttaatacaagaatcaagcaagtgacttctgtccctttgaataccctcctccaagtggtccaaagtccttgaagctaccatctccttggtacccttcctgatgcttctggtgtgggcaatgtggttacttcatcaagtagaccctggttacagagaagttaaatgatttgtccccaggcccactcacaggagagagtactatacaatatcaagctggttgtcttcagcactctgttgtagagacttccagtatgcattctcttctgcttcctctgttgtcaaccacaagtccatgttgttagggacaacagtgtgcccagttaaaaaacgatatttcctagtctcctttacagatacggtggccaatgaaagatataggctgaaaggttagctagggattctagaaaagctctctaaaggagactgacatgtaataggcttagcattttgcacctgaattctctccttccccctgtctggaatgcagacgtgatggctggagctccagcagcctccatgaagccataagacaatgtggaggaaagaaaccagtgctaaggatggcagagcaggcagatggtcacaggtctttgggtgaccagctattttgcctgcctggagatttgactatttttggagccggatgcagagggaggtgggaaaaatattccagctgaaattcaacctgtaggagtatttttcagggtgtcagggtcacttctttgtggagctgcctttcaggtctctggtatagggggcaagggtcatggcctcatggtgatgcccagggaccccaggtgctttggtctttgcagaccactttcttatgaaaaagcagagtgtgactgctctggcagaaagataaatgtcattcaggctgattcattattatacattcattatcatttatttgtggttttcctctgattttaaaataaatcaaaattaaaacacttttgcaggcccctaacagtatcatgggccccatgcactgtgcccagcatgcccaatggacatgtaggccccaagagggcagagagcaatcacagaaggacttgccctggccaacataggctggtctctctaggggcagcttcggaattgtgaattacccagagctgcgtgccaggaaatgtggacctaactcttgcctctgaggaaggcaggcaggcttggtttcatgtactgttgatgagcccgacatcctcaatgctcactcgagctttggaaatgacaagcaggattttcagaacaggattctctgtcctgtccctgttttaatttcagcctccttattccccatgtaataattccccatactggctcaattatttgtttaacgggtatgaattccagtctataatgccaaggtatcaaaatgtgacgtacctttactctagaaatctctaaattatattaaatctgctccaagatcgccctgccctacctcaccctctctgcctggttattgggagattcaaattctgtcattattggggatcctttcttgtcataatgctccagatgtcatcaaacaaacttgggcttaggtgatgccaggaaacctgggggggagcatccattgtctgcggtggctgctaccattgcaacttcgacacctgcagtctcagtgtgtggggggctctgggagctgctcagggcctgctccagttggggtggaccccacacctctcgtgatctgtcctctaactgtaggctccgctgctggaaatgtgtcgctgctctcatggccactgtgtgagctcccagtctcagcaaatgcacccagcaatgtctgattgatagggcaccctctgtgggctttgtcctgcttgctgctagctgctgctgggcctctcccagcctgggcctcctgtctcagtctgaaggccaagagacagcagcgacagcagaggaggcagaaacagaaaactctccgaggacccggggaagtcacaaggtggcttcccaaactctctagtgcagcactgtctgatagaaccttctgcaaggatggaaaagttctgtatctgtgctggtcaaagcagcggccacaagtcacatgtggctcctaagcaactgaaatgtggctactgtgactaggaactggattgaaagttttatctaatttcagttaattttaatttaaatgcccacaactgcatgtggctaccaggttggacagcatacatgtggaacacagactcctgatctgggagccttgaaagatgagccgtcactctgatgaggtggagggcctgaattgagccctgcggtggcactcggcaggtcttcagaggggctggtgacccctccaaggtgcacagcccctgggctacgagcagtggctagtcaggttggggtccctggcctctgccacgagtggccactagtggaagcctcaatgtctccacttccagtgggctctcaggcctcacatgcccatgccagggtagggggcctgtcgaggaggatgccctggcacccagagcttctctgctgtttgtcctgagggttcccttgggctgggggcctcaggtgcagggcacatgcagccggactgtccagccttgtggtatttgcacatgaactttcctgcgtggggatagacagccttattcttgtttgtgtaaagccattccaggaactattaatagttagactggcataaataagcctcaggtttggttcttgttagtgtcctacaaatccctcaaactttactcttttggctttttaagggagaagatttacagtatgttcaggcacaattgacaagaaacatacaagttgtgcggagatgagcagacccagggccccaggcctgagcctcttttctctcccatgccctgcctgctcaagttaccttgagcacaaatgatgtccttctgtgtgtgggatcacagactgagacatggggctgttcctcccctgaagtcacccctcaagttccccacatgattttactcctggctactccccagtttgctgtagtttgctggaccatgtgaccttggaggggctcacaaggcccagtgatgaagccaccgccagggctgagcctcagctcagccagctacttaatgcatgcatagcaagttacttaacacctactgacctcagtttcctcacccgtaaactagaaatagaggaacaattaccacagagagttgttctgaggatgcaaagagttcttgcatgaaaaattcttaggaaagtgctgcacatagtaggtattcaatagcattagctatttagattggaattagtggctttttgccatttactcctgactgtaggagctgttctctgggccccagatctccattccagcaatgatctctctcctccaactctggcattggaggagtaccacaatcctgcctccacatttcatttgctgacacccaggggcagcattaggtgtagagtgctggacatctaagggaagaggttcaattgtccatctgtttagttatttactcattattcaatgaatgttaattgagaccagtcagggcagctgagaagcagtgcggttgtgaggagggctgttagtaggggagatgcaggtgctggtgtgcttccgtgtatgaatatggcagctagtgcagggtcatgaagagggaatcagggacactctggggatgttaaaaactctgttgatgtggaatcagaatccctgggccagtcctgccttcctcttgctagctgtgtggccatgatcgagggtcctctttgatcctccctgatacatgggcgaggtgacccacagtggcagatgcttaaccatccaacatggagtcatcatcattacttagacacccttcatttggaatcacgattctcagtgtgaagggcacttcccaccatagaagcccctctctgtgagccctcagagggctgtctaatccataagccctttccctcccaaagaggcagcccagcgcatcactgcaaagcgccagctgagaagacgttctataaattatccaaagcctattctctggcacatccatattttggacctagctctgcccccgaagtcatataagcatagccacgatgggaaggatggtcataactcaacatgcccattcatataccttgagcacatatcctgtcccagagactgctgaattattgcatgagccccagctccttccacaccaaagcccttccgactgcatggacctcaccacttctgttcaagctcttccttcttctcatggttcctggaaagattctttatgtgctgaggtgttcagctacccttgatcttgtgctgccttccacagcatctacttggcaactttccaatgtcccacttcaggtgggcacagtgacctcctttgtctggtttttggcaaccatacctatctgttggacctgggcactgcactgacagccagctgacctccctgcctctctgtgtgggaacgtgctgcaaagccacatctctctaattctgtgtgtgtgtgtatatatatatcttttagagacaagatctcactctgtcactcaggctggagtacagtgaagcaatcatagctcactgcagccttgaacttctgaactcaagtgacccttgacctcagcctcctgaagagctgggactacaggcatgtggcaccatgcctggctaattttaaaatcttttttttggtagagacgagcgtctcactgtgttgtccaggctggtctcaaactcctgtcctccagtgatcctcccacctctgcctctcaaagtgctgggatcattctgaatatgaggtggtgacttttttaaaaaaaacttttttttttaacctaagtagaactttgcattatcgttggtgttgtcttttagatttagcccatgtattctctaatataaaacatgaagcttcatgtcatctataacttggagtggtatcccctttacatcttcaccagaagaccacttggatcagtgaagaccaagagcagagacctgtgacatccactagcgattgtcttcactgttgccactatcccagtgctctcgggcactgcattgaacacaaatagctccccttgctgcacaagtttcactgatgggggtaaagggggttatgaaacgtatcatatgatcaaatatgtgatagtgatcccacagacaaatggagcgtgtggggatgatttagacactcagccagccttgtcttgatggatacccatccttctctgctgttctctctttcctccatcctcaagcacagggagcttttggcgaggttagctaacttcggggcagctgtgaattagatactggctgtaagttacctccaacatccagagcatttaaacgctcggctgtcaatgattgtcattttcattgtttacatatagtcacatcctcagtttgtggggtggatgcatttgattcaattcagatatgcctttcaagctggccctgctgagctgggcctgaaaggcacatggctcatctcatctgcatgtgacagtctctttgaagtccccagaagtgcctgctcagagtcatgctcgggagggaagaggtaaggcacagaatgagtacagactgccacccagccgcaggaaaggtgactgcacaccagaggttcctggtaaggaggtgactcacccgcgactgtctcacctgtccaaagtgtgtgtcacctgctctgtgttcacccactgggttcatcagaggggcacttgaacaaaacaggaatgtcactggagaggggaacaaatgctgtccccaagtccttccctgccgtttagagtaacgcagcccctgtccgcacatcctcacccccatctgccctctgcttgccagaattatcagaatctctcaattctaatttcagccattctctgtgaaaatgaaaagttagtggcaggcaatggacaccctattgaaatagaaattgttcttcatatgtcagaaaagtcccagagtaatctgggagtaatctgagcaaactgattcaaaggattattacaatttcttagtcttctactgctgcaaaagtggcactctttgattctcatgtttgaggttctaattactacctcatgcaggacttacaagagatcagccatgctgcttacattgtgtgtagtgaatcaatgttattctgaagggcctcctggaagcagtagggattggagaatgtatgtcttttaacatgatcattcccatcctatgggggttgggcactcttaactcatgttgcagatgagtaaactgaggcttttgagagtttgagggtgcacagcttgaggcagaggtggaattcccagcttcatccaagaaatcacgaatctccaatggcttgcacacatccaggtttgctggatcctatttgtcaagaccacatgcagattaggagccttcaaacaaattatttccaagggagggcatctttctctgtaacccctaccctggcaattctccatggcctcagggagtccagccggaagctctgcaatgagtcctggggaactctcatctggaaaaaggcgctcatgacaggtggtgccaaccttccacggatgcttttcagcatctcttgggatgaggatacagaatttctctttcaccctgtaaatgtggtaaatgagggaatagaatttccagctttaatttttctgaataggattcaaaaatgaaattgtataaaaaggtatccagtgaaaaacacacacccatccccatctcccatccagttccctccgtaacccttttcttagtttcttatatgtcctttcagagtttctttatgcaaatacagtataagcaaaaaagaatgggcctttttcttttcttccttattttccacaaaatctatcaaaatgggttttttttgttttgttttgtttgagacagggtctcactctgttgcccaggctggagtgcagtggcacgatcacggttcactgcagcctcgacctccccaggctcaggtgatcctcccatctcagccttctgagttgctgggactacaagcatgcatcaccaggcctggctaatttttctattttttgtagggacagggttttgctgtgttgcccaggctggtctcaatttcctggacacaagcaatctgcctgcctcagcctcataatgtttttttttaatgttaaaccccttcttgtgttgagaggcctggcttgtgtgtttgagcgcagctgcctacctttgcagctgtaaatgtcagggctccaggagggctggctgggtctcccctcctcccctgttgggtgggtggggccctgagcttatccaggcatccctaggtggatggatgggtggatgggtaggccctggccttcagggaatgcactgtgtgtggtcttccagccccagcaaagtctcagggggcccgagcgggaagtcgccatcctcagggggtccgagtggggagtcaccatcctcacggtcagccgtggtttcgaattgagctcccaggggcggagactccattcccccggggaacaatctgatagccagaaatgagagcagtgagtgacttggacgctgtgtgattcaggagggtcccagtccctcagagtcgcctggacaccagattgtatttacaaaacagatggatgaggaaatggagattgggtcttcaaaagaattaacctcagattttatttatttattttaaaaattttaatttttcccaaggaccctttccaagtcaagaattgttttaaaaagaagcctggtgaaggcaaatgctgtctgtggccgaaggcaccgtgaggagctgaggctgacttatgtttctcctctgggctatgtgcgcctctaaggagttcacacactttaacccccttaggaaccctacatgatcatcctcgtttcttaaagaggaagcagagccagcaaacaagtgggggagccacagttccagcccaggtgtcactgggccctgcctgccccagccagctcctcaggagcacacggcaccccacgtgcgtgcaggggacagctgtcctcacaggaacagccccgggacctacaggacttcctggggtttaccctcagagcacccatgaggttagaatcacaaagcccgggagtcaggagacacagggcagctggagggaggtctttactgaggctactgaggcacagcagccccgtctagaggcctccccgagaggcacttcctgaggagtctggtggattttgagctgctttttaaacaaccttctccttagcatagacactgacactgaagggaaagaaagcaaatggtctgttcttagtgggaaggcaacttgctttcaggggaacgagtttgggggaagaggactggtagaagacacgactaagaaagtgagtaggagtccagacgtgtgtgattcatcctttagggcctctgtgtgtgatgggttgacttgtgtgtcccaaaattcacatgtggacgtcctcgcccctggcagctcagacgtgaccttatttggaaatagtgccattgccgatgtaattagttcaaatgaggtcatgctggagtcgggtgggcccctgatcccatatcactggtgtccttataagaaggggaaatttcaagacagacacacactcagggagtacaccatgtgaagactggacttaaacagctacaccaccagaagccgagagagaggctggaacatagccttccctttggaggtagcctggcccggtgggcactgtgatctcagacttccagccttcagaactgtgagacaatattttattgtttaagccacttattttttggtactttcttacggcagccctagcagatgctaatccagcgtgcgtcctgacagaggttgaagggggcttctcaagtcccaggtccagcttggtgtggttcagctactcaagagacatctgctgctaatggatgagcagtcaacctggacgcaggaaatcattttttatttgggtgaatacaatattctccttttgttttcacttttcctaaaagttaaatcaaggttcaaaagaaaatcgaggttcaaaagaaaaatttggtctttacatgtgctaaaaagaaaaaaacaaaaagactcatttcatctttatatgggatgggatccgtgctctggtgggctacagagtgtgtctctgtgtgggtccctgtactccgtgcgaggttggcggccgagccacggttcccatgtgagcaggacagcacagtctcacctcacacagagaacctcgcccgaacatggaactttcacccacgttgccattttcccgctccctttccctcctttgaggttcacactcgtctctccaaattaaaatttacaaagagaggagatggaggctcccaagtggccacaaagtcacattttatgtgagacctttttgcctcatttgctagttattgaacaaaggtgactctgaacctagcagaagcacgggttcaacacacagttcagaaaaacaggaaccatcaattcataagaacttaaagaaaaaaatagtttaaagaactgagaagttgccacattatagtgaaagaatgttgggttttggaaatgacaaaaacgagcaatcttcaccttgaaaatccggtggagtcagttacacaagacataaccgcacacaaacatggcatttctgatagtataatggcatttacagtcaagaagcttctttcagagtatttcatggaaagttattttagtagcaagggtagccttaagcagtgagtattcgtcaagagagtgaaaccttgacttcaaagtcaagaggcggaggagtgaggactcagatctggaggcgacctgcagggcgggtgcccacgcacaggtgtcccagctgtggacatcccacgtgcacaggagtgggccaaagagaggcccatggatccctgcccacctcagaaatgtgagcaggcagctggggggcatttggactctagccgggacaacctagtggccgggcaggggatgcaggcaccacaggtcacagtggtttgctacgagcgtcagcttttaaaattttaaataatcctcttattgtaaaattgaggacattatttgaagcaacgcaaaaaccatgtaaaaaaatgtctgtaggatgtgaatagcatgtttctttaaggcaatatctgaagaaaatataaaagccccaggtgaaagacaccctgggagcagaggtgcccctgagggtcggctgccccaggacagaggagggctctgctggtgcccaggtggcactgcctgtcttgatgccaggtgcaggggtttagaagaaaagacaaggaagaaaataaaactcaccaccgacattcctaccactagagttacccactgttcccagtcaggcatatttcctcccaatcctgtcctctctgtgtatttggtaattgcgtaaatcatctctcccataattaatctcctttaaaatttggaataatatagttgttagaataatataataatcatgcagaataatttagaataatgttgtttagaacaatttttgtagtcatgctaccttgcagtcattcataactcagaagaactctgcatttagaaggtctatttaaaatgtgccttctttgctgaagagttagttttatggtaaaaatccaataaaattgtagctaagcactgaaaaaaagtaaagaattaagctcagcctccagaaatactgattttatatatatttgctctggggaagattggtttaagaagacctatagcctgttaattgcccttttataaattgcctccctatattttttgccctcttttcccctccctccctcctttattccctctgtctcttccctttcccctccctccctcccttcattcctttcttccttctccttttcttccttttttttattgttgttctgggggaacttttctaatatcctggattttaagactttgatatatatgctgcaaatactttctctcaacctgtcttaactttctttactgtgtcgtttatattatggaactatttaacttttaagtagttattattttccttttaacacccaggttttgtcttgcttagaaagtctgttcctacccctagattcgaaaaatatcctcacatttttttcttctgatacttagtaattttatttttggtttaaaatgtcaagtcaagtagaacttatttttgtttataatttgaagtaagggagtttcattttaccctaaatgtgtagcaaattttcccagactatttattaagtcattcacttttttcctgctgaaattatgatatttaagttgataagttttatgtgttggggaggtgtcaaatgggcagtttccagttggaatgtgggattgggtagagctttgacacaacgtctgtgtctttccgactcccatgtgacttcagggcaaagaggcagaggaatggagctcagagcttttagagaatatgggccagaaacaggaaggagtcaggacctgataacgggaaccagcggacagtgaacgcagtggagggccactggggccggagcagccgagagatttcaggaggtgagcttcagagagcctcggcataaatggatccagggtgtggtcagctcagggaaagacagacaaccagggctgagcacaggccaggccaggccaggcagggcccccggagaatcacgttttagtatctgcatattgagaaagtttgaccttgagtgtgaaatgtagacaagcaacccaaataaaaaataggcctgattggggccaaaaacaaaacagattgatgaaaataatctcaagagtaggaatggacacaacctacaagaaggagactgaacccaccaagtgtggcgcttgagtcaaatcaaacgattagaggctgccaagtcggcccaaaccccaagagcgtgggaatctgggagggcaccgagggctgggctgagagcctcttttcaaggaagtctttccaggatgctgtacttctgtcttgccaccttgcaggccttacagtgagaccatgaagtccctggcactctccctgccggacccgtggccgatgttgatatctgctcggccggcctcacaggtgtgcgcgctgtgcagtcgcttagggcctcccctgcgcagaaggtcctggcttggtttaatgccctgctgttaccatcttaaaattcttaatggtttttgaacaaaggccgcacatgttcattttgcaccgctttgtaattacatgatttaaaactctgtgcttttctcttcctttttattaaaaacaagaatgtcagaaattgcccctttaaaactgtaaaacaagaaggcattaaactcttaatatttcaggtcaaatttgacactgtctctggacatgcaggtctgggtattggtgggccttagcccctttcctgctgagcccagaacatgcttctagtcacctagcataggtctctagggggcctctgccacaaggcagggccaacgccaaatgacatgcagttgcctttgatgaatgggactctccaccactgctttatgtaaacagcaggtcctgatatatgaaatgtggcttcaaagcaacttaaagaaatgaagggtcaaggatagaatatgtgatgagattctgataccatggagcctccagccccatggcttgctgtgcttgggctgtgttctctgtcctggaagggtccacagagagggcaggctgccagcaggaggcctgcctgctccaccagactgatgacacttattccacttggttcccagaactaagaggtcaggggccatgaaggactagttgcaggagaactctctgtcttaatttaaggcatgctctgtggagtggggctgttgggcagcctttccaatttatccacccatccctgggatctcttgggattgagaaactgagtttctccagggttcttctctcaccactcatatcctgcaaccttagggtcctccctgtactgggtatcagcctggtctcagcattcagggactcagagagaataatcagaggtgcatttctatcactgtgaggaccttaggctcaggccaataatgtaaagaagcaccctacctgggagaaacttactgtctagttgtaaagaaagcaccagggggccatgatgcccatcccacccatgttcccacccaaactctcctaaacccacagctcccaaacaagttctggattgtacagatcaggctccagccaaggtgagctcactgaggtcagagcttacagaatctgggagctcaaccaacatgatggcttcagagatgaaatacccagcacatccagctgcagttgccccataaggagcagaaagtttgctatcacttcctctgtactgtttttatgttcaggtgacctgtgggtcagttgttcgtaatgtggtgatgcctgtaaagggagcactggaggtcagggggtgccagtgagtggaggagaccattataaatactgtgtccccaaagggtgtacagtcaaataaatatagcatgggaaaagccaggttgacccaagagaaacatctttttctaaaaatctgcaagacttctcagagcctttggtcgtgcattttaaatatccaaatatgtgttttgaaaatatgtgaaacagcataacatttgtggtatatgttaaatgtagatgatggtggaactttctgtttttttcttagagaatttcatgggaccaggcttccaaaaaacacaaatgttttgaggacaaaacatatgaatattgtagaagattagaagcgataaattactataggcagaagataagtgacattggattgaaatttttaaaatgggaaaataattacaaatggaggagtggcatggtcagaggcggagtgcaggtgcctgtggcacatctgggctcactggctcaggcaagctgcggtggagcagaaggctggggacatgtgtgtagagtcccaactgtcagatcacagtgttgggttgggtctttcacctgcaggggcgtgtgtgtgtgtgtgtgtgtgtgtgtgtgtgtgtgtgtgtgtgtctgtgcacatgtgtgtgtgtgctgcttagagtttttgagcaaagtttggaatgatcaatgtgcagctttagaataatgacttggtgggaagaattgaagtgaggaaacactggagatttgtagccctcctagaagtcactttcagcatggatcttggtgtggcctggaaggaaaggacctggcttgtgggaggcagcagcagaatggacacatgagagccacaatcaagacagacgtggcagggtgaataactggctgaattgtgaaactctaggctgcccatatcacactgacattttgagaattcagaacagatggcaacacctgggcccctgcctgtgcagatgggccagaaaaacgtgacatgtgtgaaggtgggcatggggtggcagcagtttctctcgcccaagcattaagagtgttacagagcagaactgttattacggaattggtgaagcacctctgggggactccctctccttcccccaagtatatgttggctaagtagccaccaataacaaatggagacacctgcatgctcctgcagccactgcagtgtggccagctcctctgctgggctatacacgtggagatcgtgtaagtgaccagggccaatgtctctggcagccatggagaaacaggtggcccagcccggccctttcactgcccgtgatggacagcttgccatcgctggtcaatagctgcactcccagatagtattaggtaatatataattaataaagaatattccagttgatctggttcttttaaaacaaggaaacttcttgctatttggtacccacaaattccactactccctgaattgtatgtcctgaaatctcacaaatttgcatgctgacattgttaataaaagaacaggagataatttaaacagccctgtggtttggaagtcacaggttctgctgcttcatgttcatgcacgagactaagagcctttgaagaagatcacttcctagaccaaggctttatgtttggattaaatgcagctcctccagatcatctcccgaggagattcagccagcctctgttctctctactatccccgtcttcttgcctcatcccatgcacacatttatatgtgttcacatttatgcatggacatgctctagtgtgccctctagtgcagacattttatgcatgaaactttaacccctcttgcatcaaggcatataagcagaagagatgagtggaaagattttagggcttggaagggcaaacgtgatagtcactgtacattataaagaacaccaaatgacagtgtgctttggaatatactactaggaatgtttctgctttgcaattggaaagtaatgacattgaaaagaagtgaaaaaaatcacaggtatataattcagcaccaaattgatgaggacacagaggtgaactagaaaggcatcccagcggaaaccacttacagccccataaaagcaagatctaagcaatggggatataaaaaaggaagggaaattgatgaagatgacttggggtgacgtgacctggagtttagggagggacagggacttgccttggactcactatgggtgctcatgaaggaggcagcatttggacaaggccctgagaggcaggtggatttggatgtgcagtggtggtccgggtgtgtggagtgggggtcagcatgtgcaaaggcatggaggtcagcaaaccaaggctgagagcacaagaggttcgctgtgtgtcttccagctgcccagtgagcacatggaggtaaaggtgcacaacttggtaagcgacaggagtttgtgtggatcaggcctgctgtgacataaatatgcaaatgatgtggtccctcgtggtagcaccctcaggatgacgcactcttctaccaaaacatggctgaaaatttttggtgtgtgggggtgtaccctgggagcccatttagaagctacagtgaaaagagccctcattgcttcagctttgagccatctgggccctcccacctggctcatttcacctgacagtttctaaaacttctcacaaggaatttgtcggtttattacacatccatagaatgccctgaagagctattccaaaagaagagcttgaaagtcgaacgctaagcagaaaaacagtgacttccaaaccacagggtttgttcgaattatcaacttagtcctttattaacaacttcaaggtgcaaatttgtgagattccagacaggcagttcaatgagcagctggattttgctggttcccaagagcaaggaaaattcccttgttttaaaaagccagatccatttggaatagtctttcttccccacatattacagcatgaacgtgactctaaagtacctgccgagggtctttctttttgtgacggtgggcgctgttccccactgtcgtggacttctcacagcgctcagtgtgcattcggttgcttctctccataacgcctctcagctaactgtgctgtttctgtgctcctgggttgttaatgttcaagtcttggctctataccattttccttatcatttaggattccactgggaagacatcactaagttgtgaaatcaaacttcatgagttggctgagatcatagggttgggtgtcctctgagcacttgcaggctgggggaagacagaaaacctggacaacttgcaattgtttgcaacaaagtggaaaaactaaagtagttttgatatgtgcattagtttgcttggactgctataacgaaatactacttggtggcttaaacaacagaaatttcttttcttacagtcctggaggctggaagtgcaaaaggaaggtgtcggcaagatcgtttttttctgagagctctctccttggcttgcagatggcagcctgctcctggcacagtcttttctctgtacgtgctcatgtctgtgtcctgatttccttttcctagtagggccagtcaaattggattagggcctaaagtaattatctcattttactttacttctttaaaggccatatgtccaaatacagtcacattctggggtgctagaggttaagatttcaatatataaatttgcaggggacacatctccacccataacaatttgtttttcgtaatacgtttaaaatacccatttctgggctggatgcagtggctcatgcctataatcccagcactgtgggaggatcacttgagcccaggagtttgagaccagcctgggcaacatagccagactctatctataaaaaaaaatacacacacacacaaacttggccagatacagcggtgcacacctgtagtcctagctgcttgggggactgaggtgggagggtcgcttgagcccagaagtttgaggttacagtgagctatgatcatgccactgccctccagcctgggcaacaaagcaagactgtgttacttaaaaaataaaataaaacaaaaagacccacttccatttatttcacccatggataaattgtgtagcaagtggttaggtgaaatgtgaaatgtctggccaattattgtcatcatgctcaattatagagacacagtatgctcccctttgcattcttcattgctgattctgtgctttacatctggcagctacaaaaatttagtattttgctagcaggtgcatcaaatctatttttggtttcaaacaatacactttttgttttcagcgattctgaccagtagtcaacaattgcaagtatgtggaatgtgattctcctgctttgggaacaagggagctcccagttttgtgggcaggatccgacattcccatcataagggcggcctcacctgtctgtacctctgacacctcagtcagagcccttggagtcggctaggccagttttggccctccttactgagacctagtcattctgtagacatacttcattctcccaggcttgggcttctggttcaacctgtggctctgtcattatcaccagaagatatccatctggcccaccttctgtggcttttttcccatgcacctttcagactaaattgtatacgctcatcctccaaagggttggctgtctttggtggtattttggcctgagttctgccttggatttatgttttttgttacatatatatatatatatatatatatatttttttttttttttttttttttttttttttttgagatggagtcttactctgttgcccaggctggagtacagtggtgtgatctagattcactgctacctctgcctcctgggttcaagtgattctcctgtctcagcctccagagtagctgggattacaggcatgcaccgtcatgcctggctaatttttgtattttcagtagagacggggtttcaccatgttggccaggttggtctcaaactcctgatctcaggcgatccactcgcctaggcctcccaaagtgctgggattacaggcgtgagcctaccgtgcccagccttatttcataatttttgatcgtaattccacccacatgttctattcatgtgaaatttactaaggtgagaccaagtggagataaaaactatctaaacgaaaaacttaggtctctctttcagacttttttttggttttatggtggtaaatacaacccacttggcctttcccctgagactactggttcttttgtcactggagtcccagagatcagggtttgaactagcccaccacttactggtcatgtaactttgggcaattcagtttgcatccctaagcctcaatgtcttcatctgtaggatggaggtaaccataatgcctgtctcagaggctgctgctagtgttaactgtgggacacaacacagagtgaggcacagacgaggtatgcagaaaacatcagcttcgtggttttttactcttctgcacttgctgtagcattctgcaaaactattattcctttcctagactcatgcccaaagttacggaggacccagcaaccatctcctgcagcccctggaaacctcttgactcttctgtgatgtccccagtgatccagcagccctggccttcttttgatggcttgaacatttggtcttcattgaacagtttgtatattggaaacttgccagcctccatccacattccaacctccgtctgcatccctcggtacaaaatggttcaatctgtctacctcctttcacattccaccaagatattccaaggcccagggttcctttgaccacctcacacctaacaagttccctcactgtctctcactctcccctgaagattctaagctgcctctgtcctgctaaaactgtagacctgagaatgaagtaaggtgcttcaggtgaggcttgatcagcccagagcagaaaggggccacctcctcccaccctataagaccctattagtgcaccttggagccctttgcttggctggtggctacaatacacttctgttaatgacggaattccataacatttttccccattaatttctgctacaaaacacaaaagtcttagccaggtgtggtggtgcacacctgttgtcccagctactcaggagtctgaggtgagaggatcgctgagcctgggaggcagaggttacagtgagccaagatggcgccgttgtactccaacctgggtgacagagggagaccctgtctcaaaaacaaaaaacaaaacaaaacaaaacaaaaaccaaatacacacacacacacacacacatacacacacacacataaaagtctcatattttacacttatgaagttaggtgggttttttttgtttgtttctttgttttgttttgttttgttttgtacccaaaagtacataacctactactacctacctttttggtttttttttttttttgagatggagtcttgctctgtcacccaggctggagtgcaatggcgctatctcagcttactgcaacctctgcctcccaggttcaagcgattctcctgcctcagcctcccgagttgctgggattacaggcacctgtcaccacacctggctagttttgtatttttagtagagacaggatttcactatgttggccaggctgattttgaactcctgacctcagatgatccacccgcctcagcctcccaaagtgctgggattacaggtgtgagccactgcgcccggcccctttcctaaggttttctaaagcatgtttgtggcaatctatcttagaatcttgtcaaaggtaaatacaaggttcagggtttacggagccaccttctagccctttaagccaccagaattgctgatgtcttatggactcctgagaagtttgtggtggtgattcttagagctcagctcccgactgctggactgtcggtcactgggcagaaacagaactcagttctcatcacctggatgccgtttcatactctccaccctctcctgggcttcagttgccccacacaatgtcagtctctttgtgatggttagttttatgtgccaactttgctagggcatggtacccagatatttggtcaaacattatcctggatgtttctgtgaaggcactttttagcagattaacatttaaatcagtagattttggcaaagcagagtcataatgtgggtgggcctcatccagtcagttgaaggccttaatagaaaatgatgggctgggcgcagtggctcacgcctgtaatcccagtgctttgggaggccgaggcaggcggatcatgaggtcaggagattgagaccttcctgactaacatggtgaaaccccgtctctactaaaaatacaaaaaattagccaggcgtggtggcgggcgcctgtagtcccagctactcgggaggctgaggcaggagaatggcgtgaacccaggaggcggagcttgcagtgagctgagatggcaccactgcactccagcctgggcgacagagtgagactctgtctcaaaaaaaaaaaaaaaaaaaaaaaaagaaaagaaaatgacgaacctccccaaagaagattggattctgtcagctgacccaaactgcaacagggactcctggggtctctgcctgccagcctgccctgtggattttggacttgccagcccttaccattgtgggaacctaatccttaaacaactcaatctccactaccctcctcgcccttctctctctctctctctcacacacacacacacacacccacacacacacacccacccacacacacccacacacacacacacacacacacacacacacatccaattgattctgtttctttggagaactctgactaacacagtctccttctcagtattaatgtttttttcttggacagaaaatatagataaaatagaagtctagaagttctgttttctctcacgaccaaattcttctatttctcttttaacccattcagatttgtgagtcccggagcgtgctttgccagggctctgttgagttccacagtgcattgagcaccactatgtgggaggcactggctctcaacaggcagcaggcaccttttccctaatgaactgtctttccaggtttcactcaagccctttctatcagacttctaccatgcagctctgccaatttctttaagcatctctcccttcttcctgactgtcctgaccaggaaactccctaatctctaatatctaaagtcatgaagccaattgcatcattagatgcgcagtatatataaataacatttacttacaagaatatttttatagaaatgtatgtaaacatacttacatacatttctataaatacatttaaattcctaaagacttgtttgagcaatttaaaaaaaaaatgctccagtttaacttcctactacaattaggaatttggggcagggtgcataattgccagtgtactcacagtgactgcaattagaatgtgctgtggagtcagaggaactgcctgacagtgccgggcagttgaccctgggctgggttcagagctctccagtggccactgagaagtaggagagtgtttcctgcacaatcctgatttcttgggggaggaggtactactgcacgctgctgggaggagcctctgaaactctcctgggccaggtctcctcccgtgcttcctctccctgaggcagcctcacctcttgacgcctgtccccagcacacccttctgtagctttcctctgactcacccctctgtgtgtctttctctccaactcggggtcctgtcacctaggcctctctcctttttcctaggtggctggcagttgctcttcccttggttttctctaatttgatctctttcccacccttccagtctgccacagtcacccttgatatccgcagaatccaccctccttggaagggatgaggaagggggtttatataactcaatttcatttgtaatgtttcaaatggtattttttttctgggaataattggcgctggattctgaactatctttcctgttgcaaagaatgaaatcccttctaggtgatggggcttgatctttctctgttgcaatagcagcgatgtccaaaacaatcaatcagaggcattttctaccgtacctgagccattcagtggtttcgacctctgctccagattacccagggttatccagatgggttaatgcgagtccttagaatggtgtttcccaccttgagagtgggttgttggctaggtgtgtgggggagctgtttgtctacacctcagaaacgctcacaacagcaggttccagggaaagtccctgggtgtccagtaaaagctgggtcgccctccctagggggctctgagactagcagaactgatggccccataatttgagcacaggtatgcatatttcttaggggttggtgggcagactcattcatgttcccatcccaggggtgcaggggacccttctcccttccccacatcagcccagggccacagaagctcctcaggaggcaaggaagggaatggagaggacaagagtgcctacagagtgggaaggagacaagcattctcaggtatttatccagggtaagggcaagggcttttctgcagtccaggacattagaagagtcctgaaccaagaactccacccctgccccgatatcagctgtttttattgactgagctgttggagaacagttttggtgtgcggaaacagtgagatccctaaccctacacccctgaacccagcagatatatccacactgaccagaaaggactggctaaccacaagcctgcctgtgcatggcagggaaaggaaagccattcttgagtaaatggtgttcaaaggttgggcaatatatgtatatggtgttctcctgtggacataattgtgcacaagggtcagaagaaattgctttcattgggcaagctacttaacctgtctaaagctttgtttttttatgatctgtaaatgaagacagatcctatctcatggctctgcacgtcacacagcgatagcagacaggtaattaggatgcaggtagttagcagacagcctgggtgtactttagctgttcaagtttcctcaacctggcctcctagccatgacctttcacagaggtgcaaatcatctatgagtttgcacagaatcccctgcaaggaaatatgttcttgttcttgacttacatttgagttggttggtcttacagttaaggcggaggtcatcactcttaataaaggccattttaagtggagtgacaagtcactaagggacttgttggcattgtttacttcttatccagggctttccaagaagggacagtgtgtctgagtttttatcttatgaaggtttcccacctgcagtttagtttactattattctaagggctgtttataaatgaactagcttgtctttgcactcagggtaattcacagatttgtcagtgacttcattgcagctgtgagctttacacgaaccttgcaatccgccttgaaaaatgaaactgagtataagtggggaccaaggaagaatgtttttgagggaaatagaaattaccatcctaaaaatggttccttctgtgtgtctgctgatagaaacccttgacctctttagaaacaaccgcaaaattattcactacaattatctgaatctcataaataaaataatgattacagctgcatggaattattcaggtctaaattcatataaacatatccctaacaaatttatttatcatgacaggaaaggaaagcatagctttgtgcaccccatcccacaccctccaccccctacaaattttactaacactgtttctgggttcagaatttttttgcctgagttggtacctcaaatcacttgagttaaactgcaaatgaatcacacataatgcagataaaatgacttcatgccctaatttctagaacgtgacctgaatgtgaactagacattcgttttcctaaaccccatgagacccaggtattcttgacatgtgtagagaggattgaaggggcccgaggctgtctgtcctctctccgtgggcctggctctccttggaccaaatcgaatgcatgggaacacaccccccagttgtctttttccttcggtttatataattcctggcatgtgcctttcaacactccgtttatgttagaagtttggtattagcctcggggctttactcttgacactgctactaattctctactttatattcgtgattgcccttctgaaaggagaatcttgtttcaaaattgcacctgggcattttaaagtaaataggatgcaaatccttagttggcctcttgtgtacattaacttcagagtgaagaatgaatatgtaagacagtgatgggggatggggagttgagcaaggaaaataatttgcataatggtgtttgctccctggtgaaactgaaacccagcctgtgtgggtggggccttgtttccaaacgtcagcgctgctgcccacgaaggcctgcaccaacgcacggtgccctccgggccgcccacagaggccggcgtctggccaggagcaggggctggggacagcaagtgtgaaaccagctgaagcacctgcagctcaggcgggctgcaggctccctgctctccccctgtgaagaagcacacattgttctttcttcccgcacatttgaatctctcagtggggtctcattttctgtgacatggcaaacctcaaaaaatgggagtaaatcatttctaaagagcttagctaggcatggtggctcacgcctgtaatcccagcactttggaaggtcgaagtgggatgattgcttgagcccagaagtttgagaccggcctgggcaacatagtgagacctcatctccacacacacacatgcgcgtacacacacacgagcgcgcatgtgtgtgcacacacacacaaattagccaggtgtggtggcatggtaattccagctactctgggggctgaggttgggaggatggtttgagccagggaggtcgaggttgcagtgagctgtgatggcactgctgccctccagcctgggtgacacagtgagatcttatctcaaaaaaaataaaaaaatcaaaaataaagagctcctgatttccatcccccaccgagaatcattttctgagtcagctggagtgtttcagagcccaacacccaaggagcagtgcagggatggtgcccagttacaggggacaactcagctctgaatgttacaaagggcacttcatggaccaccaccttttctctgcttgctctgtacccctaaagtactacaaggcatttttggttaataataatttgaatactatgtgatcttgtagattctactgcgtttggctagctaatgtctctaagtagcaagatgatttattttttctggacaataccaggactatatgctgatacaggactggcttgctctaaggatcagattttccagtgtaaaatatatactccttatagggttgtaagagcagaagcccttcatagcctgtttctttttgctctctcttcagccagcagttggcctggatctttgctggtagacacagggaatgttctccttgacgagtggttcccaccctggcagcctcagatcccaccatgttggcagggatgctgaaatccacctgcctatcagcctttgtaaataacaaaaatcacaagtggctctagcatttatgtattctatgatattgggactcgtgatataaataatacaaatgcttttacatgcataattcaatttatactatgttttatctttaattactggataataaaaacataactactctcaggaagtgtgggggattgtgactcaggctaaggtgagcctcacagcctggaggctggctttagtgctggctgggagagctgcaaggagatggcatatgctgccgatgaaggtgttctccaggaattttcagttagaagttttgatcattgttcatttggcctcaggatgaacatcatggtactgctcttcattctctataattaatatacttttcaccgtcaactttgcatttgaaagtatttattttatgggaaacagtgaaaagtagataattagcacatgtgcaaatctgtttggcatttgtggggtgtttgccctgaaaacctatggatgaagcccaaagacaggagctggggggtttcatttagttaacttaaaagttttaattggtctgtgttactcttcttgttacatatttttttaaggccctaaggtgagcaagttacattttaaaataaggaggaaaagccagttttaaaagtagaattgagtcattgcatgtgttttttttcccacaaacattagctgtgtgattattatgtcccaggcacctaaggaatagtgcccttgtcctggggaagttcacagtttggaaggggagatagttgggaaaggtaatgtgaatattaacactcgtgtttcctgggggccaaaatgttccagcttctgggccaggttaattatctgaattatcttatttcatccttacattgggaaccagatgtccccaatgcccttcagtgatttttttggtggctttgaggaaaaatgaggcccagagaggttatgtaacttgtccaaagtcacacagcaggtagatttaaagtcaaacagttagctcccaatgtgcacactcttaattaccatgccactaaaccagactctgaacaaagcactctgggagcacagagaagacctctgagggtctgtctgtgtgagtctagggcatgttcaaagttaagagctgatgtttagctcagcaggaaagggctggggcacagtgttggatacacatatcaggtggcatttattgctgatgacagtaaaagaaaagtgtaaaacaagataatttgtttacatttcaagatacattaagtttttttttttttttttttttgagataagagtcttgctcggttgcccaggctggagtgcagtggcgcaatctcagctcactgcaacctccgcctctcgggttcaagtgattctcgtgcctcagcctcccgaatagctgggactacaggcgtgtaccaccacgcccggctaatttttgtatttttagtagagatggggttttaccatattggtcagtctggtcttgaactcctggcctcaagtggtccacccacctcggtctcccaaagtgctgggattacaggcgtgagccactgtgcccggcctcaagatgcattaagttttaaaggcccctggttatttctcgtcttctgagatgtcattccagtgtgacatggttaacatcagtgaggatggcattcctgtcccacacagtaaaatgtcacctctcacacatgtaactctgggtgtaaagtgagtaaaaatatgagacttagaagaatatttcatcatggtatgctgactggggatttcacttactgatactagaaaggttttgcatttcagaacacgatgaaataggtaatatttatctgaaagacgcagacaagtggtggaggaaccagacacccccagtgccatttgctggcttttatcagacagaaagcagaaaggagaaacatgttttatcccatgagaaggaaatattggcttgatgcctaccatgcccagccttgcactagacatccaggtagctgctccatggagaagttcacagggtggtcaggatagcacagggaggaggtaatacgcttgagggaagtccaggagggactcagggagtgtaagccagtaggggggtgctcctgagaaagggaatgaggctgtgccttgaaagactgattagatagaggaggaagtgaagcatcagaggctgcccaacagaggcaggagctggggctggggtgggcaaggagaaaatcacgccatcctcctgtgtggacagtagagtttcatctgctgagggcagaggccatgttttatccatctctgtccccttctatgtccctttttctcctcccttccccattccctggcatcatattgggacttgttaagggctgaattgtgtcccatcccaaattcgtatggtgccaccccaactccagtaccttggaatgtgaccgtatttggagaaagggtctctgaagaggtaattaaggtaaaatgaggtcatatgggtggcctctaattcaatatgacttgtgtccttataaaaggagattaagagcacaccaacatggcacacgtatacatatgtaacaaacctgcacattgtgcacatgtaccctagaacttaaagtataataaaagaaaaagaaaaaaaaaggagattaggatatagacatacacagagggaagacccacatgacaacatagcaagtaggtggtcatctacaagccaaggagagagggaggcctcagaagaaaccaccctgccaacaacttggtctcagacttccagccatcagagctgtgaggcaatacatttctgttgtcagtctctaatactttgttatagtagctcaagcaaactaataatccagtgctcaacatatttttgttgaataaaagcacaaagagattcatgagaagagggaaatgttgcatacttagggtaggagcaaaccacagaggtctttctcagcctgggcaaagaatgtcaactctgtgttggagccagtagggagctctgtgggtcctcgagcaggaaaatcccatggcttaagcagtgtttcaggaagactgggatgttaggctccggagctctgagcaagtcagatgggactgggagtcataagaaggcttgactgtggctagtgataaccaatgagcactggaaacatggaggggaatctttcctcccttttatatcagggttctctcctagaggagcaggtgaggacctctgatggaccaggaaattggaattctgcctgggaggcaagcccatggaggccctgatctgcttggacagagagtagctcccttcacctgtaaaatgagagtgaacgagctggtgtctaaggaattcagaatccacacccatggagttccacagggtatgtgggattttagggggaccagggtgtccccagtgcaagaaggaggctcccaccaaggggctgcagcactgcagataacccccaggggtatgaaaagaggctgaactgggggcctccacagtcagaatccatccattgacccaggatgccaggaagggggaggcccatgggcagcagaggctcaacgaactccgtggcctgacttggccactaggttttttcagctcttcagccactgcctgtaggaggctagctggcattccttccttggcccttagcttgcatggatcggggtttcacgttaaattctaagcccaataacatggctctttttatttaaactcagtgctgcacaatgatgaatgaatgaatgaaagatcagggcagatgaactgtcaaacctcagcagttgcccttatagttagaggtgtttctgtgaagcaaatcaaagcttatagtatcaagaactttttaaaaaagtacactttgatccaagttggatgttatttctaagtgtactcagggtgaacacctcttaaaaccccttattatgtatgctgagctattctgaacctcagtgagaaatcagtaatgtcaagaaacctatacataattatttgttataatataaaaatccagagctcttcaagcattattctatcctagttggtcagattctgcaggaatctgagcctgaaggaaaataaattccttgagttgaagaaatttgtgtcttgtaaaaaagctgaatgagaaataacgttaaaaatggaaggaggcctaatgatgatattatgccatctcttgtcattacttagtcctctgttgtttcagtcatttaatctggttttctttctggatgctttaacttccatcttaattttccttataattgttgtgcaattataaaagacaatctgagggacccgccttgacagcctggggtaatatcactgggagtaggatctctcagaatgctaaggagcagatgcactaagagagctgcatttcactccattttattggatcttttggtatatacgtttctgtgactttagttcaatgggatggactgttgcataatactgagggctatatgaaggaggagtcgtctacacttgtaaaaaccttcttctttaggggtgggtagtgtataattgcaaaggcatttctgatttaattaagagttgtttggttggccgggcgtggtggctcacgcttgtaatcccagcactttgggaggctgaggtgggaggatcatgaggtcaggagatcgagaccatcctggctaacacggtgaaaccccgtctctactaaaaatacaaaaaattagccaggcgtggtgttgggtgcctgtagtcccagctacttgggaggctgaggcaggagaatggcgtgaaccctggaggcggagcttgcagcgagcccagatcgcgccaccgcactcccgcctgggtgacagagtgagactccgtctcaaaaaaaaaaaaaaaaaaaaaagagttttttggttacaagtgacggaaaactcaattcaaagtggtttaagcaaaatccagagttttaccatctcatgtaagtgaacaatctaggaaaagggcgtcatacatacagctcaaaatgaagtcaagatatttcagatctgtcttctcctcctggcccagtttttaatgctttgaccccattctcaaataaactcaaccctcatgatcccgaggtggctgccatttgtcctttcaggtccaaatccagcaggaaaaacttttgtcacagcattcctgtaaaaggtatgaggttcgccctgattggaccagccgaggtcacatgcctacacatgagccaatcacagtggataaaggactgtgatgtactcattaatttacccgccattatctccactcctgtcctgagggtggagttatgaagcttgctaatggggcactaggatgtccactaggttttactcagtgacataggtgacccactaaatttaagcatattggtgtgcaaaggaggcatttgttgacttgcaagtagacacctctcacttatttgtcacactcgctcttccttttgtaagcttcctgggagagggatctcagtggctttcaagatcaccccttgcaaattaggcatcatgcccatcattccatcccctgtgtgagatggcggcagaacagttcctattcagacacctgccctcatgcctcttcccccgtcctcccagcagccccagctcctggttcccagcatctagctccttccttatcagcacagggagttgctttttgtttgtttgtgtttgagaaagacttcttatttcgtgcatgcacatttcctttctgtgaagcagactcgggagctttgcctttctgacttattctgtgcatcctatcagtgaagtcagtgagtggcttcaaaaatgcttgctttctttctttttcttttcttttcttttttttttttttttgagacggagtttcgctcttgttgccctggctggagtgcagtggtgcgacctcggctcaccgcaacctccgcctcccgggttcaagctattctcttgcctcagcctcccgagtagctgggattacaggcgcctgccactgtgcccagctaatttttggtatttttagtagagacaggatttcaccatgttggccaggctggtctggaactcctgacctcaggtgatcctcctgcctcagcctcccaaagtgctgggattacaggcatgagccaccgctcccagcattttgtttgtttgtttgtttgtttgttttagacagagtctggctctgtcacctaggctggagtgtagtggcgtgatcttggctcactgcaaccttcacctcctgggttcaagccactctcctgcctcagcctcccaagtagctgggattatagtcacccaccaccgtgcccagctaatttttttgtatttttagtagagactgggttttgccgtgttggccaggctgatgtggaactcctcacctcaggtgatccacccgcctcggtctcacaaagtgttgggattacaggcatgagccaccgctcctgacccaaaatacctttttctttttttttttttttttgagacggagtctggttctgtcgcccaggcaggagtgcagtggctcgatctgggctcactgcaagctccgcctcctgggttcacgccattctcctgcctcagcctcccgtgtagctgggactacaggcgcccgccaccacacctggctaatttttttttgtatttttagtagagacggggtttcaccgtgtgagccaggatggtctcgatctcctgacctcgtgatccacctgcctcagcctcccgaagtgctgggattacaggtgtgagccactgctcccggccccaaaatactttctgatgctgataaaatgttttgtctactcttatgcccaaggaacagttcctcccttagcagaagttagtggttaaagcttcctctatgtttgccagtcaagaatgccacagggccagcctaagtgtccatgagtggatgagtggataaagaaatgcagcacacacacgtatatacacaatggaatactattcagcttttaaaatgaggaaatcctgacatttgcaacaacatggatgaacctggaggacattatgttaagtgaaataaattaggcacagaaagacaaacaacacatgatctcacttatacgtgatatagaaaaaagttgaacttacagaagtagagagtcgaatggtggttaccaggcattggcagggatagggtaatggggagatattgttcaaaggatacaaaagttcagatagataggcgaaataaacttaagagatctactgtacaacatgtgactctagttaatagcaatgtattgtattctgaaattattgagagtaaattttaattgtcttcaccataaaagataagtatatgtgaattagctcaattgagccattccttaatgcttatttccaaacatcatgttacacagtaaatgtaatagagtttttgtcaattaaaaaaattaccaaaaaataaaaaatgaattccatagagacgttctctccaggaagggtccccttcctagatctgactactggttagggttaatcaatgccccttggcaaaacaaaaccaaccccacatttcttcatctcccatgtccaagacacatgcagtgagttctcagtgtttactaccagcacacaaatgatggctgctttattatttggtgacctttgttgtttgctgtgattgttctgttcagttttagtccctcacagcactttcggccatttagaaagacagtatttgttctgctagagcatttgcaatctgtttctgattagcttaactggtcttgaccagtgctaagttcacacttcagctttgatttatgccgtctctatctgcagatatgtttcttgttacactatacaagaggaggcctcttcttattgacttcttattttcatgtgaacgaggtaataggtatcaggaataattagacaaggccatacgcgctaatgtcataggagactgagatatggagagtaaataataacaaaattcctgattactagggcatagaaaaaaaatcataggcaactccccaagttgataatcccaaatgtctaggcgtccttctcaaatagggaaacgtgacattaaaactactcaaaataaatgagactcagtggtatttataaccatagataaaaaagagcaagggtcctggggaactgtgccaaggcccagccctttgattcacaagtatccacaaaaacagactgtacgggctgctttcaagagaaaatgtggccatcaaggtcaacactggaagccctatggccactcattcattccatctcattggccctgagcctttcgaaaagtaggcagagaagaagcccaaagaacaacatggcaggcaggttaaggaagaaagcagagttcacagacatcactaacaatttcgtaatgacctcatgacttcgctggaaggattccagtggaggcgtcaccagccctttgtccacctcttaggctgagaacctcaaaggttgcccacaccttgaccacatactttcttccttttcttacacaatcaagctctgcaccaaacattagggggacatttgcattttcattatattcatgcgtatttctagcaaaatacaaattcttacaagatgttgacttgtacagtgtggcaaggaatactgtcatacagttgtgccaaaaacaagcccatttacttatttttttaaaaattaattatatataattcttataaaataacaaattccatttatttcctcttgatctctgtcatcagagacatttgaaggtcggaggtgggttcaattgaaagacataatgcacttgacaagttgttgtatgtgtgcattgtgaataggccttaacagtgcattcatttgttttattttttcccatttatacagacttttgttctgctcttagataaaatactaataaacaggaagttgaaaaaaaaatgtggtgcaattgttctgaatgttgtttttcttgcaaggctttatgggctacaccacaccatcctattcaaagcagtccctgtaggtggtggtgttaataaagaaatgaggctgcccagggccgcctgcctgagcctctctgcagctgctcacctcctgctgaggcctctgccttcagagctagtggggcctgctcacacattccagtagtttcctctttatttgtcctgaaccaagttgtagaatttaaaggaggtgaagtaaggcgatttctatggaaaatatatttttcttctttactcctcatgctgagtgcataagaatttattatttcccctgaatgttcaaagtggtgtgtgtgtgtgtgtaaaagaaccaggagcaaacaatcttaataggaatgtgcgatcttgtgtttatctttagcacacttaattagctacaacccgggactgttgccatttgaacaagttgttaagaaaatctgccatgttttgctcttttttaaaaggaatgactttaataaccatagcaacacttactcagttttgtgatccactccaagattatgggagcaagaacagatactcctgaaagcaaccctcacctcctcccccgccccctgccctcagcaagtcctggcctgtgtgaactgaagggtttggaagctctggtttctaggagtgcccagaagctagaaagactagggtgtactagttattgaggggcagttgtcagtggcagtgtgggggcaccccagttgttattcgaggcactgcattgcttttttgtctcctctgtaagcatcctgcctcagtgtcagggcttgcagaactaggcctggagttatgccccctacccaaccaaggctttgccttttgccccccactatggtgccacctacttgggtttcccacagttggtagtgccaggcaggaagcaggagtgcaggttgcaggaagggagagcagaggaaacagaagttgcttaggagggagttgggcaggctctgtccccagcagatccaagggtccctgacaaagagaacacctcacctccgcccctccccagaggcacacagaatgccccctcccaccacctccaggctgttaattcacacccacccaggctgcccccaggctccccagacctgtgccagtcaagcctggcctgtggctgtgacacctgcattaccccagacggttgcctgacctaggcctgtccttctatctgctttgtttttatgttgattactaggtgaagcacagtgttaaaaacgggaagaaaaggctaggaatgcagttatgggagtgtgaggctgggttggaataggtgggagaaagtccagggctgagtgtgtggaccctgctctagggatctgaccggctcaagctcccaggccattaaacaaagttgttaatgaaaaaaaaaaaaaaaaaaaagggagagagtaaacaaatctctcctctgttattctgcacctggagaaaagtaaaccccttgggcataataggctgtcaccaattagacatccgggaaaggcttttctgggtttagcccttttggggaagcatgggggtagatgtaagtgtgtgaaccttcacccaagttctggagaaggattccagagtgaaagaggtttccatgctgagtcttgcatttaagggaccttccatggcatagctgcaaagaaacctgaattgcccaggattaaccacctttcctttagacggtgagcagtgtgtttcacgaacacattacacattttagggttgtctatggaggtatcggcactttcattactatttttaacattttattctctgttcagggttaagaacttcacccacctaagtcagctcctgatacaacatggaatgttccagcaatgaaatgtgaacttaagatatttggattaaaaccccaaagttgagtcaggtttaaatattctgcaagaagcagtgagctccttttgtctatttgggcacagttttcgtgaattatttaggcttttcttagatgcctgagctccgtggttagacagcagataagttatttttccctttaatgctgaggcattttcactgatttcagtcttactcattagaaaattctgtgctcacccacagctgccagggtttctagaacacaacaccctaccttctcctgtagacattttagtccgtcctcgctcctgcactgtggctttcacagtcaaatgtgagttgaccagccgtcatttgtgagctgtgagcggtatttttggaacttgcccacccccgttcccccagagtcctgtggaggtcatgctcatgggttctgccaccgggacaggaaagtttggacattactaccaaaaaaatgcaacgtgactaagcaccgtttaaaatagcctttcttattctcttgtaaaattgcagggatttccatgacagatgtcgttttagtcattttaaaacttcagcgcgctgaacctcatcagcatatttttatttttgacatttcatattttagagtggattgaaaactaatttgatccatttcaatttggaacatccctcaaggtcattttaccagcatttaggccagtgttgatcttgctttcattttaaacatagttattttctctctgtgaagtgattactccttgcttggtgtgtggtctggtgacttgttaatttcaaaattctacgatgcaagcgggtttggacgtggagcctggcccggtgtggccaggctgtggctttgcccatcgcaacggctgcctttgcctcaaatggctcgaggctggcacctggtcaatatttgcttttgtccaaaagaaggaaacagtaggggacttgggtggtgtaattttagaactttactgttgggttgttggcttgaaagatccattctcttctataaatacagatacatatttactcctccaacctttccctccacacaattaagaaaccctacaattaattatgccaaatcaagatttgcttttctacatgattttttcccttttccctaggaagtctgtaatgaattttcttctttattgtaatattttatgtttttatatacacttgtatattcttatagcacatatatgtatatatgcaaactttctgaggcttctaaaaaagagaaataatattggttgattaacctcaatttcttttcaatatcaaatgtgtaacaataaccccaaaaggagaggtttcagaaattaaaacaagttgacatttgcccacttctgaattaaaatgcagcatttgacttttgtactgttttggctgtcaagccttagttttttcacactatcaggtattttcagatcaaaggtaaatatgatttagaattatatttcaaattagaactgtcatatgcccacacatacattttgctgatatacttacaaactggtaaacaatgctctttaatcaacaattcataatctgggtcagcgatttttatctccatatttgctcatactgtatgacatcaatattttatattggcttgcccataacttaatattttataaaagcctacctatgaaattcatatttcatatttgcttggctatgaaattaatttttgtgatgctgcagttcaccttgtagcatacaaattgagaaaattagcaagctgcatgtagttccttgctgtacaaaaacaaatgacacatggtgtctttatcacttgttttgtatttacagataaattttaaaaataaaacttgccatttctgttaacgtggaaaactccccaccccactcccattcttgttgactcttttttatttttaaacaacaaatacataatcaacttcagtcatctcattttcaggggagttactcattgtattttctacttacagtcaccggggctgatgttgggatctgtgatcagtttcctgttgttacgcatagcttttctcagcggtgagagagacatcatgtacagagtacacacggagggttgagatagcagcctggtttatcttacttctgatatgacttttaaaatattgattttaaaagtgtgtctttgagtgtaccaaaatagtatgtccctgatgcttctcgctggatgcaatccctgcgcaaatgctttctatgcaattagattttggggctcagcttccattttttaaatctgtgaaagcattgatcatgccagcggccctggagagggccactctgttttagtgccatttacatgtatcaggacaggacagaaaagggacagcatattacaaacaaaataaaactataatcttgttcaatccttgtcatgctgaggatgtttgtaaatataaaaaaaattgtatggattccacttacatgagataactggaggggttagattcatagagaaagaaattagagcagtggttactagtggctggaggcaagggggggaatgaggagttattgtttaatggggacagagtttctgtctgggaagatgaaaaagctctggagatggatggtggtgatagctacaccacagtgagtgtacttaataccactgaagagtacacttaaaaaatggttaaaatagtaaattttatgctatgcctattttagcacaataaaataatacacattcatggaaacagggcatttaaatcattatgcataataaagtgagaagctagttgtgatttgcaaagaattatagaaattatagggagaaacacaatctcaagagccaccctggagtccagagctctcgttttacagattcaggagtggaggctcaaagaatatatgctttcttaatgactggaacccagacggcaggacccccacacagggctccttgctgaccctttgctgccttcccccctcccttagaggggccattctttattctgagtaaacgtgccactgattagatgggcttcatgataaagacctgcagtaaggacgttttaatcctttaatctagacggttcacgagttccactggtgtgtctctgggggcaggctcccagatcacagactggttccaccgtgccccgtgacctcagcgtgccattagatgggaggccgttatttcaggggaaaaatcatgtttgaaactaagtgggtccccggcagtttgcagcaacactggctgctcaaaaggacagcacgaggcttttcacagcatgtagatgccatggctttatgagagctttgagcttgggagggtctacttgtgcttttgcaaccttagtttagatttcatttgcatctactatttgtaagtgcaccatttttctacgggaagtatgtatgtgagaattatctacatgatttttgtaggtggctcacaaaacaaatgtcagtagccattctatggccttggagtatcatttcccacaccttttctatggactgtctttatttttgactctaatacgtatcccttatcatacaaaaagttcttgagcatatttgatatattttaaaacttccaccccagtggaattaacactaattatatttaattccacacaaacttttgtcccagttgtagaccatttacctacttcctgacagcaaacactacaccgctgtgaaattttattttaacacatttgtgcccattttcagcattaataatcgtgtgtggaagtggcagcaaaatgaagatatcgcctgagcatggaaccacaaatgcctgaacgtgtgatggcatttgtgaaacaaaagcatgacatactttttctttccaaatgaggcagtgccacaactaaaaaagccagttcgcctttcgctttctaaaatcatcttgctggagagaacggttatcaaatcccatccactgcccatgtaaaataaataccattcagaaaagcgtggcatggatggccatacttctgatgggtttataactgtagattgcatacgatcccaacgtgaagcctgaaatacgacattcaacgtcaggcttattccaggctactgctgtggctacttttgtaattcaaccagtggggcgttttaggctaacgtatattgcctctaagctgataagcattttcctgatcccaggccccttctaaaattgaacacacacgttcagctggggacacctagatggaaggaagggaaagaggagaacccgaagtgaaggaaaagtcaccaagaacagtttcatggaaaaaaaaaaaaaaactctcaagaattaagaatgttgagttgcttgaatggagcttgggcaggaaaaagaccataactctcacacacgtgaaggttactgatacccaggaggtaaaagaagtatttaacatgctctaaagaagggtaaccagagtaatggggcgaaaccaagggaggacgtcctggaatgtaatattagaaataaacttccaaacagggaagtgtccatccgagtgtgaaatgggtttatcagaaacaagctgcatgccagtttcattgacattgcaaagaaggttagaataaaaagctaatgaacagaaagaagaaagaggcaaacagggtgtgtgttgagagtggtggaatatgaaggatggtgcatttgtccaggctggggctgctggcctgaggaatggtggtggagtttttttacagagcatcttctgagcaccaggagagtcccggaagctgagtttgacactagcaagacctgccctgaattggggactgctggatgcctggaagctcccctacacttacgttcctgaagttgggctttttatcaccttaggactatggcttcccaaacttggcagtcagcgtcccggcaaaagcctctctattactgcgaggtagtgtttatggagtcacagctaagaattacagaaaaaatcataataggtgaatcttttttttttaaaaaaaacaacattttttgactttgcaaataaattgcagaattatcaccattgttgaaatattttccattaaaactagagtttattaaaagtgcctggaaggatgccccctgctgcctccctgagtcatcgctttggatttgttcttcagaggcagagatttatttccatagcaggggttttcagttttgtgcttacagtcccgcagtaagtcttactggcttcatcttctgacctgcttttaaaacagtcctccaccgtgctaggtacacaaagggatactttttgggtttttttgagacagagtctcgctctgtcacccgggctggagtgcagtggtgtgatctcagctcactgcaacttctgcctcccaggttcaaacaattctagtgcctcagtctcccgagtagctaggactacaggtacgcatcaccacacctgaataattttttttttttgtatttttggtagaaacagggttttgccatgttggccagactggtctcaaactcctgacctcaggtgatctgcctgtctcggcctcccagagtgctgggattataggcgtgaaccactgtgctgggcccaaagtgaaactattataacaaggtaagagcaacttttcccagagttaaaggatggtgctccatggaatagtgaaagtctgggaccaaagcaccttttccctttaatttctccaattgcttttaaaatattctatgcaataagcatctgagtccaaagggaggctgtgtcttcctctagggtctctctgaatgaggtcagtttctatgttaacttttacgcttccttttttgtctcatcccaaaccatttctcctcttgtcatcctctttttcctcctccttttccttcttatttctcctgttgccttttttctacctttttattttttgccaatatacataaaattgcttgttaaaaaaagatcaaagacagcatttttatatttttttcttaaaaaacaatatgaagggctgggcacggtggctcatgcctgtaatcccagcactttgggaggccaaggtgggcggatcatgagctcaggggttcaagaccagcctggccaacgtagtgaaaccccgtctctactaaaaacaaaaaaattagctgggcatggtggcgcacacctgtagtcccagctactcgggaggctgaggcaggagaattgcttgaacctgggaggcagaggttgcagtgagctgagatcgctccactgcactccggtttgggcaacagagcgagactttgtctcaaaaaaaaaaaaaaagaagttaaaccatgaaaccacccataatatattagtcttcagaaagaaaagaaaaccaaggtaagatgcaaataacagaagtacaacttttatttttctaattgtggagtgactccaagaggattctgctcccaccaggtgggcgataggcgtcctgttggtggcgtgtaaaggaatggaaagctaccacgacctggggggtccaagaggggctgctgcaggtagcctacccccccagccttccccatgaccacagccacccactccctcaaagtgggacttcaggccaagcaggggaagatctcaggcgaggagaaacagtccatccgagagctccctgggagaatcttgtagactacacgctaatgagataggcctgtcgccaaaggtcacctccgcactgtcttggccacaaatgaggcctgaaatcctgctattagagttgcacacacacaggagcctcctctgggagttctgttaaccactggtctgggagaagagacggcacagatggcctccccagtctttccagggcagagcggtgggggcgggaaggaaaggaagtgccgagtagttcaggagagggggtgggcatggggttggggggcagcctggggacactatggccccatcctagcctggtgggagctagaggaacagggaaagtaagtctaaagtaagctagactcaggaaagggaaagaaaactctgcgtgtctttttttctttccttcttttcctgacacacatagtcttgtgctctctctgggctggttccactagtgcagcgatgctatgggggaggggcccagggccctgataacaggtgggcgtgtgtcaaatagcaactcaaccaatgaatgaatgaatctgcctctcctacctctccggacagttttgaagtttaggtgaaaccatgtgtacaaaagctcctgtgaactgggagacactttgcaatcccaaagtggttaataataaaaatagtaatacttttaaaaaatcataacaaataataataatgctattggaaccatcaatctaatacactttttttctgtgagagacttattggattctttccttggcatgaaagccctgcttctcccaacacaggcaggctccctctggcacagggtgattgcatcatagacctgacccaacgtgacagagaagcggttctttctgagttaccaatggccatccatctttcagcaggcgtgccttcccattttccttgctctgcccatgagaattttcagcagaaccttggattaggtgtgccagacatgttctactcttgattgtgaagattatacacactctcaccttctgagataaatgttattaaattggataaacaaccttgtgtagttttgcttttctgttttatctcaagatcctgctgacatggctaacagggcaactgtgaaaagatttttattcgtgtctacatcagtgtgaaaggcttcatcctggtgtgtactaatcactcagacagtggtatgaataaatgaaggaatgcattgacaaactaatacacaaggtgattccggaaaggcgcacctcctgggataaatacggtgacagtggtgagtctgctctaggtctacgaagttcttgctcttagtagagatccagacacccaatgttgaagacagttcctctttgctttagaaagctttgtgtgcaagagatggcaaactacttcttaaaaaacagagagtcccgtaaacatatgccaaggtccacggtgctccaggcagggtgcttggtgccagagagacagagtgaactgagctggccatggcatctgtcctggagaagtcacactccaatcaggaaggcaggaatgtgggccagacctacagcctctggggaagggtgtccataagctgtgaggtggtggctactgactccaatggcagagaaggtgtggtaaaaaggcaaggacatctgcaatccttctctaactcttgacttattgttatctgcagcaggttaaccacccctctgttaacttccttctctctaatgaggatattaagagtagttgcctcagaaggttgagcaaatttggtaatttacacaatgtgtagttgtcccttggtatccatggggaattgattctaggatctcctatggatatcaaactccaaggatgctcaagtctctgatacaaactggcataatatttgcctgtaacctacacagatcctcttgtgtactttaaataatctctagattacttataatatctaatgcaacataaatactatgtaaacacttgttatgatatttttattggcattatttttattgttttattatttttaaatatttcaatccatagtgggttgaatccagtaatgtggaacccacagatatagaggccaagatacctcaatgattggcagttccagcattgcccatctccctgtaccaatctgtgccaacctcggaactgtggttgagtcccaagctagggggtcggttcacaccatccatcccaccactgcagcagatgctcacccagcgtcaactctgaaccaaacaccattctgggcaggggcgaaggtgagaagcacagaccttggccctgctctcccctcctcaggagcccagcagagccagtccccacaggtgggactccactacccaagggaagcctgaggcatgaggcctgtgtgttgctcagtgaccgggtccatcctcccagtgccagagaaaaggaggtgcccctcaaaccacaaagtaacccttggacttctctttagctggggtggtggctgctggagagggccctgcttgctcatctctgccagcttcccagtccctgcaaccagcagtggccagcctctggccacccccatgaaagcacataaaagggttggggaagccgcaaccccagaattgaggtgagctagagtttgaggacataggttgcttttcacttatctccagcaagaaccatgttatagatcattggtacagtgacgattttatgcttctaattgaatactgatgaaaaatggcaatggtttctcagttacttcttggaaataaattgtgggtaaataacatctgcttaaagcttggaaacccagtttcctttggtttgtgtttttaaatgctttgacgatgcggtttgcttttttactccaagaaaaaaaaaacaattaaatagaggctgacaactaggtgagatccacagccaagctattctaagagcccgaagtcaccctggacacccagcttgatgacaaagggcagaaattcaatatggaaataggatccactccaaatgcaccatctccgacattatgatgaagagaatatgtatttcatgacagggcaaatgttgccatccttctgagggaagatgtaaatgaggatgcttttagggatgatttctacattgtcactaaactgagacatttgtgcttgctcgtgccaagtgaagattgctgttgctgttgttctctcgcagtgattagggttcattccctagcaacaggcagcagcagaaaggaagctttgcaggcagagtcaccgaataaacgcagtgggaacagtatcaacaacaaacccagtgatgaagggaggggcatgtggggcacaccacattgcctctctggcttctcgtctgcacctggggccagaggcaggtgggaaggagaccttgacaatgtgggaagtccctttgatttgctgaaatggaggagttcacattttactgtgcagtctaacattgcccattctggattagctccatcagacacgcttttgtgctttactgtaactctttctttatttgtcctcctcgaaactgatccataatgccaatttgctgatcagctgtccctgggacttcggtgtactgggctagaacctcagtctagtgttcaaaggagctggcagaatgggttgtctcggcatggaggacccaaaagcagagctccctggtgctttgggggagagtgaagcccttcattccactcctcattgcagaccagctttcctggtattcatgcactgctttttgtaacgcctcaaatgaaggccacagctcagccaagtagaagagagctcctaataaatgaagtctggttgcctttgaatttataaaataatcaaagttgctatttcctgctaaggagacagatacagaacaggtgataggccacagtcattactgtcccctgcttgttccctgagcccctggccttctaccttttctaactgctgtcagaaccctggttggggacttccttttgcctggttctcctgggcttgaatggcaacctatattgacagatttcatgccacagttctttttcaaacaagatgattcacaatggaataattgggtttgggaagaaggcctttttaaagcaaactatggaaaataattgatgagtagcgcagttttataaaacttttttttctattaccctttaaaaactatgttgctaactgcacatcacactgcattcatatcctgggactaataccccttgacctctgccatatgaattaaggtgaaagaagggtcataagtaacaaagtttcaaagttgaatgaaccttttttttcctgtaattttactgaccatttccctttctgtttgagagatctgtgcggtcctgttgctgaggttctgtggttcaggggtgttatcggcgacagagtgctgatttcacttgggtctgttctggtttgtcttaatttctcttttagagcttaattttcatttccaacgaattaggcaagacagaaagtgacatttggaaaagagtgaatggatgactaaacattcaccagacgtcattcttgtaacagttaaatggtagtgattcatgtctccatctcttgataaaatataaagcattaaatcttgatggctaaacacactgacaaaactaccgaaccatgttcctggttgaggatacctgaaggtcgacatttatctgggatcttttgctgctgctttggtatgacttctatcaagatagctttcgacgaggtagaacgtttgctttcactctgggttttccttggtttcgacaatttttaagtgttaactgaaggaaatcccgtcttgtcagaatgttcttttcaatacaaatcgcagtgaaataacgggctagaaagatgtggatccttcttgattttaggaagcacacacctatcggcaactctctctgcctggcctgtgttcacggcggtatttttgcctctgtcaccatccttgggactaggtacaaaaataggcttatgttccacgtgtcacccaccacttcacttcctttttaatagatcatgggtaaggaggtgagaggacatgagaaggattggtatgaagtaaataacagttaaatcttttcagccaggggtggtggctcaagcctgtaatcccagcactttgggaggccgaggcgggcggatcacctgaggtcaggagtgcgagaccaccctagccaacgtggtgagaccccgtctctactaaaaaatacaaaaattagccgggcgtggtggtggatgcctgtaatcccagctactcaggaggctgagacaggagaattgcttgaacctgggaggcagaggttgcggtgagccgagatcgcgctattgcactccagcctgggcgacagagtgagactccgtctcaaaaaaaaaaaaaaaaagagttaaatcttttcagatttctaggctggaaatcaacagaacaagatctgctagcagaagttgttacatctcaactaagtatagactggagatgaatctgacaacctgtgacatctttaaatgtcaaacccaccgcacatcacagatgacatcgtacctaatgatcaaactccctttaaaatatacttcatgtaaatacatttttgcgaaaccacaagctgtttctctcagttttgttttcagctggctttgataaggagattggttggcagcctacagctaattaagcagctttcaagccaacatcaatgaaaggttttaggtgactatcagaaatccattccactctccatggtccaccggtgtcgactatgcctttcaattgtgccgacagaccctgtcagaagagaatggtttcgcactaatccaagtttacaaccaaaatcatcctgttttcagtggtgtagatccagtgtctgtatctgtcttgtcaactcacaatagcattagcacagggggctggatttatgctctaagaaatgcaatttacctttctaagctcacttatatatatttgtatctaacatattgtaaatttcttaaacttgttacacatttaattttataactagaaatcaatttttatttatttatttatttatttagtggaaaacagaaaatgaagtgcaagagaccctcatttccggggcaagaattctgagttccttggcttctttcattcttgtctgactttcccccctccagttgcagttatttctagattttggtaaattattcattgcttttaaaagagaaaaagctcgattttctaaatctacagttgagctagccctaacctctaaagccagattgctttaacaaaattgtcatcattttatacatgacagattggcttcaaataaaatggtaaatgggaggaaaagtatattttgcttacacttaggaatgcctgtaaacgtaacagagtttaaaaaaaaatcttggtgttttaacaaatgcatattgtgaaaaagaggaagaaaaaattagctggttgcctgtgaagtaattgtgctaaaaacattcatttttaatatataagagttcacattttaattcatatacttgcaaaagaaaagtgggattttttttcttaaggctttgactatttaaggaaagcttttgtgctgtgccagtctgcttttaagaaattccagagttacagatacaattgagggtgaacttgaatttgttccgtgggcacggccttttctgttgtggtaaaacaaagttaaaatgacaacggttctgaagaaagtgcttcaagaccatgtcctgtttcactctttccagatgactaaaatcaccctcatttcccaagtcttacatcgggggaagaggatatgtggtttaaaagagtggcaagtactagttaaggtcaggctttttctgaatgtgaacattcagttatgctgcatgaagataggggcaggtattgcagagtaaaattctcatacagaaaatgtctgaaagtaacaaattaggtgattaccacggtctccttatccactgtcatctttaatcgtcgtgtttttttttcaaggctgttttgtctgtttttaaatgctgttgtcttatataaatcaggctacttgctttaaagtaccagaagaatcctataatactgaaaaaattgaaatataaaaaagtgaagtaagaattctgagtcacatgttttagatacggtgttaaacaacataacacattatcttgaatggaagatgttattaccttggtgctctcatcagttcagcttgcccagaagcaatgccaacctttcactgagaatcttttaaactgaccacaaatgtccctattcttctcaatgatttaaaatgtcctgtgctaacttttctatcagtcaatatgtatttttcagtgttcttactgagttttgttatttgcttttagttcttttcactgtttatttgctggtttatgttttatgaagaaatccactttcagaagaaatgatgacttattttctgtgggtgtttcctttcttcactactttaagaattttcaagtataaataaattgtgagaatacatatgtgtgcaaggagtgtggggaagagttaactaatttttaaattgaaatgagggaaatactgggctgactctactggtgtttttcagagtgttcctcaatttaacaaagcaaagcactgagtagtatttctttctaatatagatgtttaaaaacatcttccaaagtaagtagcaagaactaatgctcaaagtgttgtctgaaaaatctagaaatatctgcatgctgttatgaacaattctgtttctttatggagagttgtttgggctttttagaaactcattaatttgattgtaagcacctcactgttatcaggaaaagaagctttagaaaatggtttcagaatgtgtcattttctccttgttttaatctgagacagtgtgtgggcatgctggtattttaaaaggctaaaaatgttgtacatattgctgtgtcttcaaatatgagggaagattacaaacagaagttttcttcaagcctctgtctgaaattctgcttttcttctcagtagtgattcttaaatttttacggagagatctttcattcttttttttttcattttcaatctgttgttgaaattcagcaaaacaaatattttaaaagccaagtcagctttctaccgttttgatctgaatatttaatgctttataaaataaaaccctgtgttttaattttaactagtttcattctttttttatgaaatgatttgcggtattagactgtcatttggtttcaatattaatatataacatgaactacgtgggtgtcacttattttcagtagtaaataactgcttaaccgattactttactttaacatagttctactgttctccttgagcctcgtgatctgcatcttcaaacaatatttggtgtgtgtttttgcaaaatagcatttacatactgtgtcattaaaaactagtttcatggtgtcatggtggtcggaatcagggaatgtcgtgtagttggtttcaaaatccatcagtaggttaatcattaattattctttttccaggaaaaaactgatgaggttgtttcagaatttgaatttactagaattccttttttttttttgcattaaaaaaaaacttttgcattttaagcttaaagggggttaatttggtaagaaaaggtaccttttctgtttgtattgtggcttgttcattttctcataaactgtatttggtagctaaaatgttgaaagcagtttgggaacaaaatgtctgctcaaaccatgacaaaattggccacaatttgccgattgggctgataacaaaagccagcaacacaaaataggtagaaaaacagtttgttcggtgatgtgagaccactgaagctcttttttgcatgttttttttttttttttttcattctgatgcttatgttgtgatggaaatacatgaagtctctgcttacccattgtttctgattaactatttcatctttggatttcttttaaaacttcagaaaacaagctgccccctgggcatctgagacaaatttgaaataagagccagctctgcacctaaacattgtgttttctctagaccccacttggttgtaaatgtcccaaaactcttgttttgatcgtttaaagcagcatttaaattccatttcccccaccaccccaatgttcaacattgaattgtatggcttttactacacttttgcaagtgtaaaacaaaaattctagtttgcagtttaaaagaaaagttctccacctgggtatatagttgacaaaaatgtcaacagctaaaagtacatattgactctcatattatcttcgcagactgtaagcaactattaatgttttacatgagacaatacatttttttcaaatgatagaacgagataacagcctcctctcccttgcctctgctgttgtaacttctcataccttgtgttgcctctgtgtgtgtgatggtcttatttttttggtcttaaaaatcagatcctccaggacaataattaggatgaggtttatgtttctacttatctaatctttgttttcacaaataaatacaaataactcaaactgaaacttgatggctttggtgataatataatagcagccacggggaaattttcttcattttaatgttctttcacaacccacattcagtttcggtaggaaaattattaaccttttcaaaagcatgctgaaatatgggttcacaatagactcctgagtatgatttgcaggttttggttctattttgagattttggtgtacagtttttctctttttttctctctttctttcgttcgttcattctctcataccaattgctttctttgacaccaatcgcaatgacttaaaatccttcagttgatatctttttaatgtgtgcacgttatacagtgtttgcatttatttttttattatgagaagggagaattcctatttccttctctcctactgattggttctatgaaagaggacatactctttattctcactgtttttctccactctaatcctcatgtggaggttgtgagtcctccagccccatttaaaaaaatccagttgagccacatttccccgagggcacctggctccatgtcaggcatcagatctgactcctgtctgcctccagtggcctcgtgtctgtgtccatcacaccaaagcaagtccgcccgtttgggcttgctgtcctgaaggtctgcacggcctcaggcttccaaggaaggcctgggtggcggtgtctccatagctgactgctgctggggctgcaggtctggaagggctattggagggaggtgatcatgattttgtaactctggcttcttcacctgaaacacacacgagggcaggacctggggccagagaggcaggtgagtaggaggatctcggataacagtttctgttttaggcatccccttctccaagtctggctgggacagccacacctgcagagagggccctgattggggtcgtggtcctgccccacatctggcaagcctgtgcctcatgtactcacagtcaccttttttatttgatccccatccatcctaagtccccaccccaccgcagtgccctaccctacctgttcccaccgtccctgcaaagttgaatatggaaactgagaaacacatattttatctgtaacaaatgtggacatttccagtattttagcctgggtttttttcttcttcttcttctgcttctcatacttcctgtatgaggttagtttttttaaaatgataaacaaactattttttttttcaacttttttgggaggcctggttgtctagtgcctcctacctgtgttgttgtgagccttttgctggtgctctctacctgggcacagaggtcggtgtgagcagagcctgaaagtgggagtgggggatgtggtgttttgcatagggttgcagtgaggagggttgagctggtgaaaacacttctgttctcctatttgagagagatgcagcagaattcatggctgtcgtgttctgtgcaggcaaaatgagctgaaggatggaaggcaagggggataggagcaggggtggagcatggctagaagagacatttgatgtttagggagagaacactggtgcagattgaatatcccacagtgctcagtcccacgctgtgcagatgagcaacatctggaaaagaagattaagggatgaagcatgccaacatttctccccaggtcaccccaaaaatgagttgaaaattctggatggcttctgagctgcttgctctttccgcccccagtcgggatctcaggagagagcgtccggcaagtagcttgggtacagttgactaagtgtgaacatcagtagccagccgcatagccaacctgcagtcacccatggccctgcatacaagagtgtcactaggagcagatatcacttgccactggtggttgtgtgtatctgaatcacctgggcactgtgaaacacacattcctaggccccagccccagggtttccttcttagaatatgtgaggtgaggccggagaatttgcatttctaacaactctcaggtaatgagatgctgccagtgctgagactcccattgagaactgcagcctagagccagggtgctggaaatgcctaaaaaccgtgtctactggagtctgcaagttgtctccacttttttcctaatgtccctttgtgtgtcctaccacagacttaaaatccacaccagcctctcagaaggccttttgcatttctcagtaactgcacagcaaggttacctgtcatcttggccttttaccatgtccatcagactataaaatggctaaaatgtttttgaggtttggttctctgaaaaatgggttgtattttacagatagtgaaagggtcaagctgtagtgtatggtatcactagactaggaaacaatctaccaagggccaacccttgggttgctgccccttgacaatttccgcctttattataaactaagggagctgtcataggttcttccctatatagagcactcttgacgtaagtgacaccatcttagaaaaagactccatcttacatgtcaaaaggcatcatgccaacagggaacagatggccacctaatcaataaagaccacacccaaccagacagggacatcaccagccctcttctactatcagtccttgccagaggtctcagggctataagaagagcaggatttcaccggcttgagatggtcgtcttaacagagccttgctctgttgttgctcgtgatcagcacctggcatctgctgccaaagactctgcccacatcagagactcttgatgtctgtccggaacaggccaggacactctcatccacgttgctctcattggattggctcattaaccctttcttctatccccttctcactctttttttttcaaagccacacttatgctctgttatcccctttctctcgatgttaaatgttactgttccatgtggaatgtttaatatagcatttatatattgattaagttaaggacactgctgtgtatggtttgcaatattgactgacttgcagagtggcttgagcctgagtgctcacagctctgactaccagttgaacaggacgtactaaggagaatcacttccttgggaactccatgtaacttgtggcttttgtgattgaaatagcatcagtaaaagtctgaccctgtggaaagacacaaatgtgcgtggacctggctatgtctgactttgtgctgctcaggacactctctgtaaccaaaagtgagagagcctggaagacctcagggggtcagatgtttgaaggagctgctgagtatcctggcaggcagcagagcctcaccatcagtttgctgcatggaaggctgtgtgcctctatttccctgctatttgttgaactcccttgagctccggtccttcctaagtgagagagatgataccaatagcaccaacctgagagggctggggagatgtttgaaggaaagcttggctggggagctgtagctggcctgtggtacatgcttggtaactggtggccaggagacccgggtgtgtgtcctgggactgtcacactctgctgacgagggtattgaaagtccccactcaaagacacagaatcttcctgaccaagtgtaggtctgtaatgacgtgtggagcactttgcagaaactgcttctcagcgggggtccccttgaaaaggtgctaagtctgctcagagatacgtggctgaagctctagacgcgggagcctctgtcagagacaagggcagggggactcaagtgctgctgcctggctcccctgccctgacagctctagcagcacacgagtctgatttatacaaagaacccatctcatatctccctaaaattagtctgtgataagcaatatacatttcctgagtgtgcggtctaggttttaatattctgaaaaataaaaacagtggtctcttgagagctgaacagtttggtagttactgagcaggctccatcctccttggcaattcttttgaaatctcaaaaagttggcttcctatactgttagaatctgatgtgagtcaagaatggacaggctgtgagttcctcactcgtcccttttctatgcattgaggaagacctcggtgctgccaatggggcagaggaagctcaagtgtgtttttgcatgaggctggctggaagctctggcttgggctctcagcagtgaggtactggcagttccttggatgtcacagcaaatcgaagctcgtggtcttcacttcctcctaccttgagacttactgcgcagaaagtagaggcttggatggttcaacttcaggggcaaaacagcctgccttgggggtgggactgggggtatgcatctgtgccactgcttctctccctttgtcagtttaccatgccagcagccttctgtctgttatcgggaacagaaagagcacgatttgggagctagctggggagcttcccgaaggttgcctgagctgcatttggggcccctgatgagggcttctattcagggtgatgtgtgtgaccctgaggccatctctcagatctggggggaagtgaggttgtgtacccacagtggggagacctacctggcggctcatcaatattagacacctgcaggaacagcaggtcagccaagccaaagagtaagagtggccctgtctgtgactagacgcttcttcagggttgcctcaacaccggagtggcgctggtggtctccacccactcccagtgtacgctggcgtctaggaagccatgtgtgtgatcggccctgaattaggggcaaaacttttagttctcagatgaactgtcgtgggtttattcagtgataactagacagccaggccaacatggagttgattcatccatgcaaaacctcccagacaaggcctttcagtggagaactggaattcagggtcttctcagctttggccagaagccaaaggtaggagaggtaggagagacccaggtcctggtcccagctgtgtcccatccagagtgaccttgggaaggttgccaacttcctttttcggtgagccttgctttcttcacctgcaaggtgaagggttggttggatgatccgtaagggccggccacctctcactctgtgactttggcccaaggtccacatggttgggtgttccatactgtagccctcctgggctattacattttggtttttcattgcactcaaaagtgggggtaactggtgaggggcacgggttggtaaaccacctctctatttcagtgatgaaactaaagaaaccaggtttccccttccacccctacaggccactgatgcattacttagttcctgtttctctttgcccacccaggaagacactgcgtatgaaatcctgggcccagatgctggactttaagccacattagaaaatgctagctcataggactcaaaacgggaagctggctttcccaacagattcatctgggcagtgttcttcccagaatgtgtaggaatcatggggccaggttcgccaaggctcaggaagctcgatttttcactgtcactagccaatgaggcctttaaggaaaaaacagataagactgtaggagtttatatggatccgttaactcacttgtacaagacattgggaaagatactgggggtgggggggaaacaatacagagtttcaaaagataaatagagactgtcataatcaccacatgtcctggcagccagggctacggggtcaggagaagctttattccctggcctgcagcactgcaagagaccctaggaggaggagagctccgccaggccctgcaggctgggcagcctgcctttggccacatttcctaacaccactcagcagagccctgccagcaaaggtcattgtgcaaaaaatgttatgccccatatatgtttgggaagtgcacaataatttaaacagctttcttatttcttaacttctctgggtattttgtgtgctactgtatcttgtgaatgaatctcaagaggaaggatgaagcttttccaaaatcacatgccttcatctcattttacagaaaaatttgtgcctaatattaaccaaaggaaatggggagcggcagggccagtgggttttcatggtgaactgagggttgcatcttggacaggttgcatgtggaagggacagcagggttcccaaggaagctttgcacggtcatgggtagagccatcccttcttcatccatagtgaatatggctggaaatagcgggtagtcttggatttgacctccctcccatggaagtgctgtctccagctcgctcctggaaaaactgctttctccccaaagtgtgtctgagcagcagatttaagcatgaagttggttttgtggggctacagtatggactttgggaagatggtgccatctgtatttctgattctaccgtccctctgtctgtctttggaagtatcctttcacttgtttgggagactgagaatgattttctgcaaacagtgagccagaccatgctggtctcaagcggcagagcagttattaacagaatcacagtctttctggagctgctgtcagtcctgtgctgtcctcagggcctttgcttggtcaggggccccacttcttatccacccttccctctacctcaccgaggctgctaggcccaggtgtattgtgattatttgatgtacctgggaggccatgtctcccggggaggctcaggacctcattgggctggaattccacagggatctctcattgggtctctttgggcctttggagaggggagtgcagggcaccacctgggcgaacacctgtgccatcctgtaagtccttgtgtgactcttcatccaagtcaacaggggcatgtaggggaagagcctcagggcccatcaggagtcagaccctgaccaggaagtcagaactgaatcaacttttcaataaacacacaggctggccccaaacaaagcagcaggcttttgggaacatctgccttttcagtctcttctgaattctgtttatgtggacaccccatgtcccgcaccaccattgccgccagcaatgtttgttgcttgccaatatttgaatagatgctgataaatttgattctctggcttattgtggcattcatgatatgtctttcccttttcagtttccatgtactagagcgactgtcagtgtggttggcagtgacctgtgtttttcatgcatgtttttgtttcagaataactgggagatgaaacaggaagctctatgacacacttgatcgaatatgacagacaccgaaaatcacgactcagccccctccagcacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaacagaattgtttgcttattagctatctttaaacgctgtttgaaaggatatcgaatagtgtttgagggaaccctggcacgtccacacagctcatctgacatgtttaaatgtgtgttgggcttgactctctcataactcagccacgcttgccttgctgcttctcatacctctccagattgctgtagagtcagtgtgggcagactgacatttgagagaaacgtcgggcttcatctggaagcctctttccacacccaccctgatcgtggcctgtaaactgtggccccaagatctccattaaccttgggctttccactagagacatctgccatctctgctgcctccctcccctcacacatcctttactgcttcacttattcatcccataaggatttcttaggggcctgctgtgtgctggttctggagacaaaacagtggatgggaccaactcagccccggtccccacccagcacctctagccaagtctgagtgggctctgctgaagaagtgttgggtgcagtgcacagttcatcatggtcgatggctccatcccatttcacttagatgccccgatttcctaaatgctttcttgaactctgacactctgggactggcacctgaacagtctataaaacggtgaaatgtcgaagcattcctgctgtgtaatcccactctcttccccaacctcaagcaggacaatttgaccccctcctgaggacatggccagacaggccattagtagaagccttccagaactttctggcaatcttcacttttaagcttagcaaacatctaagaataattttaaatggccatgtttactcttttgtacttgttggaattagtttaccaataggccatgatggtgatcacaaaaccccctatgtacatgcacagtgttcattgcaatgcatatccaggtctcaacccaatgtccctttctcaaggagaattccctgagcaccatgtcgtgagagaaccctccttcctccccaccatttctctctatcttgtgattttattttattttattcatagacttatcattatcagcacttatcctgaatgttcaattatcatctgtctgtctctcactccactcccaaaaggcagactgtggtctgtcttatttcccggtctgtccccagcgtttgagatccgagcctcatcaacaactatgtgctgactgggttcatcctcttattacttctcaggcacaccgagatgctgagcagcccagtgctctgaccatgtttggtggataaggaaactgatctgagtctggtgaatggcctcactagggtgaggacccaggctttcctctgggacatcacccagcagaaaagggtgattgtgaactctctactgtctggacagtcaggttctcatcagaaaccaagctttgccctgctgatgaacttcctaaagtttatgtaatttgcccccatcctggaagataaagaccactgtgttgtggagggaaatagcctcagctgggcgtctctggatgctactttctccagcagaacactaagaagatcagatgagatgaacacaaagattccaccctgccctgagtttctgctggttctacctggctaggttctagcagaagagaaggaagtatacaagggtaacatgtgcaagggccgtgtacaagggtaacatgggcatcagggacagtcctcctgaggatgtgaggagccaggcccaactgtgggctggcaacctgccccaggggttgctcacactcacctaactccggcccctctggacacaccccttgcccaggtgcaaggggctccactgggaagaacatctccacccaagtgatcactcttcctctgcgtttttgagcaggatgaaaccacattctctacccatttcgcagtcttacccccaggattatttatgacctcaaaaagatggaagtcacaggtgcagggaggaccagacgtaacccatatgatgcctgcaggatagttagttcacaaggatattaggagaaagagcaaaagagaagtgaccacacaattctagatggttaaggcaatagttctgaccctggccagacattagaattacccagaggttataaaaaatccagacacccaggatccacttggaccaatcacatcagaatctggggattgagggggtgtagacatcagtattttttacaactctgcaggtaatttcaatgcatagccaagactgagaaacattggtctctcaacgtaccatccaatgtggtagctgttagccacagatatctatggaacctttaaaatgtggcttgtacaaccaagggactgaatttttaaattcctttttattttaaatttaaatatccacatgtgacttgtggctgccatattggactgtgcaggtacagaacatgtctacggtcacaggaagttctactggctagtgtggtccaggggaacctggagtcctataactgccgagtgaaatcctgctgatcctgaagggactttaaggtaattctgtctgttaacttcactaacaagccctcctgtcttgggtttgctgtatatttttcatctatgtttcaagccagggcttgtgcagcagcaagggtgacaaactttcaaagcactgcactgtaggattgaaaagcattgaaaatacagttatgcactcactaatgtctcagtcaacaatggactgcatatacaatagtggtcccataagattataatggagctgaaaaattcctatcacctagtgatgttgcaactgtcataatgttgtagcacaatgcattatcttttctgtgtgaagacatgtttagatgcacatattcttaccgttgtgttacaattgcctacagtatttagtgcactgaaatgccgtacaagtgtgtagcctagaagcaataggccataccatatagcctaggcaggtagtaggctatgccatctaggattgtgtaagtataccctgtgatattcgcatcacaaagaaattgcctaacgatgcatttctcagactgtatccctctcattagcaatgcatgattgtatctgtaaaaatctaaggcccagacctcagtcttttggtgttcattctgctggtttactcagtttgcatcgttgaagacccagtcctagaaaggagctttctaaattattgtttaattagtgtaatccaagaatttatgagacttttggaaaagcagagcgctagaagtgccacctttcggaggtcacggatttagtcaggtgacccagcaaactccactcgttggggttagagatggagaattagaaccaaagctgaatcactttctgcttatcactcatagactgccagattttcttttttttgttggagggaaagcaccttacaacaaataataatactattttgaatttcagagctttccctttttcaaagcactttaccacctatgacttattttgtcctcctaacaaggccataagataaggaagggagggctttttagagcctgtctaacaccctaagacagagcttaatattgctgaaggcattgaaaagtataggttttgttctctcatccctggccacactcaagtacttagtggcacaacttgaagcaaattgacatagatgtttaatcctacagtggactgtgtttttaatagacactagagcttcacatttgttccctttggttccatcccaggtttctaaccttgtgcctaaatttttgggggccctttcttcctcagagctttgtgtgatctgcaaatttggtaaatatgccttcatttaccatgtctctttccaaggtgggtttcaccatgttggccaggatggtcttgatctcttgacctcgtgatccacccgcctcagcctcccaaagtgctaggattataggcgtgagccaccgcacccaacctccaaggtgttttttaaatggtgaatgggacagaacgcaggacagagtcccatggctctccatgaagaaagtcctgtgtcacttcaaaggatgtcccctgtgcagaaccaaccacgctaggctgacatcctcacttttgggtccccaaccttctcatgggtagagctgcagagagtcatttcaaaccacacttgcctgtgggcagaaagcacggaattgtctgtccaactagggactcaggagcagcctggctgtctgcagcagctgcaaagggagcaaaggcaagcaggacttccatgagctaggaggtggccttctttggagatgagtgtcctgccaattgcaagtcctcctggtcacaccatcatctggcccatcttttgtatcttagatcggatagggtgagaggttttcaaaggctttactgaaatcaagacacactttctggggcattcccctaatcgactgttctggtgaagctcgtcaaaacaggaaatgaggttagcatggagtgactttctcttagagaacttatgttgcttccttgagaccaccaatttcttcccaaaagcttgtgagccttatttcgtgtctcttttgggttttcttggaacttggaggaagtctgttcttctgtagtttttagaatccattcctctggaaaatggtggtggtgtttgcttattcccagctttccagactctctccctttttctccagtatctctaagatgtttgcaagtttgtctgaagtgagatctgcacatacttgaactacagcaagaatgggattgacccacatgctctgtgcccacgaccaggctgacagggccgcatgtgggctctctggcatgggctttaggcagctccttcccctgagaagctgttggatccacatgttctcacggtatcaaaaatggcaggaagagaaaactaacctggtggagatgaaacttagtgggaacactccgctttcctcccctgctccgtgtgtgagcacttggctcagaaatgcactgtggctgagacagccctatctggcttcacctaagcctacccccgtgttgagttctttaacttagttatcaaagcggcaagggtttcagatctagacaagctgcatcatgcttatttttgctgaggttttctgacaaatggctctacttgaaatttccagatttaaatgtctgttttattaaaactaaagtacttttgagtcatatttgcttttatgtagtagaagcaagtagaagagagtccatgggaaggaatagctggctttgcctcacaggtgtttagggaggactgctgtctccaatgcaagacctggattaccgtttagagatccacctacccctcatgatgctcttgttgctggaatcatggtctgtttcatgctttacgtgacttagcaggaccttgaaagctgtcctgagtgcccatgctggaatggggtagatttcagttccctctccctcactcccgcatgaacctcagcctcactctactcaggtctagggtacttagtgtgttcagtgatgattgtctacatagatggattaatacatatgcacctttataatcatcccagctaccatctaaggttctagctttctctggagacatttttggtggtttacaatgttattttccagtgcgcatagcaggccccagaggcaaggtgatcacccctttgtttcagttaagaaaactgagttttagtgaggacaatcaatttttcccatatcacaaaactggtcatgtgatgctgcatcccatatttaagtccagagcagtgagcttctccctatccctctattatgctgccattttgtattttgtaggtgtgtaaaatcaaatgtcattcttccttaaaaaggactgtgaatggtaagcaacagttgggaagggtgacaccagacaatggctgaaaacagggcgactggaagttgactgatgggtgctgagcacttggcatcccttcctgctgcagaccccactggaatctcctcagaaggggacactggtggcttccattggccctgcctcccgccagggctgtgtgaggatccacatgggctgggatgagggtggatgttgttctctgaaaactgtccactactcaaaagtgatgttgtggccgggcacggtggctcacaactataatcccagcactttgggaggctgaggccggtggatcacgaggtcaggagttcaagaccagcctggccaacatggtgaaaccctgtctctactaaagatacaaaaaattagccaggcgtggtggtgtgtgcctgtaatcccagctacttgggaggctaaggcaggagaatcacttgaacccaggaggtggaggttgcagtgagccgagattatgccattgcactccagcctgggtgacaggggagactccatctcaaaaaaatttaaataaataaataaataaatagatgttgctgggtcaaaaagggagaggccccaccctggccccctagcaccagaatctgcatttcagcaagatcccagggggctgtcacagttgctagctctgctctttatgcttgcctcagctaggtgctgagtacctgctagaggtgtgaattcggtctttattcttcagaggcactggtcagagggtggaaacatcagacagggactcctgggcccccaggcaggactccatggggatggagcgggggatggaacatttgagaatcaccaacatgcagcaaggacattagtgagaaatgagttccacctgccagaagggaagctgagaagggaatgcacaaatcaggaaaatataccatcaaaaactacgactcttctacctccagccctcgccaccaattcctatcccattattttatatccgagagggttgataggcagcagacacactgattctgtaagcattgtccctagtccctgtaggcgaggtgaccatgtacccaagttcactcaaggtggtcctgtccatgcctattagaaatgagttcataattcctttcagctccgcctttcactctcgagcgtgcccttgcttgacgattcctatctggcttggataccctcacttatattaccttatatctgctattatatttccccaagaagttgctttacaaacactgactcctcaacacacggtcatctctaaaagaaagggtgtttggcagttcctcgacagttctggaaaggctgccttactagaagcagagtcagccatgggggggtgagaacgaaagtgtgcactcaagcatgtgtgtttggggtgtgtgggtatgggtgtgagacatggtcttatgggttctgtgtacctgcatgtgtgacacaggtgtgggtgcagaagaggacacggggtgtctggtgcatgggtgcctgtatgcacgtggggtggttgcgtgcatctgtgagtgcacatctatggtatgtgtgtatgcttgtgcatacatgcctgtgtgtttgcatgtgtggtgtggtatggtgtgcgggaatgcatgggcggatataagtgtgggtgtcttagtggatgtgtgcatggatgtagtatgtgatgtggctggatgtgggtatgacgtgtgcagtatgagagtagggttctgtagcacgtgtgtgtatgcagtatgtatgtttgtggtacatgtgcattgtgtgtggctgggggtgggttgcatatgttgcatatggagtgaggtgtttgtgatgtgtgtgggtgtgtgcggtgggtatatgctggtacctgtgtgcatgtgtgttggtgtgtggagtggctataggtgacatgtgatgccatgtgtgcttcctgagcttgtttgtggttgttcccagacccactgcagactcaagcatggctccacatggcaccaccacaggataagcctctgtgtgtatgcagtatgtatgtttgtggtatgtctgtgccttgggagctggtggggaggagggtctcacccttgtctgtccctgggcatccactatggctgcactgggaagccactgggtgcaatggtgttgctgtgtgggacggggcctcaggcccacaggcagcaagcatagaccagatccacccagcaccctgactgttgaggatgggccctggctgtgtctctctagcccagctagctcctactgcatagtcaggctttgggaggcaggaatctctgaatggatttccttcctcctgccctgcttggataggggcacttgtggatgcttctggctccaacttttgtgtgcagtgactatgatggagaagcaatgagctccctctacagccttctgggctgctggcatccccagtatgtttctccctggagacactctcagtgaggccaattccaggctgctgggggcttttccttctgtcactgtcgggcctccgcagggatctgcctggctgcaagatgctgatgggtggaggggtggcccacctggcctccagaagcaggagctccctgcccactgcccgcatggccctcagccctggccctcacctgttgcccctctggaagaacgttgctcttgttagctaacaaccacctgactttcctcgatctgtctctccctgaggcaagaatgacctaggtctgaagactgaagaccagtgctggggcccctcttggaaggccaaggaagtggagaagtgcccaggtctggtctgcttagcctcctgctagttgttggagctctttgagccttggtttccaaagccataaactgggagaatgacacctaccccagcagcacagagggatctttgcaataatgtgcaaacccactcagcatgatgcgtggcacaaagcacaaacccaataaatggtggctattatcactattattttatttcatagattcaaatattgagaatgaaataaatatatcagaaagtagtagcatcgtgccatcagaaaaatactctgatggggtcctagcgatcttatccatgaaaataaaatatcaaaagaaagacaagacgatctagaaagaagggatgccggcagtcttagaaaaaacaaataaacaaaaacaaacaaacaacaaaaaacaaaactggtggcagagagtgagacaacaggagcaaatatagggccagccagacaggcactgcttcctctccctttgacaggcaggacagcggcccgctcccaaatctgcagggtcagacgtggtagatgaacagtgatttgcctgagtgtaaatattgtgatgtctttcttttcttgaacttttaaccttgctggtaaacagggtgcatccagaattgtttttctgagaactgagttttgaggaaataggggggaaaagggtttttattagctaattttcagtcttgtgcgtgactcaaaaccttcttattctgtttcttaactttgcttcaggagacacttggccaaaaaatagctttgtttttaattgatgaaagaaaaatcattacaatgtgtaagtatgccaattcaaacatggcaaaactttcaaagacaaagcaggggtggggaggtcattctgaagaagatttctgagacaagaaaaacaaccaatccaaatccccatttgtgttttctaatgagaaactcctcacacgccattgccctgctgaccccggtcttaccttgaccacctcgccccatcttcatctgttataacttctgagatattgtaatggaagtatagagtaagcctgagatacactctcagcattcaaggtgctgccttcctttctccaggcaggaggctgacacagccgcctttatttacaaatgccgtaaattgactgcaggatcctttcgtgagaaaggagaataacggcagggaaccatcccagcaaaatgaagttctgggctccaccgccagcttttccctcgaaggtcatatttcacctctgccctgtaatttcatgaattgttcaatgaagatgtgacttattggcttccaagcttcatggaggtgttgtccaaatacaaggtccataaagtgctttggaaggcttggaggaacaaagaaacactcttgatctgaggttgtgatggagtctcctcaacattgtagccgatgatggcgagtgctggagggttcatcagacctgacagcaaccccagccttcaaaccactctctcccctcactattcatacctgcatttgtgtctgttcagttgaatgctggcagaccgtctttcaaataatgctccagttggaaagtaaactgagtacattgagaataaatatctccagtcttctaagctatacggcagtgttgctgggacctgtaagaaagtttctctctgccatcttagaagaaggaggaagaggagaaggaagcaggaaaatggaacaaattgccgtacctttgtaaaagatgagattgaaataaatcacaaagagtgttaaaacaggcagcttgcgggaagccaattgctaacattctcaggccccatcctttcctcctcctcttcctttcagaataaattaaagaatgggcccaagtccaagttgtgtgtatggtatctttatctgattgacctcgtactcctaataatatcttatcttcgcttgtaaatcattagcacccttttccgttctcccggcatgttacttctttaaatgtgatgaacactcacaggagtccgctctgcagacagacaaagctactgcaaggatcctctgtcattcatttggcgatttggtcccgaaggcctcagctggctttactagcaaagtgtttcacaaattcccatagccctgcaaacagccactcccccaaagcaaacaacctgagacatcaggtaaacactgaagaatggaaatttcattcattttcctgcctgcatcctctctagttgacagagaatgtcagtcaatgcaagatttgttgagagtggtacatttgaggatttatttgtaggctgtgttaatatactttcgagaaattcagttgtatctaattaatgcttttttccctttgattcattccaaactatttaaattggaaaattgtgtgctatttgaagatgcacttcaaaactccttttgttgtcatggtgcctgttgtcactgctttttgttggttggttcttgtttctatagggcccctcctctttgggatcgtgtgggtacagatgagactcacagttccctagccagatgatctatagaagtttttcaaagactgcataggtagtgttactgaacatagttcatatgtggtgtgtgtttctaaccttgcaagctccttgcaaaactacataaatacttgtatttaagttgtgctgtgcatatgaacataccttattatgagaaaggtagattttaaagtattccttccatgggtaaataagtcttccctgatgataaatcattacagttgctttcacctcccaaactcctttagctctcctctcccattcagcccctgtagaaaagggctccctttatttactgccccacttgttgcaagttgggggctatttctttaagtctaacttaatattccttgtatttagttcaaactgaaaaattctcatgtgtaaccgccgggcagggcagagggaagtagtgtctactttaaatctgttgcagcacatgaacttaaatgacaaaacaaacacagaagactgaaaagtcagagaccctcttaaagaaaagcttacaaaattatagtgtccactctaggcaggactttcatatcctttatctaactgtcacatgatggggtgacatgttgatccccccacagcctggatgatagaaatatttgtggtttgatatgcgtcagcgcttatgactttggcataaaatacaatctcctttgtttcttccccaaattcaagaagtgcatctttccataatattgagaatagaacctaacatttattgaaaatctactagcatattttgtctttaaaaaaaaaaaaaagcacttccacatactcagcaatggcccagtgaggcagataatagcttcatcccatctcacaatggtgaaataaagatcagagggagccagtaacttacccaaaatgactcccttaggaggtggcagagcccatactcaaagtcagtttgtttaaccaaactgcttaaaatgtcaacttagtttgcaaaacagccctatgtggttggtggtattatctgcaattcatcaccaacacactaggcccagggcaaagctaaaagcaaagctaaaaacaaagctaacagccagagtgaccagaactgggtctcacctctgctacacctgtgccagggagaggagatgaacactctaaagtgctttcatgcacttgggggccttcctgtccaagtgcagtataaatgttctttgtgccacatcttaaaggaatcctcttacagaaagggcttcccatctgagtggcaagacccaaggctaggctgatgcctcttcctttgctatgtgagacctgaaggcaaagtctgcctggactgacagagatggatgtggcctccatctgtctgtgtgtcatgacagaaaggaggtgggaaaacttggaaaatgggaaccctcactttcctgaaattcccagcaatcagttccaagaattgtaaccttgaagcacaggaaagcaagaccctcagccgggaacatgaaagcttttgtcgggaattctttgaggtcctgatgaggtgacacagtgaccagatgttccagattcaacatcaaggccggtgggggtggcactgcaccggtcacgtcaggaagagcagtgtagtcagagagcgtggcaaccaccattcgcctggtagacagctcattccatctgccttgcatattttccgctgagctcagaatggagaagatcgaatacagtctgctcttatcaccctgaagacttttaaaaaggctctgcatactcacacaaaaatcgggaacttgatcactgtggcctgacaatgtgttttgaaaaggcgggggttgggggcggtcagtctttccctgaaagttcccatccattgttgagtaaacatcataaatctatcgcagagagacaggctgcctgtactcaaattaccgcctgctacaattttagcttcaagttttaatgccctaaacatgaataacgtcgtatcccagcacaggtctgattaatgaggcaactttgccaacttcagggtcggagagtggctccccacctccttccttttttccccctgtggcttagtaaccatttcagcaaatttcctcattaaatatacaaggcgactgagtgcaataaaaactaaaggatgtggcagataaacaccagcgtctctctgagcagacctcgctgcccaacagagcaggccagctcaggtttgctgggaggaatccagaatgttccatcatgaattccagcataaaaatcatgcacgcattgccctttgccatgggtcattttcagtctgtgggttacacttacaggaccgtctgctttccgagctgtcacatggtttatacatggaatgccactcatgccctacttgcacgtaaggtgaccaatggctggctgaaggtcacactcaggagatgacccaaattagcacgtaatgtccaaccttgaaaggaaagagggaagttttatcttgcccagatattgtctgttccccaaataagattgtgtgtcgcttgagtaattcccgaataggagcccgtttgttgagcacttaatgcaccctgggcactgaagaagaaatgcggaggagtccccaggacttgctgagtctcctagagacagcagaggtgctctgctcacaggagctcattttctgcccacaacaaccctgtgccatcagctacattatctccaggtttctcatacaaccaaagctgaggcttatagggtggcacaacttcccctgctctggctccgaattcaatattcctaagccataaagcatttctctttcctccccatcctgttcccattcccagtctctccatgaacacacacacacacacacacacacacacacacccttgtctacacttgagctgtagtctgggcccgttacatcaacaacacaaccacggcagaacgtggattggtccaaattgcagagattttaaatctaaatttcccatgctattgagactttacagaaccagtccttcaggtgagttttgattttctgtttaagccagggttcagcaaacattttttctaaagaccagagagtaaacattttaggctttgctgggctgcatggtctctatcacaatggctcaactctgccattgtagcatgaagcagccaccggtaatacatagaggaatggcagaaggtgtgttttaatacaactttatttttaaaaacaggcagagggccagatttggcctacgggccatagtttgagaccccatagtttgagatctaagtcatcactaaaagtgttatcagtaattgagggttttagacattgcatctgtctaacctatcagaagtaagattgggggccagggccattgcagtgaggctgtggaagttcacagctgcttaagaagcactgtgaccaacatcgctccttaccccagatgggccaggccagcagtcacaacatgtgctccatggggagacagcaataggcatttcgctagaaaagaattctctggactagtaagtttagaaaaccttgggctattattatcgttattattatattattccatgactgcaggacttctcagggctttcataatgctgatgaacatgaatcttcctagatattctggatctctaggaagggaaggtttgtgtgcagagcatgtctgcacgatattctttgggaagactgcgctggctcccgtcctagagattctcatgctgtcttttctttctacctgttttcccaactgttcccacttgagagtactggcctgagttgctgccaaccttacaatatccagctccgtcctcagagccacactgcggtcccactggggactttggtggccctgcctccctgcaaccccaggtactcagtttggagggtgtggagagggcagggttgaaatgcaggctgctgtgtctctttccttcaattttatcaccagctgctgaccatgcttgcttaaaggtctggtatttatggtctcctagaatctcccagaacctcacaaatacccccgggctcctggtttgagggactagatgggaagcccccctccctgggagaacacaggcctagagcttcctggaacttaggcagcttggtcagagagtgtgaggactctgacaggagcacgggtgtgggacattcatgcctggaaggccctcgacacctgagacctcggtgtggaggcgggacttggaggaaaggagtccctgctatagtggaaaaaccagccagggtaggtagttttgtataagactcttaactctgtggagacttctgttcattatctgcaaaatagaaatgtgtatcccagcagcctaggcttagattgtggaggactagctgaggggtgtgtgagaaagttttgcaaacatggctgggcacagaaggctgagctattgtctggaggaaaactctcagggcaattcagacctttctgggcccttctgaggcaagaggcattgaggcaaagtttgagatttgacttcagggacactgttctctaagcatatgcttcagtcacgagcgctgaacccactctcaaaagctaagtagtagcaatgaaatgcttaaaaagttcgacccagactgcaaagacccacagaaaatagagcacagtggctggcttggggagggaccctcggtccagacagcagccaaggagttcttgagccttatttatcacgttgtagtattttacaaggagggctatgcattatttctctaattgaacgttacttttaaaaacagacaaagagaatcaggaaaaatgatgtgaggactttaggcccagatcagtttccgtttcaacaagatgtgtcaggatgatgaaaatgtcgtttggttgagccgtggtcatcaccccgcattgttgttctttcatgtgtttgtgtgtgtgtgtgtgtgtgtgtgtatgtgtttccctctgagtttcccagtagtcattactaaaaaaaaactcctaaactgactcaaaacaacaatgacaaaaacaaaagcaaacaaaaagacccaatcaccacaggcgccattcaggccctcttgtctgacggtgttcacagactgtgcttgtgtttttggatgtacccgcttccttttctctcttactcaccagatatcactgggaatccctccttcttgctccaggaccctaaaggagacactggggtaagactcatgtgggtcttggggcagcccatttccaggagagcatgacccccaccccccaagccccaggaggacggacccttcccagctgaggtctcctctgcatccggaccagggccctgggcctgaagccaggttttagtgaaggccttttgtgggtgcctctcttgcccaggaaacacaaggtctttaagctaagcctgtttgtggggagagcaacccatttcttagagggactcaatccatagggaggacactagtccatcagggggcccttgtattttcatcctggaaagcacagtcccctgtttccttctgggacatgagaagttgcttctaatggttcatccccacaacctcacttccccatccttgatttgcaaatgggtccatagagaggtcccaggcagctacttgacccaggcagcgaaggtgagcgtgggtctcctcactgccatgagccaggcagaagagcaagcaaaacagctaagaaccagacaggccagagttcaggttgcagctctgaacctgactaagctgtgtgacccaaggcaactcacccaacctctctgagcctcagtttccccacttaaagtggaaacaagaccagcccctgcctcatggaattgtcatgaggaagagtgaagtggtgctcgtgcagagctggtgcccagggaaggggctccggtgccaggcctgacagctcgtcagggaagcctgctgccggccatcccagggagacagtgccagatcagagggaagctcagcaagccacttaaaagggaccttgactcattttgtggtaaccgaatgtgcagttcaggaagtgcttcgcaaaagcgaactgggctccagccgccccctcgtccccctgccctctgctcaggattcactgtgcgaggacccacctgacaccacctgatgcataccagcagcgtggatggcaggccccacgtgttctcaagcccaccaaaggctggtgggtgtcggctctcggaaagacagcctgacctcctggactgaaattccactcctctctttagtcgaggtgctcaatctccctgagcctctgtttcctcctctgtaactggcactaccgcatactagggccggtgcaaagcccttggcaactaggtatcatttaatccccacaagcagctctaaaggcaagtacgaaaccttgccatttaaggatggggaagctgagggcaccttgagttatgcaagggcacacgcagggtgagtcttggagctggaatttgaacctggggaatggcactcctgggccttccctcctaactcatagtatctacaacctggattgtagacctagctagtaggtcttgggggttcttccctcctaacccctggtatctagaacctggatcgtaaacctagctagtaggtcttggtggttcctcacatggatggaagagatgccaatttccattaaccatgcacactgctgcttggtgggcaggtgaggaagtggtctgagtgtggaggaagcccaggacaggaccctctttgcctccccgtgggatgtcctggctgccctgggaggatatgtgtggtgttctctacacccacctgaacctctagctccccagagcctctgactgcatgttctgagggcagtggcatcgggaacgcatgggcgcagtgtgcagagactggccgaggagagctgtaggggttacctattaaggaggcaggtcccagcaggtactagggactgaagagggtggagggagacccgaggggggaagaggctgccctcgtcattagcccagatccatcccacccacttcttcccatctccctgtacttgccccatagggattcccaaagagagggaagtagagggggagaggagtacatggacacaggagagcgagtgagcaccccaccccacaacagtgtcctgaggaaggcccctcttttgtcccctgcttcacaagccttgggaacggggaactctgcaggctgagcggcatccctgctgggaaatgagggcctgtcttagttcctcatttaaggcacccaccctcattcccaaggcagttaaaagccccaagttgcccaactcggtcagaggaagcctgtcccatcagtctcacacacccagaacttgattctctggcctccgagactgggcagggaccagctctgtgtccccgagcccacatgtagaggagggagccgcgaagctgatagcccaggaacatctattccccacttgtcattgtcaaactctgatgtcttctgggactaaatttgaaggacagtttttactgttgtaaccaaaaaagcaaaaggaagcaaacaattaacaggcccccttcttttcgggacttttttctttgtcagtagaaagccatctcagtaaacaagagctgttacgaaatgtacctcaccccacactatgcctgtaaagcatctcccttccccccgctgcacaacccattgtacaagaaatattgtgatagatacctttgggttgaggctggaacaaaatgagccatcaggaagcattccattttcagctggacttgtttctgcatcttttggaggatttctgcaaacccacagcccagtatggcatttcccatactctgtgataagaacctccaggataacgttggtggctcagggatcatctgagccttgagcagcttccattctgatctggatgtctctgatgtgtgcttgttcaagcaatcgatgagccagtcatgggccccagactcatgggaactgggggagtgcccaagtcaaccctgcttgcttttacagctttcctataaaagcttctccactctttgcctgggcaagcccatgcccagatctccagcacacactccagctgccagagggggtgggggggctccctcctgcgtctggaacctattcagccagcctgagattcagaagggcctacctgctggagctgagggtgggtgaacccacccacttggggctagcgaaagattgcatcttgtcccaaggctctgctggacctcggaggattcccaccattgtctttttgggatttgagggaggtgtttcagactgggagactgggagaatgtttcccagcaaaaggcagaggttggggttcctgggatgtggctccccacagaccaggaggctgacacagttcctctctctgtcttcctgcttttctcatgcaaacagcacccctttcccatggctgctctaacatccttggtagcttaacacaaaacacaaatgtattctctcacagttcccaaaggccagaagcctgaaatctgtttcaatgggctaaagtcaaggtttcggcagggctttggggagatcagcttccttgtctgttccggcttttagacatggccaacgttccttggcttgtggacccctcctccacttaaagtccatcactccagtgtctgccccatcgtcacatggctatcccttctttaaccttcttgcctccttcatataaggaccccagtggttacgttaagggcccactcagataatccaggactacctctctatctcaagatcttcaacttaatcacatctgcaaagtcccttttgccgtgtaaggtaacattctcaggttccagggatttgtggatgtctttgggagccattattcagactcagatagttatagttaagacctatgagacagtcttctacatccctgagtgatacttgaagcagcctagcaacaaaaaaagccacaaaactttgtcaggagagctgtttttggggccaccccacattgacccttacctctgcagcccctggtttcctctggcccctgcacttgtgtgataccttgagaaggggtggatccacatgccagcctacgcaggagcaagaggaccagtgctgcctctcctttcttggtacatgccagcatggtctgtggctgggatgctgctctctgagacttgggagcttacttgttcacctcagcaatgaactctgaccacattttgccattcctattctcaggcccctagcaatctcattcccaaactcgatgacccagtcttttgcatggctcagagaactgccagaactgttagcacctaggccctctgctggagttcacagatgcaaattctgttgcttgcactccaaatctgtgatgcaggattgtctgctatgtggaattaattcaggacttgaggaatccttgtagtgccaccttacaaatgggttggtgccttggaaacccagtcctggcatcaaggccttggcatctgtcaagcagaagtgtgcctggggtgtattggggggggggcagtgttggagccgatttcaccgatttctgtccctggctctctattgtgcaacaacaggctcttctattccttaagacggcagcattattgccaggtccttctatttgctcataaaactcccatttacacagcagtttgcaggacacatcaaatacaaaaatggatgtgaggtttagtacagggagaccacagccataatgaatcctggcagggtttttattttggttgcatctcagaagcactttgccaagcaatgtatatgtgttgaatgaatgaatgaataaatgaatgaatgaatgccggtggactgacatggccgtatagaactgtagtcacccttcagagagaagcctctgcaatgcacctgaaaagcaatgaccatctacatgttcttccttttcttgttactatgttttaccccaccaggatgcccactgaccagaaactaaacaaaaaaactcatgttcctgaattcatcttttacttgagggtaaaagcttggggtagtgaagtgaatgttggtgccatatcatgttcaagcattttggaattatatagctctaatttagacaacagcaacaacaaagaaaagagactccatcatcagaattgataggttagtaaatttacagatcactcaaagatgttaaaacaaaaaaacaaaaaactttctaaactctcggtgttcttgggaagtagcctgctgtcgttgggctagagataccaagaagagccaaggcagcagattgtggttgaaatttaacacggtgtgggggtggtaggctggcggcacaggggctgctgtcagagataacacacagcccggagaaccagggtgtagatcagtgcatcagagccctttccaacggtcaggagaggaggcagctgccctgggggcagggaggacctctgacccacaagtcctgacctactggcaggagaaccattcctggtttgcttgctgggtctgagacatttctggagatgtgggactttcagtgttaacacccaaatagccctggggaaactaggatggttgctcacccaagctccaacttgtctatagaattatctggctttgaaagaatgtcacgtgcttttatcttgaatctaaggtcactggcatgcccctctcatccactggttattcttgatggtaagggggcggggtgggtagggtgaggggagggtgaaggggaggttcctcctgccattccttcctggagaagagaccagggcctttccaggattttggactctgacatggaaggaaaacacttaaagaccttcaggatttcgtgagaataacaagattttattttaaccataaattgtaatatttgagaaaatgcagacatattgtttctcagagcccatactaagtcagtgtggaaaacagcctttctctggaggcaaaattgcactgattaacttgaattacaaagggagcattgcttaccttaagctaagacagctcaatgagacctgctgtagcatttttattacatgtgcaattgtgcacatgtaccctagaacttaaaagtattataataataataataggaacctgaaaatctagacgtggagtgcttgcggtctctggacactcaggtctctcctcttacctcctttcacctcctctcagagcccatcgctgacatttagttcctctagaaacacaagcatagctcagctgcatgtcagaagtgcaaaaatatttaactttaatttttttatgtatatgtctaaacttgtcttacacttaaggtccctgtattagtctgttttcacactgctaataaagacatacctgagaatgggtaatttataaaggataggggtttattggactcacagttccacatggctggggaggcctcacaatcatggcagaagacgaaggaagagcaaagggacttcttacatggcagcaggcaagaggcatgtacaggggaactccccttcataaaaccatcagatctcatgagacttattcactactacaagaatgccatggtgaaaacctgcccccaagattcagttacctcccactgggtccctcctatgacacatggggattatcacaattcaaggtgagatttgggtggggacacagaaccaaaccatatcagcccctttctattggtggcaacaaaatatttcattttactaactaaagattagtaatctctactgtattaaaacttacgttcattaaggttctaagtttctgatgccactcaaggattccccactcccctcctttcccaaaatgcagcccaggtgccaggagaagtgggtgtgtgtgccctgtggcatctggggagaaggggctggcctcccaaggaagaagagcttctccctcctggtctttaggtgccaccctcatggggtccctgcctaggtgtctatggctggggttgctcatgacctgttctcaccacaggcacagcattaaggtccgaggtgacttgtatgtgtccccagattggctgagaagtaattcattgtatgattatagcacagtttgtttagtcattcacctgctgatggccatttgggctatttccaattttgtagtacagtagtccccctcctatccacaggataggttccaagactccccagtagatgcctaaaactgtggacagtactgacccctatatacactgactgtggatagtattgacactatccgtggatttgataactgagagggctactaagtgacaaatgggtgggaagtgtatatggcgtggagacactggaaagagggagtatcactgtccctggtggaataaaacaggacatcacgagatttcatcatgatactgagaagaaggcacaatttaaaacttatgaattgtttacttctggaattttccatttaataattttggaccatgattaaccacaggtagcaaaaaccatggaaaacaaaactgtggaaaagcagggactactgtatcatgaataaagctggtaagaacaagtacaggtcattttgtggacaagtgtttttacttctctttggaaagtagaagtattgctaaaccatacataagtggatgtttaatgtataagtaactactaaataattttccaaagtggcgtatgttcccactaacaaagtatgagaattgcttcatgtcctcaccaacagtttgtgtctttaatctctataatttgagctgttctagtacatgggaaacggcatttagttctggttttaatttgcatttccccaattactcattatgttgactacctttgcaagtgcttattgaccatttgcaaagtgtctgttttaggccttttattagacctatctctaggctgttccaggcctatttttatatttggccatgtattttttattatggatttatagaaattcttcatgtatacttgatataagtcctttgccaaataaatatattgtgaatattttctcctagtctttggcttatctctttttcattttctttctttcaaagagaagaatttcatgaaaataaatttattactaaaataaatgtataattaatgtatgagtagtgttttttgtatcctaagaaatctttgcctaacccaaggtagcagagatcgtttatgctttcttccacaagttttatagttttaggcttttatttttaagtctatattgataaacctaaaagtgtgttacttaatttttgcatgaaaatttttaagatattatatggttgttgatttctaatacccacttagttagagaatacactttgcataacatgacatagacaacagggataagcaatgggcaattattttttaaagaaattagagaaagacaaagagagtagtcttttatggttacacacatattttacctatccatggttgttaacatcttggtatctgctttccattctcaatacccaagtttccatctgatgtcatttctcttcaacctgaagaactttctttcatatatcctggtgatgaattctctcagcttcacttaactgaaaatgtctatattaccttcattttttgaatgatatattttactggacatagaatttcagcatttattatttcgttaccacaaaattttgtcatctctgacctcattgcttctgataaaaaaaccgatatgatttatatcattggccccacacaggtaatgtgcctctggctgctcaagatttttctctttctcttaatttttcaacagtttgactgtgttgtgcatgtgtgtgtgagtgtgtgtgtgccctctgtgtgtgtgtgttcatcttctttggagtgttttgagatccttgggtttataagttagtgcttttcatcaaatataagacattttcaattacattttctctctattcctcttctgaaattataattacacatatgttaaactatgtgatattatgccagatgtcgctgatactcttttattaaaaaatattttctatatgttcttaagattggatagcgtatattgagctctctgccagttcactgaccttttcttctgttgcctccaatctaatgttaggcttatccactgaaattttcatttctgagttctagaagctctatttgtttttgttttttgttttaccccaagttgttgctattttcttctctgattttctatctgttccttcattattaaaatattttcctttatgtccttgaacatatttataatagctactcaaaaattcttgtctactaattccaacacctagagtaccttggagtttgttgctattaactttttttttctttcgagtatgagtcacttttttctgtttctttgcatgtttataagtttttattatatactgtgttttgtggataatagatttagagattctggattctattgttttcctttggcaacatcaatcagttaattatggaatgtcaccttaaagttgcagaaccttggttttatactctttagggtaggcctatttagatttttccttagtcttagggaggatctttaatcctgggggcatagttattactcttaggtatgaccccttcctaggattttagtgaaatgcccaagatgtttccaaacagctcttttggaaaaattgataggatttaaactccaaaatctgtctcccaatcattgagcaatgggcaattggttgaaatcattattcagctttaaaaactttagctctttccaggatttatccccctcaatttccagtcactctggcagccccaaactctgtcctctgacacctcaagcaataagatcacagctttctgcctggcggactagagagagcccttagataaaaacagggtaagcataggaagcacgggtgcagttccttatttcaaaggtcaaactccagtttctctctgccagtgctttcaatttttaaaaaatattttgttcagagtttataaatcttatctgcaggaggattgggccagtggaggatactccatcatcattaaaactagaacttcttctatacccactttatggttcttaaaatgtattccaaaattgaccttcacaaagattagacattctcactggcaagaaatgagagtccctgatatcctttccccttggcagccagaatttcttagaccaaattgcatagaatgccagaaccttagaaaacaccagacccagtacttcccagctcaaggctcctgaatcccaaaagcgtttatgagggtagcacagggtcaaatggcagcttctataaattataagcactatgtatttttccaagcataaaatatacagttattcataacacaaatcttaaatgtcattacttttggttggaattacatcatagttttcctgcagacataggttttctcttgctcatcagaagcactgctttatagttaagtacatttttggtcaacctcaaatggcaaggtgtattattattattgataagtgacatgtggcttttaggacataggaacctcagaaagaaagtttattagaagaattcttggtggccctgggcactttgaatagtaatgagtgtttctggttgatgaatttagatttaatcattggatctatctttgtttataagagctgctatagctttagcttcattatttgctgaggccccaagacatgaaagcacttgcctggagtgacacagactgacaccccttgtgggttcagagatcagaaactaagatcagactttgttctgaacacagcagcatttataactgtgaaggactaattctgatacctaccatgtttcagagacaaaatataaaagggtaaacttagagaagagcactttagagaggcatccagagagaatgttgatgattggatggacatgaccttttgaaatgcctgtgatttctgttccatttcttaccccggcaagaataaaccaattggaattcaggtgaatgaattttgattgagcacagattcatcatatcttgccaggtttgtcctttatttgtctccaatgctgatgcatctggattcacatcaactccatccactacacttacaaaggcaaatgcttccccaccttctgtaatcatggaggaaatgtatggtatagggcaagcacataggtggctttttctttataactcctgtaatatccaggccaatgttacatattccttaatatatatttactgcagcaaaatttagatttatttcaccatatttttccccagaaaagccagcatccccatttacagaagcaatcacagaaacatggagaaattcattacagtcttagtgcctcagaaggacataaatcaacttttaattacctctacctggagatgcttggtgcaatgtgctgtgtgtgtgagactgaatgtgtgtgtgtgtgtcggagattgagtgtgtgagtgtctgagaagtgtgtgagggtgtgaggtgggtgtatgtgagattgtgtgtgagagttagctacgcatctcctctgtctcctcagagccatttcttttctaattgtgctctcagacaaccagccagctaagcagggtctggcgagtctgagacattcatgctggggtttgcatgaagcttgtctccaggaatccaggacacagtttagatttgctcagacccgtctcagcagcctggagttaggatgaccagatcctttgaaaggtaaagaagctgctgcataggaaacagaaatgagtcaatttctgggaagttgctagagtttgaatatttgtcccctccaaaacatgtgttgaaatttaattctcggtatgtcagtattgagagacagtgcctttaacaggtaactgagtcatgaaggttcttcccttatgaatcacagggttatcataggagtgggactgatgtcttcataaaaaaggaagcgagacctgagctagcaggtgagcatgctcagcccccttgccatttgatgctctgtgctgcctcaggactctatagagagtccccaccagcaagacagccccactagatgtggcccctccaccttggatttcttggcctccagaagaaaataataaatgcctggtttcgagtgctctgttatatgccacagaaaaagacaggagtggagaggcttataacccccaggatggccacaggcttatatcccttttatcctcaggggtgaacccttgcctacctgtttttccatccagccaggccagcactgtagcagagggaaaacccaagggccccatatcctggcaatgcagccaggactagtgtccaaaaatatactgggaatggtgctgtgactacatgctgtgaatggaaacagcctgactgcagagggaggagtcaggaggggcttcccagaggacagggtggggtggggttcacccctagtgcagcctcagcaggagaatggggggttgttctctctccactgtgaacctggtgttcttcccttctctggggtctggctcttctactgagagaacaaggtgggcaacagaagtcaccaaaacctcctccagttgtgcaatgctaaccttgagagcagggccaggctgagacaaacacagaacccagcttcttgcagataagatgtgaaaagagtctgttactcattccaggtcctgtggcacttttagcagagatggatgtttccagctggggcttgccttagtttactagagacactgtaacaaaacaccttagactgggtaatttgtaggtaatagacatttatttctcagttttggaggctggaagtccaagatcaaggcgcaggcagatttggcgtctggtgagggcccactctgtacttcatagatggtgccccttgctgtgtcctcacaaggtggaaggggcaagcaagctctgctgcagctgttttataagggcactaatcccatctaggaggcctccaccctcatgacttaatcatctcctaaaggcccacctcttaatactattacactggtagttgtctcaacatatacatttcaaggggacacattcaggccttgcagggctttagatcccaccacttcatcttatcctctttcttgtcccttctcccttctcctgaagcttgaactgaaagatgcttgattttggcctctactttgtcctcattgccatttgtgacaaatgaagaaattctatgtatggtgaggacagcaccatggagccccttagactttagacttgtccatttggctctgtggatatgggttgtattttctctacttttctttgagctctccaaataaaaacagttgataatctgaatacattgaccatgtattctagaggtatacagaaacatgtgtggactctgaagccaaactttctggtttagtcctaacttcaacacatattagaagtatgacttgggcataaattatctgggtctcagttttctcgtctgttaaaaaagacagtgatacagccaggtgcggtggctcacgcctgtaatcccagcactttgggaggctgaggagggcagatcacttgaggtcaggagtttgagaccagcctggccaacatggcaaaaccccgtctctactaaaaatacaaaaattagcccggcgtggtggctggtgcctgtaatcccagatactctggaggctgaggtgggaggcggaggttgcagtgagctgagattgccgccactgcacccaagcctgggcgacagagcaagacttcatctcaaaaaaaaaaaagaaaagaaaagaaaagaaaagaaaaaaaagacagttatataatagcaaagacatggaatcaacttaaatgcccatcaatgatagactggacaaagaaaatgtggtacatatacaccatggaatactatgaagccataaaaagaatgagatcatttcctttgcaggcacatggatggagctagaggccctcgtccttagcaaactaatgcaggaacagaaaaccaagtatcacatgttcttacttacaagtgggaacaaaatgatgacaacatatggatacttagggggaacaacacatattggggtctgttgggtgagtaggggatggaaggagggagaagatcaggaaaaataactaatgggtactagtcttaatatctgggtgataaaataatctgtacaacaaacccccatgacataagtttacctatgtaacaaacctgcacatgtacccgtgaacttaaaataaaaatgaaaaaaaacagtgatagtacctacctcatagtattgttcttggaattatgttagccattatataattcttaaagagttcttggcatgtagaaagtactatgtaagtgacagccatcgttgcttttgtaatgattattttgcttcctttctttttgttcattgcacatttaaatttctaaaagagattccaatgtctttattattaaggtgagaggaaagcctgaatttaccttccccctcttcccagctctgcccctcacagcccccagacctttgctttgcttgctggacccaaagacacacaattcttgtccctgtgcctgggaaggggtgttgggattcagggcagatgtatttaccagactgtggtttgggcccctgtgttgtcttttaacttataaaatatctgtataattatttttcattactagccaccacattcctttgttataactgcttttttgaaaatgaatatatgcacattgtaaacaatttcaagtgaaaccgcctccccatcccttgtctgatggctagtctccctcccctgagggccgacgccactgcttgccaattttgacataaggcttgaaaccaatgagtgtccagtgactgggtgagtttggttcctcctacttgtcttggcaatctcaaacagttccaggagaagattgtttcttggagagtgggtggcaatgaaataatagcaatggtggtcaacctttattgagcaggaattgtctgccaggcacccttccaggagctttgcctgagggatctcgtgatctttgtgatgagctatcgaggcggctactgctgcgacctgggatggagatgcccaggtggaggcccagagaacggaagtgtccttctaaggcctaactaacagataggggacttccatctgctccaaggatatctagttccagagtccacactcttggaatctagaaaactccatcaggactaatttatgagcatcttagaaccactttccctgaaatttcctttctacaaacctaggaagggttttttctcccttcttcctagcaagttcttagctttttatggaataagaaaatgcacagagtggccttcatcctggacaggctcctttgatgtgagccacgaggcacctagggctgggtcatctgtggtctctgcaggtggccaccacgtgtccttgggcttccccatctgctccaggctttggtcttttaatttcaaaagcagggaaagagcaggctcacctgaaccttctccagagttctttctattactcagagtccatctagctaaacatgtttttaaaaatatttatttgcactggtgagcccatggccatggtggaagtggggacatgggtaagcaagagtccaccctgccccacggagctcacgttccgcaggagtggaacacacagcagccctgggcaaggcacctctggcctgtccctcacctgctttgcacctggttatgcttcccttactcccagtagcaagtgccccaggaaccccgtgggtgacctactcagtggtaggctgtgcctgcttgcaggagggaccagaaggctacctggggttacttctcaggcatgagccaagggtcacattataaaagctatgccagattccccatagatgatcctctatccaaaaattaggagctcttaagtcataagatgagtcaaatctacccccttagaactcaacatagctatgttcagttttactggaaaataagtcactggaaagcactttttatggttttctaaatctctcttatgcccaaagaagtggttcagccctggtctaaggcactgctcacttactctgattgccatcttcagcatcatcgtgatgatgataatgatgatgatgatgatgatgatataacaagatagtagcaataacaagagctgcctcctcccagttgtgaaattatgtttatggatatctggggctcactgttctctttaggaatgacccctgagggctcatggctcccagcccccagtaccgcaggtaaagcagtgaccctatctccagaaacgtgggtaccaccaccacagtcatagcttagatggggcaaagagtgctgactccagaagccgccatcatcaccgactgtgtcgaatttggaaatggggacagaaatgtacacatacccatgggctttgcagagaggccatcaaatcgactgtttctttttggttgtaaaaccctgaggatctctctgcatttcttcccttcccacccccattgtttaagcctcagtttctcctttgagctacctgggattctgatgggcaggattgctcggtaagcgctaagctctgtccacaactcagccattttgtgtctctggtttgctttggatggcagttttccccttatcctgcccagatttccagtatccaagcccgttattttcttatattcttctttatgacctgtatttttccaaagattgggaagcaaaaatgtcaaggtgatagatgcatatagataggtaaaaagatgacagtcagttttaatcctcattttgcttttctgtatttccaaaatttctacaaggaacatctattgtatttgtaataagaaaaatagtctaatgaggccgggcgcggtggctcacacctgtaatcacagcactttgggaggccgagggggcggatcacgaggtcaggagattgagaccatcctggctaacacggtgaaaccccgcctctactaaaaatacaaaaaaattagccaggcgtggtggtgggcgcctgtagtcccagctactcgggaggctgaggcaggagaatggcgtgaaccctggaggcagagcttgcagtgagctgagatcgcgccactgcactccagcctgggcaacagagcgagactccgtctcaaaaaaaaaaaaaaaaaaaaaaaagagaaaatagtctaatgaaaagcaagttggtgccttgaagttgagtgttttggttgaatgttggctaaggatccagtcccccagaggttagttaaaagcttttcctccagccctatgaccacaggggtaacaactcaactcctcaggccatgaaatttcagagggttatctttgtcctgagcctcagacttctgtggatccaacaagggaagggctgtccggcagtggagacttgacatctcactggctcccaatacttgcagctgcagtgtttcttgagcactactgtgtcacacacggcctgagtgcctgcccccatcttcagagaatggcacccgggtctggttggctcacctcactcaaagtggcaggaccgtctctactgcatgcattttctgtgtggtatgtttttctttctttggtagctcataaaatttccctatctgtgctgggcctcttggtctttaatcttcaacctctgctggagctgtccctatttctttttaattatgcctctttttttatggaagtttcctattaaatttttatgactatatagagctgtggatagactccaacaaaaatgaaatctttatggaatagtcatttctctccaggagcccctgatagatgttcctctgtggatagacacacatgtgtggtgggggtggggaaagtccctctggtcttggctgcagctgggcaggatgcgggagaggcagctgagctgcttattcctcagtgtgagggctgctgggagcgtggggtgcagctcagcttggggggtgggggtgacgtgggatgcagaggataagaagtaaatcttccctaggtgtaatttctttgccttggtgtctgctgaattagcactgctccctaatcccaagccatcaagctacatggctgcatatgagcggagacatgccccgttactccttattcagaaccttcatggccaggcacgttggctcatgcctgtaatcccatcactttgggaggccaagtggcagatcgcttgagcccaggagttcgagaccagcctgggcaacatagtgagacccttctctatataacataaaaatttaaaaaaaaaaaaaaaaggagaagaaaagaaaagaatctcctgcccaggtctgccagctgagcttgcaaaaatgttatccttggggctaacattctgtattagttcattttctcgctgctgataaagacatacctgaaactgggaacaaaaagaggtttaattggacttacagttccacatggctgtggaggcctcagaatcatggcaggagatgaagggcacttcttacatggcagcggcaagagaataatgaggaaaaagcaaaagtggaaacccctgataaacccatcagatctcgtgagacttataaactatcatgagaataacacaggaaagactggcccccgtgattcaattgcctcacccctgggtccctcccacaacacgtgggaattctgggagatacaattcaagttgagatttggatggggacacagccaaaccatatcacatcctaagtgactgtctggggtcactggaccctggcatgcttccccctgtgccagctaccagctatgtggtctgggaatggcttgggatccacagatagctctccaggggggtcacggaccagagttgctgttgcagggtgtgagtccccttgccagggagggaagggacagtcattcacttataaacagatgttgggactcacccaaattgagtgctgggcctagatcagggcaccagggatttctcattcttagtcccgtggagctgatgttcctgaaggaggaaatggagaaaactcaagaaagcttgtaaacgagtgaggtggttttagattgtggtgaatgctggggggcaaacggagatattaagagggctgccaagggaggaggagggaggggttctcatttcaacaatgttcagggaaggctgcctgctggggcgatcctggagctgggacaggatgatgaggggcttgcatactcagatcaggggcagagccttccaggcagcaggaccaacaagtgcaaaggccctgaggtggaatgagtttgtcaagttgagaaacttgtcaagatgagcgtggctgggacagtgtaagccatggggagagtggagagacaggaggctgggtcaggcatgggagatttttaatccttgctaacttactttaaatgtctaaagacaccattttgactgctggacaaagaatggactatggaattgcattaaagtccagaggtccagtttttggaaccaccaggaaggcaacacaatgcgcctactctcaaagggatttggggaatggaagaaggtggggttattgtttcatcaggctgcttggatttagacctgttttcttaagctgcaagatctcctacaaaactggatcctcacctaagtttggaggacaactgagaagtgatagttatgtttgcctccctgcagagaataaactctcaggagaggatggagcactgcagctcttacctatgaaagttgataaggaagggagtctccaatgtgagtgtggcaactgtctactcactggaaggaacagtgatacatatcataatagggaaggaaatgaacagcatccattatgtgatggcgtctatcccatgtgttaggtcctgtaactgacaacagccgccctgaaaagtattattgcatatgagactggagaccagagaggttaagtaaattgcccaagatcacatagctactaagaggcagagctggggtttggactcacgtcggcctgactccaatgcccttgcatctgtcactcgtgcccatagccctagtcaacacccacatgctaaaggcgtcagtggtcccctctaacaaaagctgttatggcttctcagagagactggagtccatggctgggagaggcaggggtaccctgggagaaccatgtgtcatcagggttctttccaggcccttccagccacccacccatgggcataaggcctaccccagctctgcaaggtttcaaaaaaacatgcttgacacttgaacaaaaattggctccaaaacataagaagaaagctgcaaaaccataattagtaatttagatcaataaagaataaggactataaagaagagagtaggggaagtagggaaaaaaaggaacatgatgtatttattaccattgaacaatacacttaaaatggtaaagatggtaaatcatatatgtatattttacctcaataaaaaagaattaaattaaaaaaataagcaaaacaaacgatcttattttaccttcatttatgctttctctgccctgcatctctgcctgatgctgaccccagtttctgactaataaggttttccttctgcctgaagagcttctgcaaagctgtccttaggacagatctactcgctaggaattccctcagtttttgtttgagaaaaatatttatttctgtctcacttttttaaaaattaagctttgttttgttttgttttactataattatctttttgtttgtttgtttgttttgagatacggtttgactctcccacccaggctgaagttcagtggctcaaacatggctcactgcagcctcaaccatctgggcttaagcaatcctcccaactcagcctctcaagttgctggaaccagaggcacacgccaatacatcatgctatttttttttttttacttttgtagaggtaatgtcttgctatgttgcccaggcttgtctcaaactcctgggctcaagcgatcctcctgccttggcctcccaaagtgctgggattacaggcgtgagccaccacgcccaggccaaaattaagcttttttatctggagatcattgtaaattattctgcagttttaggaaataaatcagaaaatatactgtgtgacctttatccagtttcccctaaagataacatcttatatgatagtataatagcactgccagaatattggcattgatatacttttacttgtcctcattgtgtgtatgtgcacacatgcatgtgtatttagttccatgcaatcttatcccacatgtagggtctgtgtatccatcaccacagggttcctcttgctgcctttttatagccatacctccttccatactcttctccttaacccctggcaaccaataatctgttcttcatttttataatgttgtcatttcaggaataatagactcgtggtgtgcatgtcttttttgctcagcacaattctctggagatttttccacactgttgggcacatcattatccaatgcccccttttcttgctgagtaggactctatggagtggatgctccacagtttatttaatcagtcaccgaccacacagagtgaggctggagagaatggcagatgagagaggggaggggtcgggacagggaaagaaaaccctctcagagatgtctcacgatatctgcagtaaaacctatactctcaaacaaaaactttcttggtggactcttttcttcttctgggaaaagaggcaacataaatggacgcagatcacctgccacatacacatgtgcatactgatatgtcccctcgtgtgctcatgtgtacacatttttgcacatgcatacacacacacacacacacagacatgcctgtgaagaggccaaccccagtgtgcagcagctgtgagggggctctgcccctcctctcctagaatggaacatacgttcttgtgaacatagagagtggcattttcttatgtcgatgtaatgtgaacaactcctggtcaccagcccccttgaccactgatgcctcttcatgggtcggtgagtgagggagacacagccatttattcctggcatcttgaattaaacttgaaattactgcccactagaaataaggcctggggcatagagtcttattattaaaatcttttgtggaaagtcacagggctccaatcaccccaaaaacattgtgtctatgggaaaatgcaccttgagttccatcttacaaatggatttgtaacagtttaggtttcatgtaagctgttcacagtatcctagtgatacatgtttatggtaaaaaatcttggagggtaaagaacaaacactgcccataattttttactgtatacacttttttttcttataaaaatgttactctattgcacatagtgttttgaatcatgccaatttttatttggcaattatataaaggcagaactttaaatatcacccccaacattctgtgcctatgcctcagagcctatgcttaaaaagagcaatcatattcatgactacgtatttaatgcaacattagaaaactaatgcagtcataacccacaagcgttttccatgccaatgacctttttgccatctggtttagtgactgcagagtatcccattacatggttgtctcacaccttggcaagcatcccttaaggatggacactaaatcatcatggggtttaatactctcatccacagaagagactcccaagccagtcctcacatatcttgctctcattactagggcagagggttctaagaattttcctcttatgggccaccaccagagcagaccagactcactgtttccatgcctgctggctcttgctgccaccatgccctgatttcaaataaccactccatccatgagctaactgaccttagaaagatatacttttaaaatgcatatcctcccaattttcaattaaggccaaaaggagtagtagagaccaaatatatcctctttcatgaaacaaacaaaaaatggcaaaaatatgtgaatctacgaaaagatactagaactcttaagtgaatttagaaaggatacaagctgttatatcaatatttaaaaagtcaatttcatttatatgattaacaatgaacaatcagaaagtgaaatagagagtgtcatttataatagtatcagaaatataaaatacttagaataaacctgacaaaggatggggaagacctgtatactgaaaactacaaagtattcctgagaggaattaaataaaacttaaataacataccacattcatgtgttcagtctgaattacaatgtctaaagttaaacatactgaccacaccaagtgttggtgtggatgtggaggaactggaactcttatatgttgctggtaagaatgcaacatggtacctccactttggagaacagataggcagtttcttaaaagttaaacatacatttactatattactcagccattccactcctaagtatttactcaagagaaatgaaagcatttgtccacacaaacattcttacatgattgttaataacagctttattttcaatcacttgaaactgaaaatgatccaaaggtatagcaacagataaatggactgtggcatatccatataatggagtactatcaagcaataagaagaaacagacagctgggcagtggctcacatctgtaataccagcactttgggaggttgaggcagatcacttgagctcaggagtttgagaccagtctgggcaacatggtgaaaccccatctctactaaaaatacaaaaaattacccaggtgtggtggcgcacacttgtaatcccagctactgggaaggctgaggcaggaaaattgcttgaacccaggaggtggaggtttcagtgagccgagatcacgccactgctctccagcccgggcaggcgacagagagagactgtgtctcaaaaaaaaaaaaaaaaaagagaaagaaagaaagaaaagaaaagaaaattagcagggtgtggaggtgcacacctgtagtcccagctactcaggaggccaaggtgggaggattacttgagcacaggaggtcaaggctgcaatgagttgtgattacattgctgcactccagcttgggtgacagagtgagactctgtctaaaaaagaaagaaaagaaagactattgatacgtgcaaggatatggatgaatctgagaacaattttgctgagcgaaagaaagcagaggaaaaaacatacaagcagcatgatttcatttacataaaatttttaaaaatgcaaactaacctatagtgacaaaaagcagaacaatgggaatttataatgttaaacacatatgtttattagaaaaaaaaagatctacagtcaatcattcaggtttccatcttaggaaactaaagaaagaggcctaatttaatttaagcctgaagcaaggaaaataagataagtaattaaaaattagaacagaaattaataaaattgtaaacaggaaaacagtagagaaaaatcataaaacaaaagctggttcttggaaaagatcaataaaattgataaacatttagtcaggccaatgaagagagaaaagacacaaattattaacattagaaacaaaagagaggtcatcacaactgatcccatagacatgaaaaggttaattaagtaatacaacaaacaactttatgctcataaatataattaaggtgaagtgcaacaattccttgaaagacacaaactattaaaaccccccaaagagagtagtcttatattcgaagagattgaataatttaaaaccttccagaaaagagagcactaggctcagatagtttcactggtactttcaacagaatacttaaagaggaaataataacaattctccacaatatcttccaaaaaatagaggcagaggcattgcttccaaactcattttatgaggccagttatcttagtctgtttaggctgctgtaacagaacaccacacaaactgggtggctcataaacaatagaaatttatttttcacaattctgaaggttgggaagtccatgagcaaggcactggcagatttggtatccagtgagggcctgctctctgcttcataaatggttccttctagctgtgtcctcacatggtggaggggatgaggagtctcccttaggcctctactataagggcatttaggtctcttctacaagggatcacccattcatgagggctccgccctcatgatctaattacttcccaaaggccccacttcttaatacaatcaccttggaagttagaattccaacatatgaatttgggggaacacaaacattcagaccatagcacagtatattaccctaacaccaaaacctgctaatgacattttaagaaaggaaaaactacagaccaatatctctcataatcatagatacaaaaaaatctttgaaaaaattattgaatcatattcagtaatattatataacataaccaagtgggattcattccatgtatacaaagctggtttgacattcaaaaatcaacgtaatttaccatatcaatgggctaaagaagataaatcacatgactatatcaactgctagagaaagtatttgaaaaaaatcaatacctatctacaataaaatctctcggcaaactagaaacagagggtatctcttcaacttgataaagaacatgcacaaaaagcctgcactaaacgtcatacttattggtgagaggctgggcattttccccctaaaatcaagaataaggcaaggatgtcctctctcaccactcctatcgaacatcatactggaagtcccagctacagcaataagaaaaagaattaaaagaaagatatacagactggacaaaaagaaacaaaaatggtctttattagtagatacactgtctatgtaggaaatgccaaataatctgtgcacacaaaaaaaggtgaaaacctcattggaaaaggtgagtataacaaggacacagcatacaaagaaaatataccaaagtcaattgctttcccatatacaatgaacaattagaattttaaatgaaatttacattaccatttacaatagcatccccccaaatcagtatttagttacaaatttgacacaatctatggaaactgtaggcaaaaagctagaaaatactggcaaaataaaataatctaaataaatggcaagatagtccctgcttatctgttggaagacttggtattgttaagatgtgaagtatttataacttgatcagagcagtccaattcaaaatcccagcaggttattttttagatattgataaactgattctaaaattaatataaacaagcagaaggcctagaatagctaacacaatactaaagaagatcaaagttggagtactcagagtccttcatttcaagaattactataaagctataataatcaagatggtgtggtattggcaaaaaaaggacacataaatcaacaaatggagatgccagaaatagacccccccacacaatataataacctgacttttgacagaagcgcaaaggcaactcaatggagcaagtgaagtcttttcaccaagtggtgctggaacaattggatgttcataggctaaatgaatctggacacagaacttgcaacttacacaaaaaataactctaaatggatcataaacctaaatttaaaatgcaaatttataaaacttttagaagaaaacataagaaaaaaatttatgtgaccttgggtttggtgaggaatttttagatacacgaccaaaagcatgaaccatgaaagaaaaaaaaatagagaagttggactttattaaaattaaaaacttctgctctacgaacaattctgttaagataatgaaaacacaagctgcagactgaaaagaaatatttgcaaaacatgaacctgataagaaacttgtatccaaaatattttaagaaatcttaaaagtcaacaaaaagaccataagtaatccaattgaaaaaatgaataaatctgaacagacacctccaaatcaccaccaaagatgatatttgtgtgtgtgtatacatatgacatatacatatgtacatatatgtatatatatatatcttacaaatgggaaataagcatgtgaaacatcatctgtcattaaagaaatgcaaatgaatacaacaatgagctttcaccacacacctattagaatggctagtatacaaaaaaccaacaataccaattgctatgagaatttagaagaataagaacccacatgcgtttctggtgggaaggcaaaatagtacagctactttaaaagatgtttggaagtttcttaaaaagttaaatattattttactgtatgaaccagcaagcatactcctagatgtttacccaactgattgaaaactacgtccacaaaatacctgcatgcaaatgtgtgtagcaacgttattcataaccaccaatatctggaaaaccaggatgtctttcagtaggtgaatagattaataaactgtagtacatgcatataaaggaatactattcagagatataaataaatgaactatcaggctatgtaaaaacatagataaaacttaaatggatattgtttactgaaaaaagcttatccatttatattatgttctagaaaaggtagaattatcgagatggtaaacggatcagtggtttccaggggcctgtagagatggaagagtagagtaggcaaagcacaagagatttttttttagaatggtaaaattattgtgtatgatactgtggtggtgaatacataacactgcatttttcaaaacccatggaattttacatcacaaagagtgaaccttaacatatgcaaattaaaaaaataattaaagatgttgggggattccaagatgggatgctgagtatgacagaagactaactgtattacaaatgtataaaataattccactgaaggggtgggaggaaagcgtgctgaccaagtggcattggaagtgagtggagactgtaagactaaaaacataaggaactgtccacaaccctgtattctagtagataaagctctttcccaaaaggatataaattctgaagccactagtcacacactctgaaatgtgaagtcactggatggaggatggtgggagccaggtttatctttgttggaggggaggctaccaacaagcaagcaggaaaggttgcagtgattcatatggcagtggttagtgttggggacatcaacgtggaatcgagttcagctcaaaatagatgcagacggatatgtacaatacacttacagatatgggttggtatatatttccttgttctgtctcctgacagggcctgaataagtgtcatcccagtagcaatgagcacacctactgtttacgtcttagtttttgatgctgttcttttttttttctttgtaacatttaataagctcaatctacatccagaataatttacatgaaaggacaatatttatttaaacagagctcagtggggtagccatggtatcatcagagtgcatccagaggaaaagagggaggaagggccgaagaagacacaatcaacggcactcccacacttttactgtttgagccacgctgccagtgaccacatagggtgctgtcttgtggaaatccaatgaggtaacaaagtgttcatacgcattgagggtcttcatgcattgcctgttcttgtaatcccatacgtgtagggtcttgtcatcagcacaactcaaaataaatttccccccagaactgaacagaacttcacgtacccagttaccatgacccacgagggtcatgaggcacatgccggtactgacatcccacatcttaatagtcttgtccctggatccagacagcaagaatggcccagatttaccactattttttagtctcagagcctgttgcttcagagatggaggaatatgagctttctggagcccaggaaatgcattctaccacatgctcatgttctcggagctcacccttgcattgcattgttgctacaacccatacacgcacagtctggtcattggaacagctggctatcagagtgccatcttgatttggttgtacaatatgtacccattctctctgtcctgtgaacatcttcacacagtagccagtttgcacttcccacatttttatagttttatcccttgaggcggacactatatgatctccactggccatgatgactactgaggaaacattatggtcatggggaaccatgactatgcatggttctgatgcattcaaagtcctgaaaatcccatggtttaatggtcatagctgcagaacaggaagccagaaacttgccactgtggtcaaatgaaatgtcctgtacagagtctctatgtccttcctttaagagttctttcaaaatctccagtctcataatcccacaccttaactgtagcatcctctgaagcagagaccataacactgaacacaggatggaaaatgactcgaatgattggactcctgtgaccactcaatgtgtattttttctggcagaaaatacccattcttttgggtcttgtttctgaccaagaggtccacctgacgtaaattcttcttttgcttcatttagcgttgattctaattccataaacttcttttgtaatctaataacagatgtccattttttccccaaaacaccagcctactttatttcttcattcatatctaattcagcttcctttttaaaaactgaatatgcctcttcgtagccatttgaacgaagataatctgctttagcttgatttagttcatctcgttgtctctgggacagcaccatcttggctgtaatgtcaagcttatctcatatagtggtatgtccctcctttgggaaatgaaaaagctttttgatccgtggacgtataatataaatatgacactaagtgtcttccactcagcggaaaatgattcttttacaaatgaatccaactagtaaccagaagatattcaacaagtaagattcattctactctcccggccgctggattctgccactgccccgccgctccagctctgtctgtcacaggagctgccccaacaccctgacgtcactgtgccaccaccgccactgcccccaccaccgcccccactgttcttaataccatttaataaaaggaagtaagccttcctggagaaatggctgattctaggacaggcggggaatgtacaaaatgagcctggaggagcattttacagggccagaaagtaagaacgtgttcagaagaacaaacaataacacacaggtcaaggagacacagtgaccacttgaaaaagctttcaatggcctaagctggaacaatttgagcaataaagtagtattggattataaataacccaagtataaaataaatatgcatgattccatactgatttacatttatatatttagttaatcacatacatatgaataagtaaatggcagagaataggcacatctccagagtggtggaatttcaggtaatttatgtaatagtgcacccccaaggaggtggagcataattctcccctccttaaatatgggctgcacacagtgacttcctttcaaagtgtacagtgtggaaagggggcaggggagaaacttcacagtggagacgtccaacaaacactgcctcagccagatgatcatggtcaacatcacgagtgacgtcatgttgataggatgtgctcctgatagaatgtgatgaaagtagcactttacttctgtggtcttctcccaataatcataggagaaaacaccaggcaaatcccaatgttgggacattctacgaaatacctgactagtgttcctcaaaactgtcaaggtcatcaaaaacaaggaaagtctaagaaattgtcacagccaagagaagcctaaggagatgggacaactcagtgtaacatggtgttctatggtggaaggacagctgggtcaactaaggatatctgaatgaagggtgactttagttaatatgcatcaacattggccattaattgtgacaaaggtacctcattaatgtaagatagtaacaatgagagaaactgggtgtgatatctagggaaactctctggactattctcaacttttctggaaatttaaaactattctaaaataaaaagtttatttttttaaaaaggaaggcaatcccctttctctctcctccctctttctcctttccctctctttcctcatttctcccttttccttcctcctcttcctcctgccccctcctcttttcctttaacaataacaataatgtgtagtccattctcacactgtgataaagaactacctgcaactgggtaatttatgaaggaaagaggtttaattgacttgcagttccacaggctttacaggatgcatggctgggaggtctcaggaaacttgcaatcatggcggaaggtgaaggggaagctaacacatcttcacgccggagagagagagagataagggggaagtgctacacactttcaaacagccagatctcgtgaactctatcaagagcacagcaaggcggaagtccacccccgtgattcacttacctcccactaggcccctcctccaacactgggaattgtaattcaacatgagatttgaggggggacacagagccaaaccacatcaaatggcatcacacatgtgaccagtacgttgtcgtttccagctctcttcccttgcattattctgcaggagcccttgccacagtgcagtgctggatgtggtattcttgaattcacagttgggccagggaggtgaaatgacccacctaggaggtagcagaggtgctagcagcactcccaagactcatagtgaattctcctgggcctgtccgtcaccctgttatgccacttttcatttccctctgatcacaaatgactcagcacacagtgtaagtgctacaattttactccagaatttgacttgtattgtcctacagactgcaggtaccctcttgttgctcctttcccttgaaaaaaaatacatcatctcaaaagaacgcaaccaggagctggcaatggcactggaatcccttcctggtcacagaattgatgctcatctgcccagtgcatggcacttttacaagaaatcttatttggtcaaccccccaaatatcacagaaggacattattattatctccagtctgcagttgagaatgctgaggctagaaagtggttaccactaaaagcaaaccttttctctctttcccattgcctatccaccctgactctgggctctgacccatacccacctgctcaaggtcccaggtaggagttgcccattcttttaagtatgagttcattcatacacatcaccatgtgaggcttgatgtgacctcagtaacaagcaggtctcatctgccctgtgcatgtgaatgtgccttaggaagcttatcaaatcccaaaggagaaattacatcctctaggaaaagtacagtgaggtgactgtcccgtttcctttactggctctggaccacagctgagttcccatgcacgcactgtggcacacgagagtgtgggcagaggcacttctgctgagtgggatgaaacatcttaagtgctctgagggttgaaactttgaagaggttgagatctgtgagagctgaagaacctttgaatctcccttcagctctccctaccccaaccacagcccttctcttgatgtaaaacatgtgttcagatagaaaacaaatgaggcttacttctatgccagtaggactgtttggctttaagcttccccagtggttgaaaacagcaatctccgagatttgcccaaaactttaaatggaagtcactcccatgggtcacatccatggatttgtgagatagggcaggaggctgtgtctctgctacccagcggtgggagcaggggtctgtgcagcctgattgtattggggatgggcccctcgtccagttgcctatgaggataacctgcggagaagatcagatggagatacctggacttatgcagaggcgtgttcgggttaaatagaaatgcccagggtccaatagagggaaccttccaacaagtgtatgagttggcctctcacccgacgctggccacccagatgacagcttcttggacatgatgaatggcctcacttccaccagaacatcttcctgccaggccctgctgctgcttccccagctgtgtggccttggatgagtaacatggcctcttattaaagaaatggatgaaatactttctaaagaatcttccaactctgaagatctgtgacatcttgtcactgaattaataggaaatcagctccttatagatttggtctatgttaggagacaacctctgttgatgggctgaccgaatgtctgaagtgggaaggatttggggaccaaaacaggtaacaagagtagacgaacacaagaaattcaggttgaattaaccttcaacagatatttattgagtaacttctacatgtaagtcaccaaaatctgggaaggggaaatggataaaagtacgattctctctctggaaagcctatagtctaattaattgatgtattaagtaatgctgggtggaggaacaataacccaggacttgtataaacaataggaaactctgggggaagagcaaggctagaagagacattatctgggaggcaattctagagcaggtagatttcaggaacaggacaatcaaagaaaaggagagtggcattcacacatcaagtctaataatatggccttattttatggtccacctgagtactgcagaatttagccctaggtactaccaggtccaaagctgcttctttaagctacactttaagctcctgtcactagaaggggctgtcagggtgccagggattttggtaggttccgtgcggacttccctagtcctagaggacgttggagtcactggggtgtgaggacattggagagacaggaatagagttccacgctgcgatgaggagatggagcctgatgcaaagccacagggaggctggcgttgttggggtgggaggaattcccacccagtgggagagttttacattgaggactacatacctggtcagggtataaggcaaagtgggctcccactcctgacatgttcctctttaccgatgttccttgtgaacttattccccacctaggacagctaacactttaagctcttgactgtcatttatactttattcatgtgaatgagtttttagttttctcttgaaagcaagttgggatactaggaaagttgacaagagtttgagtttctatgttggttgggaaagagtgatgtctccacatgtaatttgtagagggtcccatcagtttccaaaagaggaagtgggtgtttgtcttgcttttgagacattttgggagacttagacacaatataatttctattgagaacaaagtagggttaggatttggagaaggaagacagatatttccttctctctgctaaagagatggtctggagtagaaaacttgtggactgtgtttacaattgtggagtactactcttggttaaaacaataaagcagaatcgatgtctgtagaacagagctggaaggggcctcatggttggttttcaaggtaaactaaccacagacatcagttttccactcctctgcctttttagcatctgggttcatcttccaggaaggccataacaaaactccacaatctgaggatcttaacaactgaaattgattgcctggaagttctggaggatgaaagttcaaggtcagcttgggcagcgtaggtttcttccgggtgccatgagggagaatcattcgtgcttctggtgtttgctggcagccgctggtgttccttggctggcagaagcaccaccccaacctgtctctgcatcttcacagggcattctccctgtccgtgtgtgtgtctgaatttcccccttttataaggacaccagtcatgttggattaggggcccaccctactctagtataatctcatcttaactaattataccggcaatggtactagttccagataaggtcacatcctgaggaactgaaggttcagacttaaacacatgaatgtgggggaggagacgcaactcagcccataaccacattctttctacacagggagttcaagttagagagcccatcaaatcatgcagggaaaggagatgaaatcctctgggtccgtcactgtttgaggcagccctagacacatgctgagctattgtccccactttgccaatgcagactaagcttgtgtccatggaaaagcccagtgtgaactaagatcactggatgcccaccttggtgctgggggccggggcccacacagaagtcccaggcccaacctgaggggagcaggctataccaggccgaggatggcccccttgatttgggtgcacactcaaatgtacaaactactgcctgcaccacagagactggcccggaggtgttatcttcccagagggctgggcaaagggctatctttgaaccagctgttcccactcaggcaagagtggctttgctgggcctccacttcctccactgtaaaacgagggtgatgctctgccctgcccgacccatctagggtcaggtgaagatcaaatgggataataagatagaatgtcttttgaaagacccacacacgaaggtggcatgagggattgtctttatgactatcatgttctatgcagccctgactgttacgtgctagctggctgtctcatctcctcgaggtgtcctgcgtgcctgctgatggggatgattccaatgactaaaaggtacctggccttctccatgcccagctttacatccagtagaggctcaggccaccctcgatggcagcctgcccgctgcgggcctgcttgtctgctcaaagcagaggttgacttgcgcccaggttgcattccagaagtcctggcctgctttctccacatggttagcttcgagcagtgagcttgggagcagcctttctgcgagttctgccaggtgagccagcccgcaggagtagggggtatcccaggcacgcacctgtggctcaggtttctcccttgtggcccgctctctccccactgctgttttccagagcacctccatcctgcaagattgacagctcactcttggtagggaacagagtgtaggaagtgatcgtttcaaacttctcttgcagctccatctgccaaaagcccctctaccagttgccgtatttaccctggctgccaggcctctctcagctgccctaagaaaacagattaccgtccagagcaaagtcctcgtgtgtttcctttctggagatgaatcaagttctgaaagaaaggtttcctgtagcccattacaccatttcagtttgttttatctgtctccacctgcagagcagggaattaacctgctgcccagggccgggccagcgaatgcttggaaggaaagcaaagcgcacgggtgtgcattttttgacaacagaccatggccttgttctcctcagcagagcattgtccccatgaggcccaggcccaaatctgaataggactttgtgtaactcgatctgttttccttcttggctatagtctctgtgccaaatttaactgtggtctgtatatatagtgttgtgggagggtgggggtagaccagggaaggttgggggaggggagtatatccatgcagtttttttcctgtcttcctttttttgtgcttgcctgctttgctcactgtttgctatatataactcaacatgactgtcctcgcatctccagtcattaaccctttagggataactaatgcacctctttatgtaggcccctggctgggaagcgctggcactgttggagttaacgactggcccctggaaagtgaacttccccagaagtgcttgtgaagcaattaacagggccccactcagatagtaaaaatatcccctggcttacaaacaagcagagaagcgcctccaagccaagagtcaccgctgtgccccaggcatgtagtgggcgctccctctttgaaagtcttgtatcttagactttgcagaaatgctacgaaagctggtgatgcagcaacgatttcaggggagactgaaatctattgtccaactgaaagcctgtcagggctgggcctctctcaggaggtgaaccatcccaagggtcatggaaagagctactcattgtgggcctggggtgacagtgacccatcctgggtgaacagaagcctcacttcactttgccggagggagacagtaggctgacaaactattgtggaatctcctaaaattggttgctaaagggagcttctcaccagggccagcttgcctgggctcttctttcaaagggtggagtgttgtctgccagtccccaggctcaggggatgcaagtgaaagggcttcgggctttactgttcatttcctcagaatcatagaagtgccgaaaattacaaaactgcggtctccctgcaagggactcaagatgtcttgggtcatcttaggctatatttagaatggaaaatgtgttggctctgaggaaacagggtatgtgtccttctccaagcaggatgctatgaaccttgccccataggccctcctacccatcctcacagagccctgaaactcctcctccaggaacccttccagccagtgggaagaccccacagataggacccagtttcccctgtgaatcaacttctctagcacgtcccactgcccagggctgggaaggtccagtgtgcccagtgtggcactgttttccagggctggatgcatgtttggtcctccagtgggaactctgctatcgtccctgcttcaccaggagtgatgatggggacaggcacggcagagagtggacacagggatcctggccttagggggcagtcactcatccagctcacacttgtacatacgtcaccatggacacagaggttttcagtatgttaacgatttgcacagtccacatcagcatcccgttaactttctttttgtaaccctcagcatggttttaagaacctggaagtttattgcgtaactgttttgcttgtgaagttgcacatgatttctcagaaagatcaactcaaacccaccttgtcacccctctccacccaggccccacttcctgctttgctggggctggggggtcagaagtaacatagctagagacagatgtccatcatctgtgcttgtgatgacaaaaggaggtaacaggagtacagtcagaccctcactccttggagccctgttgtgagccgctcatggcatgcaccattctctgtcctcacaacagctcagacgggtaggaattattggattctttctctaaacgggaaaccaggggttttaggtgccttatccatggaccctgccctcacctccctcacccagtgcccccctgtgccttgctggctctatctgtgaaatttatccatggaccctgccctcaccttcctcacccagtgcctccctgtgccttgctggctctatctgtgaaatgtctcaagagtccatcctgttgtctcccatcccatgtctcccacttggcccacagtccagactcttacctgtccagactcctactccagagagagccggcaagatctttgggaaaggcacattgagccatgtccttctcccccttggaactcaacagtggcttcctgtcactctgagaacagaatgcagcctcctccctgtgcatgacaagcacctccctgaggtcacagctgtgtctccctgactctgcactggtccagtccagcctcaaggccttaaatttgccactccagacccctggtttggaccctggactctgaatacattctggtcttttcctcagggaggtcgaggcactgtcctagcttgtgacctgctcccatacctattttctcagggtggaagcagacgctccaactcccacactgtgaggctggtaccattacctccaagacccaaagcctgtaggaagtatagcaggcctcacccaataccctgcagttccctcacttgctccaagtgggaggtgggtcttcacgggtccccaagatgagggtcagtggctttcctctttcacaggctacagtgggagcgagtcttccaccatgggacctctggccagatctcagggctctgtggttgggggaaaatggctctctttcatggggctttaagacatgaactgacatgacatgtcctagagactatccagagagcatgtggatcactttttgctgctttagatcaccttctttaaaatcaatgcattgacatactttcagcacttaaattttcgtattctattatcgcatcatctcagaagaaaagtctttcataattaatgaatctcaggttgggttaaatattcagtggctgcccacacaccacttactctattgcttcaaaataattggctttcacttatcaggtctactagaatgactgtcttaaaccagtcacgtggtggaagcgtcaccatgtttcttgctcagaaaataccctttcaagggcttttctaggggagccggaacagtagccaattctagtgggacctttaagaaacaactttgcccaggatgatatttgagccccctaaagggccaataggggtccctctattcaactttccctccgagtcccaccaacctccccactttggttccatacagcttggattattgccctactagttcaaaactgaaagtttcaaataaaaaccaaaagacaaatgttaagtcacattgaattgataactgagacaatctgtcaagcatattttgctttcctgatttttcaaaaaaaccctaatgttgcaccttccttgttgtcagtttagtacgttaacatttttttaattaaacttcagtatcattgaacaggtcatagagtgtgagcaatattgtctttgttccaaaactccaaatgtaatgaagctgccattcacaattgttttccgctgggctgcttattttaaaaaaatgattttgatgaataaaaataggtgcattttcacagcgtggggtccagcaagaatgaaaaccttacggatcacagcccggcccctgggggtgcgggaggaggtgttgtcagatgtcaattttggctgattgtttttgaggtcatgagactgccattcctgtgtcctgtggtgcattttagagactgatgtcacttttttgagataaattattagagaaatgtttatagatgaatatacatttcacagtgtgccagagttgaggagtctaatgaagtttagaagggacactgggatgagggtgctgagctgcggtgcctgtggcctgtgacagacacctcctgcaccaggaggcaaggatcctgatggtcagatgctcagtccccaacaagagggggttcaaagccagtgcagccccttcctcccaccgctgggggcagcaaaggacccacagtggagattgcaaactatagcaggggctgtgctttgtgtttgttttcaatatttgagccatcatacaaaaatctagtgatttctcattctctatacaaaaaccagaagatctgggccacaaggtctgcattttccccagtatcagtctgctatggccccatattagctgcctagggcccctcactcctgctcctgctagaccctgtggatatttgagtcatgaccttgcctcaaggcttattcatgtattatttgtttatttattgttaacataggaagggtcttgctctgttgcccaggctggagtgcagtggcacaatcataactcactgcagccttgaactcctgggctcaagtgatgctcctgttaaggcatatttagatgggaggaaacatctttcttcctttagagcatctaattattggcatggccctggacaaattatcctagagcctggagcctcaatttgctcatctctgtaaggggggtgacaatgcaacctcatagggtggttgtgagtactacatagaaaaagactccagaaggagcacagggcctccattgggagcccctcagccaacactccctccttgctgcctgcacagcctcaagagaacatggagtcctttgggatgctgaaaactgtaaggaagacaactgtgcattctctgtgtaagcagtgtgcacactgtcttcctcctaaatggctagttggaggagtgaagacagactcactcagaaatgggtgattccctggctgcagtctcctctctgataacaaaggactgggcccagattagagacgaggcaggaattatgtgctgcagaaaggcggtggggacatcttgagtttgtttgtagctaatctcaaataattcaggtcttttccatttgcagcaaatctgattccctcaacacatctgtggtaaaatgttatgagtgcatgcggagaccaagtgtggaggggatttttttttccaccaccaaatccatagttaccctccaagttgtaatcttatcatatttaactggttccacataaacagatctatgtatattttcagtagtttcagctgaaacctgttaagaacagatgtgccaatggttccctggcactgatccatttaaatatattttttccacgaacaggtttttctctctccctttccttagaggggagaaaaaatatgaaagtggaaccaccattaaagtggatattacatgcttctgtgttctctgcaaccagtgtttgccattggttttccaacagcaatttggcacatgaggctatgaacacagagtgtgcatttgatggacagtatttgctctgagactgtgtggctgggagaatgggctgagagctctgtagttgctacctaagctagggtcagccagggttagtttttccctgctgctgctgctaagcagcccctgggcaaaggcttcagcaggccgtctgcctctttgagcctttagtttttcagttgcaaacaaaaaaaaaaaggtccagggagtgggaagataaagaactcctataactcagcaacaacaacctgattagaaaatgggcaaaggacttagatagatatttctacaaagatgatatatattaataaatggccaaaaagcatgtgaaaagatgactggcatcactaatgattagagaaaagcaaataaaaactaaaatgagacatcacccccacaccattagaatggctaatagcaataaaacggaaaatatcaagtgttggcaaggttgtggggaaattggaacccttctgcacttttggtgggaatatgaaatgctacagccactgtggaaaacaggatggcagttcttcaaaaaatcacaaatagaacaaccatatgacccagaagttccacttctaggtgtgtattaaaaaaaattgaaagcaagatctcaaataaatatttgcacatccttattccaatatagcagcattgtttgccatatccaaaaggtagaaacaacccgagtgtttacagatggatgaataaacaaaatgtggtctatacatacagtggaatattattcagccttaaaaggaaaagaaacagtgctatatgctacagtatggaagaacctggaaggctttatgctaagcgactgaagccagacaaaaaaggacaaatacactatagttccacttatatgaggtacctagagtagtccactgcatagagatggaaagcagaatggtgcgctaggcacggtggctcacgcctataatcctagccctttgggaggccgaggcaggcagatcacttgaggtcaagagttcgagaccagcctggccaacatagtgaaacccctctctactaaaaatacaaaaattagccaggtgtggtggtgtgcacctataatcccagctactcgggaggctgaggtataagaatcggttgaacccaggaggcagaagtggtggtgagctgagatcgcaccactgcactccagcctgggtgatagagactctgtctcaaaaaagaatggtggcttccaggactggggaatggagagttgtttaatgcctaagaatttcagttttgggggatgaaatgagttttggagattggtcacataacaatgtgaatgtacataacactactgaactgtacacttaaaatggttaagattgttgaaaagaagaaaataggggagagggtctaatttgtgacaccaacctcatcgatgggggaaggattcaaaagagaggtgcacattcagccagacactgagcctgttgcccgtggggattatgcctaagaggaatgagataggaggggttatgttttctcagctttgaatttctttctcaagaacactcctctgtccaccttcccattgcccacacgacagagttcaccaggcctcctagctctctaccagcctatagccatctgcaggaatgtcctcactgggccctttgggccatgccctgtgtctgtgactctggggcctagcactctgacccactggcctgtgttcctctctggttggaagacagtgcaaaagggacctattccaccttcagtggcctccgagtaacccacctgctccagtctgcagatttccatctcactgactttgccctggcactgggaggggggacgtgagggctgcaggtaggagtttgatggcagatgagcctcaggggttcaatgtcagctgggagaagcaaggccacttccagactcagttctgccactgtctggcagtgaggctctgggcaaaccattttgttttgtctctggtaaaagaaggctgtgggcaggattgggctttgtaattgccaaagattccagatctttgaggggctctgtcttcctaaattctgtgcagcctgctagcctctgcaggacagtatcagggaaacttaacatgcctgtgtttcgtagtgaacaggatatctagggttgagaattactgcgaacactgttatgttgtcacgtgagctggggctccatggtgatgcaccctgggctcccagaacaatgtgaagcactgagatgccctgcacctgggcctgggtcagaatcctggtagaggggtctttggcaaggacaggagaggacctccttgggattggactcagctgagcagcaggatgcctggttggcttgggaggtgagattagcttcctgggggcaaaaaggagccatatttgtcttaatgaggagaaaagagcaaaatcaaagcattcaaagaggataaaagaacacttcaaagaggataaaagaacatgttcagttcacaattactgcctccctaaccaggcaagtgtatgatggagaatcctgttatcctaattcaagaggacaatgccaaaggcttctcttgctggctgagaattgttggggagctccctgcccacggagggcctgtttgccagatccccagccccctgcagacctctgatctgtgaggagctggttctagtgattcacacttgcttgtgaaaaccttgatcttcatcaagcttttaaaaaaatctcatccgtattttttcccaattattttcctgcctgctcttttttttttcaaaagtaaacactcaaaagccttcatttctataactaattctggagtttacagaagcaaaaatcaataggctcaaaactccattcctttattcacttggctcagactggcttggggcagcacctctgagcccaagccagaaattgccaaaagggggttcctgtcggaatcttggagctcatcccccaaacttgagattactgagcaagtgagcaagatgtctctgtctggtccaggaagatgtcagccccacactgcccctcccagataaagagatcaacacgggacaggtcagtctctcccattctgtctccacctttgccagtctgcttctagatccccttcatgtactcatgttgctgccctccattcactagattttcaggatctatttatatccatccaccacatccaccactctgttttccaaatattatcacaatcagcgcagtagtgcttccccccgaaagactggcagctctctgacctttcttttcagctacaaatgaaaggggacttaaaagctgtgtgtgcatgtgtgtgcacacgcctgactaatggacacactcctcatgaaaaacaggataaattacagagaatggcaaagtaatgattacagaaaggtatatgaggcagaacccattagtgagctgcattttgttcaaaaccgagatactggcaggcagaataacatgcctttgtaccagaacgcattcagctgtagcaatgactaataaagtagcgaggatctgtgcacattttcccccttttgtgcctattttcataagttaataactcaagcatgaaaattgttttaaggctgaagactggtggtaagatctggtcaaactgtgtgggaaacaacttttgttgttgttgttacttaatttagtttggctgtttttaagttagaggagtggaaatgtcaatgtcaatgtgagtcttgcaatgtgtttttgttaagcccaagagcatttgggattgcatcatacaaagcacatttttaatgactagagatcatagtttctcttcctacaggtgtatgttcctatttggtacaggttgggattgttggggagggaggaggagatggaagcaaaatcttataaatgacatcatcctgggcttacccttcttcagctagaaaattcctattccaccagcaaatcagcctggtgagcaaacagctgccttagacaaatggggttgagtgtaggggtgaaacctgctgcaggattttagtaaattctcagagcaatggaaggaacagaaatatcatgaataattgtcatacctctcattcctacaggactcaggttttgtgagcattttcctgtccatagaaccagagaaagtctaagttaagggtaccagattttgcataactcctctttcttcttgccttttattttctttttattggatgagaagactttgaaagacacagaaaaacacagagaataacataaatacctgtgtagccacattctaggagtaacaactgtaatattttataatgcttactgcaatttattttttaaaaataaaataactgaagcattactgataaagatgtatcatctcctttatctcacagacaagcaaagtggatcagcaaaggctgcagtcaccagcatcttttccaaccttaatgaactgtatcctcaaaagaacactatcagactggtaagacaagcattattgtcccacttcacagatgaagagcttgggggccctgtggatgtgtaggagagtcggccttcctttttataggccttttgctgagctcagaggacagagcagaagacaaagccgaaagcagccctaagcagacactatcccagcccaaggagctatgcagacagctcctgcctagaggagaaacaattctctccttcagccaggcatgtggcacagaggtgaacaggaaatgcttagggagacagttcacagatatatatgtacttcacagggcacaatttaatccataaatcaatcatggatcactgctaaagaaaacaaaatatgctgccactaatttgccaccaccctgtgagcatgattggatgatgtttattttgattaggagattgctccatttataaatcttcaatacatcctgtccccctaaaacggcatctggatcttttgagggttaaaaaaaaaaaaagtgaaattggatgagggatgagagctggacttctgtgtgtcccggggtctctggatccacagcctggtgcctagcatcagttaagcccacgctggggtcgcatcacatcccgcaaagccacgtgctctgtgaggccaacaggagccccgccgggtggaccagctggaatctcagagagcgccgactctgaaaatacccggctctgcagaagcacgctgggcccagggggcttctagactgacagctccatttatcaactacctattggttttaaaaattggagtgtcttttccgcgttgactgattttggctctaagagatgtcgctggtcatttcagagtgactgaacctcccctctaacagatcccgggaattgttttcaggaaaggtaaaaggcagccttttctgtcacaacacaacgctgagccggcagcctggctctgtcaggatctggggctccagcgcccgagaagcccagcctcgccggcggccaagttcaccgcgaggccacgcgctgcctgcgctgcgctcccggacccgcaccgaccgcagcgcgcgccgccggtgcttctcccaccccagcctggaagctgcctccctccgcctatccctgcaggataagaagcccgaggaggcggagcatggaactcgacagttaaaacatttaagagagaaaacctagtgtcttgctggcctgaaatcgagtacgcagcccggggtgatcagggtctcccggcccggatgtgtgagacttgcttcccctgggcaataggcgatacgatgctttaggaggaaggtatctctccctcctaagccccggaggggagaacttccaaagacagaaaaccacagggttcctggcacagagctttccctttatcagctaaagcagaatcttttctggccttaacctggccccttcctctaactgtaggcagagaggcagacagaaaagcacttgctgaaacacaaagttttgttctgtcctcaacgaactgtctagagttgattgctgatagtcgtggtgcattatgccttcctggttttcatttaattgggcaccacgctgcctttcaagacgccttaaaggaaccaacaaccaaatccaagagagctggacagaccattgaacacacagtaggctgtgtctcgtggctttcgttgtctggtgcctcaaagaaaacaccagaaagattgtttctaagctagagccaccccagattgcttaaagtgcaaagctcactgctgttgggggtacccttgtgagacactggaaagctggttttaccgtggccctatgaagaggaagactgaaatttagacagtaatacctttactaggattggaaaagatttggttaatgacagccctgttatttctaaaacccattatcactgtatgagagattcctttgcgctgcatcctcgacagtgcttcctaaggtccgtcttttctattgtattcattttaatgggtgcatagccgtatctcgttgtgattttaatgtgcatctccctagtgactaataatgatgggacgcttttcatatacttgtttgtcattcataactcttccttggtgaaatgtctgtttagatattttgtccattttttttatttggattgtttgatttcttattattgagttttgggagttctttatgtattgtggatacaagttccttattaggtgtatgatttgcaaatattttcttcaagcctgtagcttgttctttcattttcttaacaatgtcttttgtttttaatttcaaagaaatccaatttgtcaatattttcttttacagattatgcttttgatgtaagaaatctttgcctaacctaagtcacaacaatattctcctagaagctgtagaaatttcaatctgtaatgatcaattttgaactcgtttttatatttatttatttatttattctttgagatggagtctcactctgtcgcccaggctggagtgcaatggcactatcttggctcactgcaacttccacttcccaggttcaagcgattctcctgtctcagcttcctgagtagctgggattacaggtgtgtgccatcacgcccggctaattttttgtattttagtagagacagagttccaccatgttgcccaggctggtttcgaattcctgagctcaggccatccacccgcctcggcctcccaaggtgctaggattgcaggcgtgagccaccatgcccgacccagaacttatttttaaatatggtgtgaggcatggagcaaagtttacttttttacatgtgtttacccaattgttccctcaacatttgttgaaaagacatttctccactgcattgttttatgtctttgtcgaaaatcagtgtatttttggactcttgattctaacgttccattgatgtttgtcttgatttatttttttggccttgaaacaacaatttattttcatctctcatgatattggaggttggccaggttcagctgggcaattcttacttgggttctctcatgcatttgcagttggatgatggctggagcagcaatctggaggctcaaggaggctgaaggccacatatgactccttcatttccatatctagcacctcagtggagtaggctggaacagctggggaatgattgagcttctaattctctccctacctcctatctatgtgtctagttttcacttcttcacagtacggcattctcaggaaagtcagacttcttagtagtggcttaccctagaatgacttttccaaaagcacatgtttcaagagacccaggcagaagctgcaaagtttcctgtgacctagcttacacatcctatagtttcttttgccatattctgtaaggaaagcaagttgctatggccagaccaggttgaaggagaagggtatgagactctacctctcgatttcaggagcattattacggagagggaaggattgttggttgcttctgtataagcaatgccaataatagaaggctccactgtcctgattaatgtagctttataacaagtctcaaaatcaagcaatgttagtccttcaactttgttcttcctttacaaagttgttttgactgtgctaggtcccttccatttacattcgaattttagaatcagtttgtcaatttctaccaaaaagaaagcccttatgaaattttgatcaagattgcattgaatttatggatcaatttaatgagaacttacaattcaaattattttaagatcaatttggtgaaaatttacaccttaaaaatattgagtcttttgacctatgaacctacttaggttttctttaatttattttagcaattacattataattctcaatgtatagatctttctatcttttatcacatttgccctattttatacgttttgacccattataaatggtatttttaaaatttcaatttccggttgttctttgcaagtatatagaaacataattgatttctgtacattagccttatattctatatttttgctaaagtcacatttttagttctagtagtctttttttcataggattttctgcatacacactcatgtcatctacaaataaagatggcttttcttctttatttccaatctcaatctcttttgtttccatttcttgctgttgcactggatagcaccttcagtacaatgttgaatttgtgagagtttctgatcttaagaggaaaacactcagtctttcaccattaagaatgatgttacctataggcttttcatagatgttcccttagcaggttgaagaagtttccatctattcttagtttgctagactttttatcaggaacgtttgctgagttttatcaaatttttttctgcatctattgagacatgcaatcttctagtgccatcattttacaagctcaagtgaagtgtagggcacttacctttctttacgtcctactatcctctctgtttataatataattgcttaaatattttctctgcatatatttaggatcacattagatagttataatttttacttcaactgtcaacataatttagaaaagtccagtgaagaaggaaagtctattatacataccaatatttttgcttactattatgttaatatgttctttcttccttactgatgctccaatattccttcctttactgtttgctttttgtttagaaaacttttttttagctgttcatttatagtatgtctgctggtgacagatacttttagttttccctctcctgagaatgcctttatttccattttattcctgaaggacctgtgattggggtggggctgtggtattttaagtggtgtttggctagagtggagcggttattgcccaaagcttttctgtcttgctgggctgccactgtccagctccttaggctggagagagcaggcttttgttggggccttcttggtctcatttggaatttctgagttcagtttcttcaactatatatctgggatatacaagacagaaagaaaccagggcactctccaccatgttgttcctccagtctcaagatctctagacagtctgtcttctctccatctttcagagtcttcttgtgcatgttttttatataacatctacactttttagtggcgcttagcagaagcaatgggacaagtatgtctactgcagctttctggaagagaagctcctcatttctttttttggatacatttcaaaagaagttgcaaatatatgaccctacacatttcagtatgcatatcattaactacagctcaacattagtttatatttttctttttcttgtgtgagatgaaaactatacatacattgccatcaggctttgcccaggcatcagaactcactagacagcagaatatacatctttgagaggaaccacagaaatgtaatgtgcatgctaaggcttttacctgaacatcaaaatggaaacatcagagtattcatattagagagcaaccttacaattataatggatgtggtaaggctttttaaaaaatcaatgttcaaagacatagaatcaaccaaaatggccatcagtgatagactggataaagaaaacgtggtacatatacaccatgggatactatgcagccgtagaaaggaacgagatcatgtccgttgcagggacatggatggagctggaagccattatcctcagaaaactaacccaggaacagaaaagcaaacaccacatgttctcactcataagtgggagctgaacactgagaacacatggaaccagggagaggaacaacacacactgaggcctgccactgcaggtgggggttcaggggagggagagcatcaggaaaatagctaatgcatgtcaggcttaataagtaggtgattggctgataggtgcagcaaactgccatggcacacgtttacctatgtaacaaacctacaaatactacacatgtaccccagaactaaaagtaaaataaaagaaaacaaatttcaaaaaataaaaagaaaattctaggtacattgaaatatgcaattcttacgtgcaccatttgatgagtaccacccacccctctgtcaagatacagaactcatccatcaccccacaagttccttcttcctccttcacagtctaatcccttccccagccacctcgcggggacaaacattgttttgttttgtttttttacacctcctagattagtttcatcttttctagaatgcagtatgaatagaagggatatcatgcactcttttctgtctggcttctttgtttcagcctaatgtttttcatatttagcaagttttataagtcatttgtttctgttgctgagtagtattccgttgtgtgcatataccacagcttgttgatccattcttctattgatggatatctgagctgtttccaggttttggctagtatgaataaagccaaagagagccattttaatttggggcatttaaaaaatggtgtgaataaactttcatctgaacacagggttccgtggtaataatgtttgaaaatatcacctccagctctgacgtgccgagtttgtaattttcgtaaatgatataaaaagtcatttcttcatccattcatttgttcactcaacccttatttagtgggcctattccctgtgccaggaatcattcaaggctcagtggggaagagaacaaatgtaagtaagtcggcctggtgcagttgacatgctagtgagggaaaagacaaaaacatcagttagtgaatacctgttatgacggaaaagaagccaggtaagtgggtagggcattacagttggtccagaggtagtcagggtgtcattttagctctggaagtagggagaggaacttagggagatggtcaggggagggacttatatgatttggatctgtgtccccactcaaatctcacaccaaattataatccccaatgctggaggtggggcctggtgggaggtgattggatcatgggggcagtttcttatgctttaacaacatcccccttggtgttgtcacagtgacagtaagttatcacaagatctggttgtttaaaagtgtgtagcatgtccctctgtctctcttcctcctgctctggtcatgtgaagatgcctgctctggctttgcattctgccatgagaaaaagtttcctgaggactccccagccatgcttcctgtacagcctgtaaaactgtgagccaattaaacctattttctttataaattacccagtctcaggcatttccttatagcaatgtgagaataaactaatacagaaaattggtaccaagagtggggtattaccataatgatactgaaaatgtggaagcagctttagaactgggtaatgggcagaggttggaggagtttggaggactcagaagaagaagggaagatgaaggaaaatttggaactttctagagacttgttaaattgttatgaccaaaatgctggtagtgatatgaagagtaaagtctaggctgatgaagtctcagatggaaatgagggacttattggaaactggagcaaggtcacttttgttatgcattagcaagaggttggctgcattgtgcccctgctttagggatctgtggaactttgaacttgagagtcatgatttagggtatctggcagaagaaatttctaagcagcaaagcattcaagatgtagcctggctgtttctaataacctatgcttatttgcatgaacaaagaaatgatctgaaattggaacttacatttaaaagggaagcagagcatagaagtttggaaacttgcagcctggccatgtggtagaaaagaaaaacccattttcagggggaggaattcatgcaggttgcagaaatttacataactaaaaagaaggcaagtactaatagccaagacaatgggaaaaaggccctgaagtcatttcagagagcttcatggcagcccgtcccatcataggcccagaggcccaggagggaagaatagtttcaggggccagaaccagggtctctactcccctgcacagctttgggacactgtttcctgcatcccagctgctacagctccagctgtggccaagagagcccaaggtacagctctggatgctgttccagtgggtgcaagccataagccttgatgactttcatgaggtgttaagcctgtgggtgcacatagtttaaaagttgaggcttagaagcctccacctagatttcagagaatgtatggaaaaacctggatgtccaggcagaagcatgctacagggttggagccctcatggagatcctctactagagcagtgcagaggggaaatgtagggttggaccccccacacagagtcttctttagggcactacgtagtagtgctgtgagaagagggccaccattctccagaccccagaatggtagagccacaagcagcttgcaccctgtgcctggaagagccataggcactcaatgccagtccatgagagcagctgtgggggttgaaccttgcaaagtcacagtggccaagctgcccatggctttgggagcccaccccttgcaccagcatattctggatgtgggacatggagccaaaggataatattttggagctttaaggtttaatgactaccctgctgggttttggacttgcatggggcctgtagcctctttcttttggctgatttctcccttttggaaagggtatatttacccaatgcttataccgccattgtatcttggaagtaactaacttcttttttattttacaggctcataggtagaaaggacttgctttgtctcagatgagactttggactttaaacttttgagttaatgctgaaatgagttaaaagactttgagggactgttgggaaggcatgattgtattttgcaatgtgagaaggacatgagatttggggaggagccagggtcagaatgatatggtttggatatgtgtccccacccaaatcttatgttgaactgtaatccctagtgttggaggtgggacctggtgggaggtgattggatcatgggggtggtttcttatggcttaacaccagcccccttggtattgccatagtaagagtaagttatcacaagatctggttgtttaaaagtgtgtagcaccttccccctctctctcttcctcctgctctggctatgtgaagatacctgctctggctttgtcttctgtcatgagtaagtttcctgaggcctccctagccatgcttcttgtatagcctgtagaactgtgagccaattaaatctcttttctttacaaattactcagtctcaggcatttctttacagcaatgtgagagtggactaatacagggaccttttaagaggaagtcataggagagtttttggagaaggtaaggttggaagaaggtacaaagaaaaaagcttatgtctttaaatcatcttcattcctgataattcagcacactttagaggcaacttccaagtcagctgttgatggtagtgaagacccaaggcccagagagggagcaactggccctagagttgcatgatgagtcttcagtggcaaggccgagattagaggtctgtactcagcattcagctattggtggacagaactcgtcctttgcttcctaagtgcggcttcagtcctgtcatggccctgcacttccccgattccctgcccactccgtccccacttcttcaggtgcttccccatgggaactggtagaatagtgttagaaagccacatccatagtatggcctcttgaggatttctggtttgtgtgactttgagcaagtcctcccctgatgttggaggattcttacccctgaagttggggaaggagtgaaatcttgatggtaggacatccgctcacatgtcctttgagacttaccacgtttgtcaccatgtatttagcacagctgcctttcatctgcgaatacagcctgggagctctttatgttttatctaatttaattcttataacaatcccatggagttgttaggtagtaaagtgctctctctgtttttacagatggaaatctggagactgagtgaggttgagtaatttgcccgaggttggcaagaggctaaagtagaattctaaaccagatctgtttgattctgatgctcttgcttttagccacaatgttttagcatctgttcaattctgaacagacggacagaatttgcagaggtcagagggaggttctagaataaagctgttctctagtttacaggacagaaatggtggtagtgatatgcctgtgccagttctgggatgtgcagctgggagggaagccttctgtggaccaccatgtaggagggagagcatagcagggtatgatgggaggagcatgggttctggaattgaaaaatcctgtgttcaaatccacactctaccacaaatcccacgaatggaggacatttggacaaattgttgaagccctctaagcttccattttcatgtctgtaaaacgggataataatggtatctccctagagggttgctgggtaggtacaatgagatgatgcaaataaagtacttagacaataccaggctcacagtaaatgcctaataaatgctggctgttgtttttattcgctattgttttgaaaaatggcaggcactacagacatacaaagtgcagagagtggaaagacaacaatgtgttttagggccaggcagcccagagctgcccaggctggcaccctgcccagaagtgggagtgatctagcagaggccagggccttgcaggaggatttttgcagacacccaacttcctgcatcagtggggtcgagtgatctctggagtgccttccgacctggagaggtcatttcaagtctctgcaacggtagcgatggtagctccagcaagggagggagaaggggcttccactggctcttggacactccagctgtcatttttgggaatgtgcttatctgccccagagggaaatagatgattgagaaaggaggcaaccaggggacttaggctttaccagcagtgacctactagctccggtgtgtctgcctcagacagcaggccaaggctagtgtcacggcagtttagggggtcctgcacattcactgtgccaacgagcggtattttgcaaacttattataaacagattatatttcttatcctaatgtggctgttggctacctgcccatgaattttagcctccaggagaaaaacaattgcttgagctgagtgttctgtgcttttactttccatacattactcagggctccttccagttcccccaacccttaatctctctctttctctctctctctcgctttcattctctctctctctccatctttttccttcttttcagaaagtcctctttcatcttgggcataactagaaaatctgtaagctgtgctttctgccatgcattagccaacagggtcctttcctcccaagccagggaagaaagcacaaaaaccaatgtccaggctgggcctctcagggtccacagcatcacaggcaaaggaagtaactgtctccatgcctaccaacggatccacacacatctcgctgggcagcatctctgccccaggaagcagcgcgcttactacactgggcacccagatgtctggtcttgcgtggcaggcagccactttctcctggccttttcttgtcccaaaagtcagaggggcaggccagttccagaatgggattccaggcagaccaggagactaggagtgcatgtgaacaactgcaaggggatgcgtctgtctgcctggtgtccgtgtgttcatgtgcacacctgtgcacgcgctcccccagacttacacactcgtgaacacatgctcacacaagttcatgcacgggagtagctccaagcctctcactcagcactttgctattaatagctcacttttctaaaaaagtctgcttagccgtttgtaagaataaccaccactgcctgtgtgacagcccaggcccccgcagggaggacagggccggccctctgctaggactgcctgactgcctgcctcatgttagaatccagagggagggccaagaggggagatgaaaacccctcctgagtggccagggcagcctccagtgcctgtgcccagggacaaggcaactcactggtaatgtctgcgggcaattggccaggcccctgagagccaagatgccaccttcttcatggtgacagcagggagcatgctccatgaaaccagaatgagcctgttctccactctggggtcctgctgtaaaagccaagaagcagagagccaagctgagcccaccaagagcttggcacgaggctgtcacccacaacttctcgctgatccaaaagacaggctctgaggctggaaattcaagtgtggtggtgctgtgacacagcacacagccaccgtgcacttgtgtccctggcagccgcaatccgggcctgagagggcccagtgtctgtgggtgtttgtatttaattgcagtggggtgagaaaggccaatggttgggttttatttcaaacctgctttgaggagaagtaacattaggtggcccagagctgtgaaatgtgtcctggtcataaatgcctcaccatcaattaacacctccagaatacctaagagttgccagcaacttcccattcaaataacctcttaaaccttcctccacaccacactgcccattccctcgcaggcagacctgcatggtttgatgacgactggtcacactgctggccctatctgtataaaagtccagacagttgggctgtgaggggaaatgcctacctcagagtagcttaagaaagaaagatattggtttacttctgaaaagctcaagaccagctgagtttaatggcatcattaaactcattagacatggggctgggaagtggctgccagcagtttggtgcacagcctgtcctctcagcagcccaggtggcaggtgtcttgggagtggcaatgatgagaccagctgctcatcctgggctggtcattgtgactcagatgtggagtgggctggttagtggttctgggccacttgtccatctctggatctggcagctccatctacacagtgtcgggctaggcatgggagcattctgggccaggagaaaggggattggatcctggatggtgggaaccgcaggtgtccccctccacgtgcctgggtccaagactgctctgctctggaccttctacgccttcagaggtacaagttgcagtgctacccttgctgaacctacaaccctgttcaagtgacaacttctctgagtctcatacgaggatattgaaagaaccttctgcacagggctgttgtgaggattaaccgtaataatacaagaatatctggcacttgcattcagcaactcaccgcttacttgttcaaccaggtaaaaaggttctgatcccagtgttgcaggacagaaagacctccccctctgtagctgcagatgtgacccagcacagaaaaaatggcaggtgaaagacaggcaggaagagcaactaagaaggtgggaggcacctccataagatgcctgaggccatggggatgaccgttcacagagctagtccctcgagcaatgtgttaaatctactgaactgtgataaagcaacttctgggtgaattttgtcctgctacaagttgtcatggaatggcaaggtggcagatctcagaagtggatccaatggtttttttttagttaaagcagaacattcctggggatggtgtcaaactcccttccatactgttgagtctgctgatgattacactggcttctcctctttgccccatcatttcacaggttcccatcttaaagaggaagagaaaggaaggagggaacgaaggaagggagggagggagggagggaggaaggaaggaaggaaggaaggaaggaaggaaggatggaaggaaggaaggaaggaaagggagagagggagggaagaagagagggaaggaagttatcaaacccaagctctgtgcagagcaggagacgtttccatgggacccctagaatagataggttcttgctgctctcctggtggatggagatgcccaccagtagctgtgagagtctccccgaaggcctgattgtggctccaagttccgtaggactcactagtctttttttccctagagggtcttgccattgagaggcaggtgatgtgctgtttcagaaaacaaaattgggacatgtcctgatatgacatccatcaaatatatacagataggtgtcacagcccccgaaaaagcttatctcttctaggccacacatagctatttcctccaactgtgtcagacattacaaagtttctagcaatcaaaacaagtcaaatgccattctcaggacccgttggaggattttttgctttgttttggctttgtacggtatccataccattttccaaattcttttgtccttacatattttgtttttcttaaaaaaaaaaaaatcacctataatcccatcaccagacaaaaccactagaaagaaaccaacattttagccatgtttttctgtatataaaaaaagtgtgtgtggaatttttcataacaatattgggaccatgacatctatcacattttttattaggaaatggccttcaacaatatgcatttaacaatatgcttgatgtctgtgtaatatttcatctaacaaatatatcatgatttatttaagtattccctgattgcttgcttctaactagaaaaaacaatttttctaagtgtcaccactgggttagagtaatctcagccaatcctcctaatagcactgtgagaccagagttatgataatcttcagttaatggacaagggacatgatggtgtggaaggataaataaactacccaaagacaactagctagtgagaccagcatggacagtcaagcccagtgcatgtaatctgtgctcccctgcactgttgctcatatacttggacccttgcatacatgattttcttattcatcttgaaagagaaatgttagcttactgtttttatttgcatttatttcgttgcttttgagtttgagcatctttccatttcttatagaccatttgcatttgttttcctacaaaatgcctgttcatggcttttgcccatttttctgttagccttgtcctatgtatacacacatgtatattattagttcactatctgtcaggtaaattccccagttttcttcttgccttttaatgttgttatggtcatttaggactagaaagttttaaatcttgtatgcctatcagtattttactgtgtgactattcccattatttttatgcttagaaagttttcattcctatcaagtatagataaatgttcagttctactattttattttaactgtgcagtgggttcatttttggcattgaattaattaatctatctggatgttatcattagtttccttctgaaaaagtcagtccaggctgggtgtggtgactcacacctgtaatcccagcactttggaaggcctgagtccaggagttcaagaaccagcctgagcaacatggcaaaactgtgtctctatcaaaaatacaaaaattagctgggagtggtggcacatgcctgtgttcttagctactcaggaggataaagtgggaggattgctggggcctaggaagttgaggctgcagtgagccatgattgcacccctgcactccagcctcggtgacagagcaagaccctgtctcaaaaaaaaaaaaaaatgcagtccagatgtactggaacaagcttgtgtgggatggctacactcctttcctgttccaacacacctgttacctggatgagctcctatatccttatccaggtaccagatctgccacacctggtaccggcatgagccctgtggggaacataccagcagagacattatacttccaccgagacaaaataaagccacattgacttttagtactcatattattgactgacattaaacccatggcaactaaaatctcgttgttgttttttttttattctgggggtgagggtacaacttttagagaaagtatctctccctaagactgccaatcactctaaatttgcatctaacacttctacataactttatctaccgagtaggcagtatttaccgtctgctgtttcatcttgtagcataattttcttttatatttccaggtgtgaaaatattcaaactgacccctaattctcagctttcagagctatctgctacttcccaggtcactttggtttttaagcgctttcacatgctgttgttggacatctgggttattcccaaatcttgttttcacgtaggcagctgtcaagtcaagatagccatggccctgcctgacatgttctttaagattgcattttatttttattattttattttatttttcttggagacaagagtttcactctgttgcccaggctggagtacagtggcatgatcttggcttactgcaacagatcttgacttactgtaacctccgagtcccaagttcaaatgattctcctgcctcagcctcctgagtagctgggattacaggcaccagccactatgcctggctaatttttgtatttttagtagagatggggtttcaccatgttggccaggctggtcttgaactgctgacctcaggggatccacccagcttggcctcccaaagtgctgggattacagatgtaagccactgtgccaggctgcatttttaatactgtgtttttcttgacatatattccaactaaattcttctgggtgttgttggtttgacctcatattcggtcctattgaaatgaatttgaatcattcatgatttggttatttattgcattcattgtccttctcagcttctggttacccacacattagacacaagtgcctttggcatcttttttcaaatctacagatgaggaaactgaatcccagaatggtggagtgatttgacgaatattgcaaaactataatggggagatgagatggggatccaagtcttgtgcccccaaagacagggcaccaggcagcgtagaggtggccagtaccagagcaacagcctaacaatggtatgtatgtcacacacccagctcactcaatcctgaccacaaccccccactgctctgattcctgccccatcagtagcgtctgaaaggacatctccaagttcaccttcaaggacactgttaaggctgggccagtagaaggaatatgacccctggcactgtcccccttcataagacttcaaagttcatcatttcatttgggcatcattttacaatttgctaggaatccctcttatcttattttcatctggtccatattcctccgtttcaaaaacaagactatcctgaaaaactgtcagctgcttgctgaggttatttttggtatacagtacttaccagagtcacctggtcagcattaatcaccccatcatgaaagatttatggttgtttggggggtactgaacccatgttgtaccctatgttttttctgaaatattttcaatctagatggtcagtagttctagaatattccctcagggattgccatcgacaattgaccatttttataaatgttagaaatggaccgtttgcccaggagagggcttccctgtgttgagtttctgtgttgctgccaggtcatcgaagagttttcattgttaaacttgtgtagggcatccaagcaccaccttgctgtcttctcaccaggccaggggtccaccttttggaagagcatctttctaactagaagagagagacgtgaagttgaaattacttggctctgcctccttttttttttttttctcaagtttctacattttagcatctttcctgtgtaatccctttcttgtcccactcttcaaatagctttgaaaacccttctgagatcacgggcctattttcagcctctgcttggtgtgggcttttggtttcccagtgtggttctcacaggttcaggcccccccaaccccggtattgactccatgtcaacttctcatcttctgggtatgcctttctgaaagtctgagatcaccagtggtaccctgtgtggcccacactggatttttctaactatttcctctttttggtcctcactgggcttattcaggattattgacgatacatatgcagaatttggggttttctcctaatctcttttctcacttgggatctgtgtgtgttcagactccctagccccagccctccaggttaatattgtgtggcactaggacattagcctcagtttcttcaatttgatataattgtgtatgataacagaatttacctcctggagttgttatgaggattgaaggaaatagtgcttagttgtggttagtattaatattattatctacctattactgacacactttgtggttataagtgacagaaaactacctcaaactggcttaaacacgaaaagagaatctgttgctcagagaagtttcccctaggaattaccatcaagcaacatccaaaggtagacctggctttcggcacagctgggttcacagccctggtaatgtcctcaggactcagttgtgtccatctggttcctctgacgctctgtgtggaaggaggaggtggcgcagcagcagcctccagcttggcatagccatggtggggagcaggaccccagcgcttaggtttggctcctatctcagcaaactggtgctctgccaaactgaatttggaagacttgctttcccagagaagagagcacatgagccttcctgactgcgagtgatattgctgacacaaactggacacttcctccactctgtagctaaggggcagctgggcctttcaatgcagctcttttctagcaagggagaccccaccagaattgagatgggtaaccccgagccctgtgcacaggtgcctgcttttattccctcattcatctcggtctgaacattcctgaccttgactcttgcctgcgacatcctctgcactcctccacatgctccactcagctcgctcctgagagctggtaattaatcggccttgtctttaccctctgaccccactgagcctcccagatgggtttccacacctggcaaatgaccttggagttactcctaactttgtcccacaggcctgctggattggatttaatgtttgcttgctaacttctctgactcttgacctggtctggtcacttgctgtggttgtgtgtgacacctctgtgttatacacagtgccgggcattgctttttcagcagcctggaatccactgcctcttctttccccaattcgatgtccttttgtggcactactctctcactgggcgccgtcttcatggtaaatccaggtgcttttccccctgcgtggaagtggaaagttgtccacagtgtctcctcccttgccccagggtggtcctgagctgagctgagctgagtggtctcagggggagggacagcaggctgtttgttccctgtagaggcgcttgatggtggagcgctcttgtcccagttgaacctggttctccagctcagaatccagcacccctgttgacctcacaagctccttcatagcttccaattcattcccctccctgcttgagtcagcaagggtcgttccttctgctttcaagagtcctagctcatattcctgtgctgtgctctatcttccctggctttatagatttacttgggctcttttcactcctccctctgaagttaccaattgcactttttctggtctcatgggctggcctcctgcagcatgctctgctcttcccagctttgggccagcacttcctgcttcctgccaggcccccgctgttctgaggtggatctgggctgcagtccaggagacaaaattctccactgtgacaccatctacatgcccagatgttccctccatgtacttcctctttctccttttcttttccaaactcacaaccttccagtgagagaaggaatgaaaacaccacctgtaacaccaattcctccaatttcctccccagaacttcaaagtaaacagaaatgtattgggcttagactgggacttatggatggtcagagttggaagaagccttagaaaccatcacaagcctttgctcccagggctgtctctgatcgtttggttgtggctgactgggttgtcacatctggacacaggaagaaaagtgctgggagtgattcccaatgtctgagtggatgagggaagggggagtgacagcatatgagctagttatttgcccgtcctttaacaatctgctctgtactttacaaaatggggaaactgagtcacacatctatcaagctgtctaaggccacacaggaagtcagggcagatttgggggtagaatccaggttgtccagccttctctatcaacaacaatgacttctctttcccattggaattcactgtcataggatgtcatctaagtccacttcctgacagcatgtgtgtctcccagtctgtgatgtcatgctatactcggccacctctgtacaggacagtgtggcacgaaagggatcctgctggtgcctgtggggctggggctaatactctgggacaactttcagaatcacagttcttctaccctaggacaagagggtggtatacagccaaggaaaggtggtcctgggctctgcagccatggagctccagggtttggaaggtgccgtggaatcttactccttagtttggacttttgtcaaactgcagctggaaaaaaattagaaattgctgctccaaatggaacatactccatttcattccaaatgagaagtaaacaaatagacgggtgagcctccccaaaatgataaaactcttcacacttaagatgagaagtcagttcaagtgcagtcctggcgtgactcactggggtttgctgcaggaagataggggcgaaatgtcctcatcctgcctatagaagccagctccttattttaaatcccatcctgcttgactatcaaagtcagacagagccttcctaaaagctgaaacacacgcacagaatgagaagtccctgcgggagcaagttcactgtggtgagaaccttgcagagcagacagctccaggggccagcggctgcctgcaaacacttgctgagcaagtccctgggagaggggcctttctcccaggccaggaacgccaaagtggggtttcctgataaggaacacagaactgctgtttcttggagagggagttcacacggactgggatccattctcaggctgggccttagtagtgggacagcatcctgttttattaaaagcctgttgctggcagggaaagccatctgcctgctgagtgggcaggggcccaagatcgctgtgggcaattccaagccagtactgggagctgacatcaaaccaggaaagaacacgactgtttttagctgatgtagcagtacattttctttctttccttctttcttttttttttttttaatagttctattgcccggtttcactgtgtacattttgtgtgtgcaggcatgcgtgtgacatcctgtacccagctacagccgaggttcactctgagatgagcccaccccacttattctccccttctccctcctttccccacctccccctcttccccatccttcccccactgacctccccagctctaaaacccctgatagacataaagaacagagggaaacccaggctgtaacctggggttattcacagggttggggtgggtgagagaagaaaaacagacttctttgtttatcttttgagtcttgaaattctaaaaaattcattcatttccaaggaagccttaatttgtaggattccaagaaatttaaaaaaagtaaagggagattcacttcaaaagaaactaggggaaaagctgttttcttttttagctgatttgttcattattcttattttatttaaagttaggtttgttgaaggcaggcaaaggtagtcactttttcatatttgtattacattcttactttcttcctccattgccttatcagttaagagggcaaataatatttcaagagactgatagaatatgttctgcactctgctcatttcatagctctctggggaattggggtttttataaacttttataatcacattttctgctgaggttatagatgactccaagaatcttccattcatgctgtaaattaaagtgactcaaattgcttccacttttacaaattaaaaaaaaatgtacttctatacagatttttaacaattaacaaaaggccattttaacgctctggttggttgcctgtacgtgatttttctggcttttcttaaaatttggagtgaacagctcccatgtcaaatataacatgttaacttattggcttctctttaaccctgcacacaaacaataaacttttcatgtagagccagaaaatggtatatgttgtgaacttttttttttttttaaagatagagtttgtggtgataaagggatttcagaaaaaaaaatgtacttgaaaatatgttacttcacattggaacattcaattttatcttaaggatataaatattcaattttaccacattaatctttgtactgagataagccaaaaataacgtaaactgacaattgtttgctatacattctaatattttacatatttataggagttttccaagtcatgagatatcatataaggcacacaaaaaaagaatgacataaatcatgttaagtgcagtctactttttcctgagctatatctttaagacaaaagatatttaacaaattgaacttgttttttgtgggagggtccactctctggttacttaagagaaaaccagaggattatcttcgtggtgaaggaaagtgtatagaaggcagtattttttttttctgttataaagggccagggctctatccgttggtgcagtgttctgccttttgtgtttttttctggttaatttaaaacattagctccaagtttttaatgtagtagtttcccgtgagtcactgggctgaaagcccatcctatctgtgtcaggcaagggtccaagacaagaaacaaggagaacacagatataagaaagctttattagtgcagctaaacattgataattaggaaagttccagttcttctatggtagtttatttgtagataaatgtagttgtaaccttttggtgccaaaggaaaaactcctcattcaagacaagggatacggaataggaagagctcaaagaaaacacagttttctgtgttacagacaagtatttacattactaatcaacttttggttcaggaaagaagtgataatctgtttagatttttaaaaggaattcaatatcctgttgactaaatgcagagcaggttcagaggaagacgactgttgaataatgcaattgattccttccaagaaagcatagggtgtagtttttattataggaagtgccatcgatagtactttttctgctttctggaaaatcacccaggaaataaaatttgttttaaacattatttttaaaacaggctctgccgacttccagttctggaacaagatggttaaactcatttttccctgctctgctcctctaaatacaactaagtaccttggaaactattcagcagacaatgataaagggctctgaaagctagaagaaaaggtgtacttgcaagaaacctcaggacttgagtaacagcaacatggtaagttttctaagttttcttttcgtctcccatatacgctgggctgtgctggaatcaccaacaggcacagaaaaaatgacaacaaaacaacaacaaaacccccaagaatatcctgttgtctttggccaaagttcaggaaaggggagccccaacagagacccagtaggaagctctagcccctgttttgtacaacccagggtccttgcagagagattgatctgccagcagtggcatcagcagcaatagtagcagcagcaaagccctggacagtcctggcccccagtccacaacttagacacagcacatggcctaattcacccacagaagcagccactgtgaagccctgtgtctccccagactccatccagtggcataaggagacccaggccctgcagcttcctccccatcatggaaggctgtccatctacagagtttccaaacataataagcactaaggaaacaacataacatgatatgccgaaaaaaaaaatcacaattaaatcaaaatgaaacatcaaaaaatgtccaagtaaaccacaggaaggcaagaaaaaagaaacaaaagtgtaataaacaaaaggatcaatcagagaacaaataataataaaatatcagacttagtcctaatatatcaataattatcttaaatgtaaatgttctaaatgcatccattaaaatgcagagattggcagagtgtattacaaaacatgacccagctatgtgttgtttacaagaaactcacttcaaattcaatgatataggtagactgacagcaaattgatggaaaaagttataacgtgtaaacattagtcagaaggaagcacaagtggctatgttaacatcagaaaaagcagacttcagagcaaagaaagttactataggcaaagagggaaattacataataacaaaaagaattaattcaccaagaagatgtagctctcctgttgtgatgttatgatatatgtcggttttcatccgtgggtcctggctcataactcccacatcccgtgttagagtcttttgttatattgttgggggtgttaggcctcagggacaggcctctgaccttctcctgccttcctttcactctaatgttctcccacctttctgcctttctcattgtggatcttaagaccctcccatgagacagtcccaccctatatcctgggggaaggaatgctgacatcatgaagcttccataaaaagccaagaggacaaggttgttaagcttccagatagctgaacatgtggaggttcctggagagtggtgcacccagggagggcatggaagctccgtgaccctttctccatacctcaccctaggcatctcttcatctgtctcctttgcaatattttttaattataaacccgtaaacataggtaaacatttctctgagttctgagagctgctccagcaaattaatcaaacccaaagagggggtcatgggaaccccaccttgaagctggctagtcagaagttgtggaggcccagacttacaactggtgtgtgtatgggggcagtcttgggggctgaaccttcaacctgtgggatctgactctatctctgggtagatagtgtcagaactgcattggaggacacccagctggtgtccgctgctatattctagctgattttctccctagtagtcctagtagtcttgagtgtggggagacagtgggggattgatgccccaaccacaattgtggatttcttctttcagctgtcttagtttttgcttcagatatgtgaaagtctgttgtttggttcataggtatatagagaaaactctccctagctgtgtttttcttctgctgtcacaccatgacaacatcaacacagaagcctttcttcatatcgtataagggcacaaaaaaggaatgacataaatcatgttaagtgcagtctatttttcctgagctgttatctttaagacaaaagatattcaacaaatagaattttatttttttgcggtgtggggtatccactctctggttacttaggagaaaaccagaggattatctttatggtgagggagagtgtatagaaggcaatattttttttcttttataaaggcacagggctctatctgttggtgcagtgttctgacttttgtgttttttctggttaatttaaaacattagctgcaagtttttaatacagtagtttcccatgagtcactgggcctttcttctgtgttgatgattgtggtgtgacagtaaaagaaaaacacagttagtgagcattttctctacatacctatgaaccaaacaacagactttcacatgtctgaagcaaaaactaagacagctgaaagaagaaatccacaattgtggttgaggcatcaatccctgctgtctccctgcactcaggacttctaggactactagcaagaaaatcagcaagaatatagaaaaactcaaccacaccatcaactgacaggatctaattggcattcatagcacaatctgtccaacaacagcagaatacacatttttttaaaggtcccatgagacatttaccaagatagagaatatcctagatcataaaacaaacattaaaaagttcaagagaattgaaattatacagactatgttacctggccataataaaatcaaagtagaaatcaaggcagaaagtcaataggcaaatctccaaacccttggaaactaaacaaaaaacatttaaataatccatgcatcaaagtggtaatctcaaaggaaattttaaaaagacaagaaaagaatgaacatgaaaatatgacatgttaaaatttgtaagattagctaaagcagtgctgagaataaaattgataggagtaaatgcttacattagaaaagaggaatgatctcaaattactaatctaagtttctacttcaagaaattagaaaagttgagcaaaataaactcaaaggaagcagaaaggaggaaataaaaaagagcagaaactaatgaacttgaaaactggaaaaagaaaaaatgaaacagaaagttgtctctttaaaagaattaataagattaataacttttagcaagaatggcaaatataaaaagagagaagacatgaatcaccaacatcagaaatgaaataggggacaccacaatagatgtctttagctataaaaagataatttaaaaactgtaatcaactttatgctcatatattcaacaagtttgaagaaatgggctaattcctcaaaaaccacaaagtactaaaacttagccaaggtgaaacagataatctgaatagctgtgtagatatttctaagaattggatttataataaaaatactccccaaaaagaaatctccaggtccagagggtttcatccaagaattttaccaaacattcaaataaaaattaatgccaattctatgtgtatcttccagaaaataggagagaagagaaaattaggaagttcccaattctctttatgaagccgtcattactctgatacccaaaccatctaaagaaagtatgcaaaaagaaagctacagatcaatatctctcatgaactttggatgtaaaaatcaccaatcaaatgtaattaatcaaaatccaacaatgtataaaaagactaaagcaccatgaccaagtgaaatttatgccaggtagacaaagctgattcaatatttgaaaagaaattaataaaatttatcatagcaacaggctaaagaagagaaaccatataatcatagcagttggcaacaaaaaattatttaacaaaattcaacacccattaatgatgaaaatagaaaatcctctcaaatacactaggaatagagggagacttcctcaacctcataaagaacatctattaaaaaactacatcagacattgtatttcatgataaagacagaatacattgccttatacaatccaaaacaaggcgaagatttctactttcatcagtcttattaaacacagtactagaagttctagccactgcaataaggcaggaaaagggaataaaggtcatgctcattggaaaataagaaatgaaactgtctccttttttaggcagcatgattatttaaatagaaaatcccccaaaaaatctatgaaaaataggttgtcctccttctgttggctacattgatcaggcaagtgctgctagttgttcttaggggttctgcttaagtgctgcaggagatggcagcacagaagctgaggcacagcttgggcatggtagaccagggggacacccaactccattactccctagctctatgcccctgaacaccttccttgatccagctgaactttggtcccctcatctgcaatggtgttgatgatagaacccagaggccataattcttgtgagtattaaatgagagcaagtgtgtagtaaatgtgtcattgtacttgctgcgggtactgctgctgttgctgcagttgtatgtgatactgtgctatttgttctgccactcccaggcactgccactggagcccttgttcagtgatcctatgacttgtcagctcagtcaattgctctgactcttactgctttcatttatgaaatggagacaataacccctctctcataggaagggtaagaccagaagagcctacactatggttggaataatatttgtatacagtgatcaagagaatgttctctgaaaccagactctctttaaatcttacctctatcacttattagttatatggctagctgttaaatgaggtcaaaagagtgtgttcttcataaaactatacagaagattaaattaattaaaacatgtacagtccttttaaaaaagatcaagtgaaacagcatacatgaaagtgctttcagcacgctgagaataacaatagcaatggctagagattatggagcactccccactgccagcaccaggggaactttgtacctacaactttttacttagtccacataaccatgaattcgtctcatttatgtagaccgggaaacaaaagcctagagaagtaatttgcccaaagacctagcttacaaagcaatagaatccaggtctggactctcgggatctgactgtgttctaatgcctcccagagaaagtaggctagagagggcaggaatagcttgacttagagatcacttccactggcacggtgggtacaatctgatgtgggaggctctgggtgcagcctgtgatggcagagtggaggagccaggagtcattcttggcctcattgtcactgccttcaaactaacaagttgcctgagagctaaggttccatttgataggacaccgggtgggatgtgcatcagaatatccatttccttgaaggatccaatgattaggctgaggcaaaatgttttagaccattcccaggtctaaaaataactccatcatcacctctaataaggactcagtctggagtgacatcactccttcaggtgcagaaaaggaaagcatgactgtgtgtcactgacttaaaataggagtgaggtgagaggggcagctgggctcatggacgtcaagtggacagtttctcagctggtatttcctatatttcctgttttggacagcaggttcctgcccttctaagctgggggtaggggtgagggagtgtatgttaaaaagctctgtggacttgctttttctcttctccatgtgtgttctttccatcaataatctgcgttcatctttactggctgttcatgcattatctggagatacgctagttacagaaattcaaacaggcaactcttcctctttctccctagctttacactacagatccatgaagttttcttgactgtccctgcctagggtacaacaaggaaaccactatttggataattcccctgattccatggtactgtggaagtggtgggctctccatatgtcagggtattctatgtctatgaaaaggtatctcttttgagaccaagggtggacgggatcctaagagtctaccaatttttaaaataatttagctatatttaagtcaataaattgtattcaaggctgactttgtagtgatgtattccatgaattatttcattcaaaataattttgaaaggacttctggtccagacaaaatagcatagatccatttctgtcttctctcctctcagttaaatgcaattataaagtctagaaataatgcaagaggtaaccaaaggagaactctgaaagatggaaacagaaagaggaattagttagggaccctaagactggaggaacaatagaggtaggatgtcttaccatcaccgcatccaacaagagaaggtgacctaggcctggtattacctgatcccaacttggcaccaaaagacagccaacatagactcattcctcctgcttcctggtgagcctggtattctcctccacttccactgacagacatgtagggtgactgggtggtatcaacaataggaaccacatcataacaggcagcctagtttgggaagcactcttggtctccgtaggcctgagactccttttgcccatctagaggcaccaggtggcccagcccatggaaattccctcagccccagaaaggggcaccagaaaggaccagtgggagctccagtaggctataatagtatgaaggctctgaaatgaagttgccactggacctacagcccactaaactaggctaggaccttaggtgatagcctgaaaaaaaaaaaaaaaaaaagacccagagtcttttaacataaaaaacaggatgtgcaaatacaatgaaaaaacacacattataccaaggactaggaaaactacctaaatgagaaaagacaagtgacaccaacactgagatgaatcagatagtggaactgtctgacagactttaaaacagccattataaaaatgtttcagaaagcaattacaaattctcttgaaacaaatgaaggaatagaaaaatctcagtgaggaaatagaaattgtgaaagaagaaccaagtggaaattatagaattaaaaaatataacaatagaaattttaaaaaaatcactggattctactcaatagtagaattgatatgacagaggatagaatcagtgaaattgaggaaagaacaatataaatcccccagtctgaataacagagagaaaatagactgaaaagctctaccttgaatgataactttgatcacaaactagtagtattaaccacgtggaagaggagttgctaaatcaacttaagagaacaaatagttttaggtgagtgacaaataattggaaaattaaaaagttaaatgatgtcatgtataataacatcaacatacagagaaataaatctaataaaatgtaattaaaaactataaaatcattgtgaagaggcattaaaagaatccaaaatatatattcatggaataaaagacaatatttttatagtcagttctgtccaaattgacctatagagtcagtacaattttacaacaaattttagtggaattttgtttattttatttgaggaataaagtttatattttatttggaaatttaaaggactgaaacaatcttgagcaagaacatttgttaagacttattctgaagctttagcaaataagacagtgtgagatacacacaagcatagacaaatagaccaatggaacagaaaagagagtactagaaaacagaccacgcatattcagtcagttgatttatgacaaaagcaatactgccatgcaattggaataggacagataatgtttgcataaatgttgcagggtcagttggatcttcatacttaaaaaaaatgaatcttgactctacctcacaccacacacacaaatcaatcagatagaatgtagatctaaaagtgaaaggcaaaataataaaacttctaaaagataacataagagaataatttatgaccttggagtaaaatcttttcaaatgtaatacaaaatatactaagcacaaaggaaaagactgattgatgaattggacttcattaaaactaagaacttctgcccgggtgcgatggctcacacctgtattccaagcgcttggggaggccaggaagggaagatccctacaaaatatttaaaaaattagccaggtgtggtggcatacccttgtggtcccagctactcaagaggctgaggtgcaagaattgcttgagtccaggagtttgaggctgcaatgagccctgtttgcacaactgcactccaaaaataataaaaataaaatacataaaattttaaaacctaagaacttctgtttatcaaaagacaccattaagagagtgaagaagcaagcccttgagtaagagaagatatttgcaaatcataaacccaatacagggtttgtatctagaatatttaaagaatttccatgagtcattaataacccaatagaaaacatgggcaaaagatttgaacaagcacttcacaaaagaggctttgtaattttctaataaatgctagcaaggaagtgcaaattcaagtcataaggagataacctctacagagccaccagggttgtccaaaatgacagactaataatactaagtgccagagagaatatacagcaactacagctgccatcctctggctggtgtgagtgtaaattagtataaccacattggaaaactggcaggatctactacagctgagcatttgtgtatcttatgacccagaaattctacaaaaatgttcatgactctctagttatagtaaccaaagactggaaacaatccaaatttccatcaacagtggaatggataagatgtactgagcaatgaaattaaaggacctaatgcaacagacagtaacatggatgaatgtaataaacatcatgttcagtgaaagaagccagaaaaccaagagggtaccctgatgactccatttacatgaagttcaagaacagacaaagctaatcaatggggtcaggagtcaaaggtgatagttattttgggtatgtgactggtaggggtacaagtgagacttctgtggtgttggcaatgtcctacttcttgacctagtcagtgatttctctggtttgcctcctttgtgaaaattcatcagtgtgttctggttattatttgtgtgcttttctctatgtatcttctacttcagtaaagagtttactgaaaagaacatacttgggtttgcagagttgaaaacacccgcaacatcttcattgcctcacaaagactattttacatgatgtttaaaaactttagaagctaaaatgctgttctttcattctgagctgattacagattacagattagtaagaaagtaagtgggctacttgtttaaagatggtctatgttaagtaccctgatatcttcttttgaaagagaggtcagtcttcctttcagcagagcattctgttcacctgcctgcccacctacctcatggaccttacagagcttggttaccctgactctaggcctctcagctcttgtactgatcctcccagctgctctattctgatgccatgaccctgtctggagactagagaggctaggccacattcagctcttccttgtcactgtacaactcacctggtgacttggtttttttttttttttttttttaattccatgccgatgtaccctgacatggagaactaaagacagaattatttagggatttcctctctctcattctgaaaacgtataaatagcctttgctgagttactttgttaaaataaccctgacatttttttaaatgagcaaaggggctctaacatggaaggtagatatactgaaggaaagagcccttaaagacaaagggctagtttatttcattatgagatgtccagggctttccagtcccttaattctatcaatgaaccgagtgagaggtaacaatgagctgtacattttttacaaaacctctctgcgtagtcccagtagtaggttgctgaaattatgttaaagtcaggtggggacttctagaaaacccactgtaaccctcttgtttggatgacattgaggccagggaggggaaaagaacttgcaagttgagcagtaataacacagatcccacaggacagctggcagtgaccccacaacagggatttgaaaacaaagtaaggtcttgttgtacccttggttcctcttctttacttcctactatcaaagtcaggttctagaaacttccctaggaggcggcaagaggcagtctctgcctcctcccagtagcaaattggccacaggaagtcctcatttgggatggactggaggagagaggcagctgtgtggaaagggcaaaccttgaaaacacccaagtccttgattgggcttgcagaaggatgtggcaaagagtaaagatcttgagttctggaggcacaactcataggttcgaatcttttttttttcttttttttttttaaatggagtctggctttgtcgcccaggctggagtgcagtggcacgaccttggctcactacaagctccgcctcccaggttcatgccattctcctgcctcaacctcccaagtagctgggactacagcgccactacgcccggctaattttttgtattttttagtagagacgggatttcactgtgttagccaggatggtctcaatctcctgacctcgtgatctgcccgcctcggcctcccagagtgcagggattacaggcataagccaccgcacacagcccgtaggttcaaatcttacctgcacctcttaacctctcagggcctcagtgtcctctacttgtgaagtagggataacagtcatattcacttcctggttttgctgtgcaaaatgaatagcatgtgatgctgaggcactgtaagtcgtgagggcagatgatcacccgctttaggagccattcttccaaaatcttaagtgagtgaaaaagaagcagagatagctttttgtatttgcgcatggaggcagagttcatctgttgcctgagctaacagtatactattcagcccctagtgaaactctggccccagggcaggaccaactaactaggtagggcagtgatgaaaaagggagagtcttctcagtggagtctggtctgggtagagatgtcaaaggcaaaccatcacctccttgacttgttggctctaggtgatgatgctaacctgacctggagggatagcccttctatggggtgggcaggggcagccagaggtgttctgaaaaccagagaagtctcctcactggaaaacatttattcctgggatctgtcagttgatggcagaaatgttcattgttaaagagccgtttctttggcttattaattggtcctctgttagccagtcaacaatactgtacccagcacagatatccttgagaaatgaaggagaaataaagtctttcctagataagcaaaaactgatggaatttatcatcactagactgaccctacaataaatgcttaagagagtcctacatctggaagcaaaagggctatattcaccatcatgaaaaccctaaagtataaaactcattggtaaagcagacacacaaataagaaagagaatggaaccacatgttatcattacagaaaaccaccaaactgcaaagataaacaaaggaaagaaagaaagaaagaaaggaaggaagaaaggaaggaagaaaaaggattatttaaaattatcagaaaacaattgaaatgacaggaataagacctcacctatcaataacaacttttttaaatggcttaaatttcccagttaaaagatatagactggctgaatggattttaaaagtgacctaactctatgctacctacaagaaactaatttcacctgtggagacacacatagacagaaactgaagggatgaaaaaagatattgcatgcaaaaaaaaaaaaaaaaccaaaagtgtgcaggagtagcaatacttacagcagacaaaatagattttaagtcataaaacatagagaaaaagaggtaattatataatgataaagggatcatttgagtaagaggataaaacaattataaatatacatatactcaacactggagcacccagatataaaaagaaaatataattagagctaaagagagatagatgcttatacaatcatagtttgggactttaaaactcaattttcagctttggagagatcatctagacagaaaatcaacaaggaaacattagacttatactgcactagagactaaatgaagctaatagacatttacagaacatttcatccagtagctgcagaatcacatgcttccctcttcagtacatgaaacattctctaagatagaccatatgttaggccacaaaacaagcctcaacaaatttttaataattgaaatcatatcaaatatgttctcagaccacaatcgaataaaaccagaaatcgatgacaaaaggaactttgaaaactgtacaaatccatggaaattaaacaacgtgctcctgaatggtcaatgggtgaatgaagaaattaagaaggaggtcaaaaaagttctcaaaacaagtgaaaatagagctgcaacataccaaaaccaccagcattttttttttagcaataatctatttttaaatcaggtgtgtatattttttagacataatgctattacatgcttatgggctacagtatggtataagcataacttttatagtcactaggaaaccaaaaaatttatgtgactcactttattgcaatattcactttattgcagtggtgtggaaccaaactggcaatatctcagaggtatgcctatagttaacaagaatatattgcatatgttcacaaagctggaagagaagattttgaatattctcagcatgaaaaaatgatatatctttaggtgatgtatttcctaattatcctgatttgatcattatatgcatgtactgaaatatcactctgtgcaccataaatatgcgcaattattttgtgtcaactaaaaataaaaggaaaaataaaaggcagagccctctgggaggagaagactaattaggcttagtgattgctaattctgggagctgcatgcaagcaggttttaaagaaggcagaaaacttaaggatgtggatgtaaaaggaagttacaatgacaacacaatttacagaaatcacttagtcacctggaggactccaatttcaaatgtgccatgcttggatatttgcttacattttgcacaatgacttttctgccatctcctgtgaacctctgagcaatcctgtaaagcagggatcatgcccattttccagatgaggaaacagagtgcccatgccctgcccatggttccagaatgcagaacagtcatccttgggagatgggggtgtctggtccgagtacctccagtctcacctctgctttgtgtcgcaggtggggaggggtcactgaagacaaaggctccttgtggctataggaagggtctgcccaccaggagaggtgggaggggaggagtcttattcaggctgccaaggttaagcctggttaaccacttagacccagagttaactagcaaggggcacaggtacctgcctcagagcatttgtctctgcctggagtgtttgactagaggtcctgagagcctggaccctccgacgctcaggtctcagctgccacattcccaaaggtcatgatcatcctagaccactcaggtgctctttgttcttcaccctgcttaatttttgttaggagtgcttctgatggcttctggtccatagcctgcctctgtctctgccctgccaactccgtgctctgtctcaacgttgcacctgaaactgtgcctgccatggggtgggtattcagtagccaactgatgaatgaatcaatgaataaatgagcagataaatgaatgggcaggaaagctcctcctgtcactctctacactaacatgtaggaagtgttggagggacacacgttagtggatgtcggtcacttagtcctgataaaacagagtagatggttttcttagtaggagatcttgagggctcttctgtgaagcctcttgtggaaccagtgaagtacctgaaaggcaaggattgggcaaatcaattccttctggttgtggaggagaagcccttctagggttgatgttaatgctgcattttaatgaaagtgacttttcaggcttataattggatgacatcagctctatttctgcttttgcttctagaatttagtgtgattctattttaagagactaagaagaaaaagcaatttttagactctcataagaatactagcaacaatggcaatagctaatgtctctgcagcacttagaaaagactgtgccccctgccaagagcttgacctgggctatctcgttgaatccttgcaacacacagccccttgtatagatgagaaaactaaggcctgagccagctggccactcatccgtcacagcctcctttcctttccagtgttggggacagctcacagtgggctgtaggatgccactgggcatcagcctggcaaggtagcaggtcatctcatttttcttttttctggagggtgaggttatcctgcaaaatggaggtcatggggcctcctgccctggaatttctgcctcatccctgacatcttggatgttatcccaggctgctctggtccagttctggcttcattttctcaacatatcagatgcaagagaggcctggcctgctagctcctgtctccctgctctgctgcattccctccccacgcggtgcaggtactgactcgttctcaaaactgtcagatgggctgccacctacctgggagtttcatgacatgtcctgggatcctactacgccagaggctcaatgcctggcagagtgaacacttagtaagctgcagttgccctgaaatattttcctgttgctgattcatttcctcatctgtggataccatattccaaacttgctgtgccaccctctgaaggggcaagttctttcctaggagtagataccaagagagaggaagcccatgtcatggggacaaccacacaggccaaacacaggtgtcactgcctgcagggacagcctgcaggcatcaggcctcccaggagatagcaggcaggacaggaccatttcagactcatttcagcagtgtgtggacagaaccccactgagaaatgcaagcatgagacctggagtctattcctgtcttgtcctggggttccttccactggatgctcatcaggggaaatcctccctctggatgctgatgtggggaaaatggccaactagttttaaccttaaactcatccaaaacttattttctctccacttgagatagttgtcaggagatctgagttctcaccttccttctgctcttcccttgtatgtgaccttaggcaagttgcttaatccctctgagactcagtttcctctcttgtagctgcaggatgatggctgggctctattctagatcagtgagactcaaacctgccctgtggcatcagtcaggaacagttttgccgagtaggctccagtccagaccaatacatcacgatctgtgggagtgaggcccaggcgattcccaagcactggaagggttggaaattcaggcatatggtttctgccttaaattccatctatgaaagccgaagcgctctctttaccaccaccacctctccttcccacccttgtcttgtttgctgctgatttctcgcctgactcaagaacaaatgtgtttaagccccaagcccctaaaaatgggaagctgtctatttcccttctgtaccagctcccacatgtgtctggacacagactctgccagggaagtcccctcccatagggaccgtgtgcctccagagttgtgtggacaggacttgaagacatccaaagcccccacaagagatgatgacaacaaaactctgtgttaaagagtttccaagatggagaactcctgcctgtcaattatccttctcagacactgattttgtttgtttgttttctggctagagacgattattccacacaggaatgacagacagtccctctgttctttgtctgctggtcctgggggcctcttgcgtcagtgggaatggaaagtatcaactttcttatttctccatgttccctcttgccttgcatctttcttcctgctttcatttctaatttcttgggccctttgactttctcttcatctccctcttcattcttcacacaataatgtttatttaattttggatgttctcttctggccaaaagttgacttggtccagaccaaatggaaatatatgtgattaaatctgttctctgcggagagggactaaaacaaagatcaatgccagatattgtcgtgatgatgaaatgtcagggcagagggcaccaggaaggacagaccaggctcacagaagcgtgccattctttcacagcacatgcagcacacaatatgcagaggcatgacattccaaccttctccaacccaccgtttatcagtgtgtcccctggactggtagtatcagcatcacctgagacttattagaaacacaaattctcaggctccatcccagaccaactgaatcagaaacactgggggtggggtccagaaatctgttttcacaagccccagaagactctgatgcatgtggaagtttgagcaccactgcttctagtgcgtagacgttttgcttgctatcattgaaaactcgcttgacctctttggagaggggcatggcggcccccagatatctgaggaaggctgagcaggaggataaggtgagctgaggaaaagggagggagcaatggggtattcacggcaggggagcctgagatggtcccttaaggatttgcattggttaatgggcagactggtgcaaaagaggctgaattgaataattaggaaactgggagaattcaattcaaagaagaattcttgttcgcaaggtcaatttttatactatttaagtaaaataactctggtaggttctatagcaaatgctaagtaaagtaaccgctggtttctaaattattacgataatctgagaaaattatttctttgaaaaaattatagaactttcaaatatgcaaaaaactctagagagtaatataacaaatgcacttaatagggacaacctttaacattcagcagagaacattttactctattggcttcagatcttgttttgactgcagcttgattcccacagtcctctctcatccccacccatcgtgggtcctcagcctcatctcaccaccctgagttgggtatagaatttcctgtccaggtgtttagaattctatacatttatctaaaagcaatatagggtatcgtgtgttgggttttatatgctgatgtaaaaggagttgttctgcaatttgctttcttctctccatgttattgagctctatcctgttgctacctgtggacgtaactcgttctcattgctgggtggtatctatcttatggtccctttctcatcatcatgagcatttaagtgaagatcgtcttcaggatttccatgtgctcatgtgggagagtaagtcctgaaagtggaacatcacctgtaaatatattaaagacagggttttccaatttaactgggaaagtctccagactcagctggagctacattatctgtttctctaagaaagaacttttctgtccataaactcattgtattagtccattcttgcaccgctataaagaaatacctgagactgggtcatttacaaagaaaagaggtttacttggctcacggttctgcaggctgtacagcgagcgtagtggattctgcttctggggaggcctcagaaagcttccaatcatggcagaaagcaagggggaacaggtgtcttacatagcaggagcaggagcaagagagagtgagaggggagatgcttcacacttttaaagaccagatcttgagagaactcagtaccacgataacaacaccaagagggtagtgctaaactattcatgagaaatccacccccatgatccaaccacctcccaccaggccccacctccaacactagggactacggtttgacaagagatttggtggggacgcaaatccaaaccctatcactcatttttttctcccttcaatcattcaaccaacaattgctgagcaactcctgtaggtcaggcactgtgctgggggctgggaaccagtgggaataaatcctatgggtctctgcccttgtggagattccagagtagggctgcccggatgttcttgcattgtgcacagtgcagagacaggaggctcccggatattctggcctaggcaactctaaccctgaaaaatgaacaagcccatcacattctattcatgtggttatagtttacctgaaacctcaactgctccacagaatcagatctctccgcagctcccaaaagtgtcccaagggttagcactgaccagcttgctgggtttgaaggaaccacaatgcatcgggtgtggctctcttcctgctagctgctccgaagtgagctcctactgattctattcagttggacgctcacattcagcgagtccagggggtttttcatgctttgagcatttttaagagtctgctatttgcccagttcagtgaggggcactcaggatgtatcagtggttcaggctgacttggttcctgcctaggggaagacccacaagaccagtacccaatgcagggatggcatggatggtaggggaggcttggaggccctaacccactcttgaagggatgacagaagcctcccaggctgggattggaaggatgaaaggagcagacaggccagggtagagggcattgagtcccagtttgagcgaagggctggagcaagagagagcctggtctctgcaaagatctgaaagaacctcagagcaggggccaaagggtaagggtgtcagggcagaggctgtgccaaaagaggtgagcctcatcctaaactctgttcttgatttggggtggaagtgtccctggaaaggcagatcaacaaaggaaggagcatgagccaattctcaccacacctcttgtgcttcaagtcctctcttgggttgggtgatgtcatacagggacccacacttgattggactgccctccccaccttttaaacctctcctgtcactgagggggtacaccactggagcctggcaaaggtagccagtactcagggggtgtgcacaaacctcacacccatgtttataaggccattacaaatgctggcccagttggtgaccagacaccaatccttgtccttccacgtagccaacagtgggctagttggcaggtgcatggcaggcgctcagggctatagacaatgcaggctttaatcccatgagtggagtcggtgccaagtctagaattcaaggatgactcttcacccaactgaccctcttacccaacaaaccaatgagaacagcttgaggtctggaggacccgtgcttgatatctgtccactcttgtatttgagtaaggtagtggaggtcacaggctcacatcataaactttgtactttatttgaaacacttttctggctctgttagtggctccaacaccatacttaagcttacttcaaaatgacttatacatctctattttccttaaagtatgcgcacagataagaaaagatggggtgaattttttttttttttgagaaggggtcttgctctgtcacccaggctagagtgcagtggtgcgatctcagttcactgcaacttccgcctcccgggttcaagcaattctcccacctcagcctccgaagtagccaggattacaggggcgtgccaccacacctggctattttttgcatttttagtagagatggggtttcactgtgttggccaggctggtcctgaactcctgacctcaggtgatccacctgcctcagcctcccaaagtgctgggattacaggcgtgagccacggcgcccggccaagatggggtaattttgatgtccagacacaagttgtcatttaagatgaagcttcgattgtaactctatgaagccctgctgaatattaaaagcttatagaaagcagcttttctcccccaggcaaaaagagcccttcgatctgtggtgggactttgcaaaaagctgagctgccactcaaagaaataattccccgctaactgcaagtttctgtcttgtttatggagggcctgttgagaaggccctccaaacctttggttccagggtctggcaaggggaatctgtcatcattcattgcaaactacacctccacccactgggctgaagacctgtgcaaggatagaccaagaacttcctctggggtggctgtgctcatggatgctgatttgacaatttccaacctccctcattaccaagatccccttccttcacctgtgaaaccaaaattccatcttcttctcttccctcctttgtgacagagtggggaaagatggggactgagggaaaggagagtagaaactcagtcccttgagagatgggagctgatgggaaggaggtagaaacttggtcctttagccaggaggctctgcaggcattcaggcctgatctaccatgtaaggtgatttctttctttttggaaagctcccatttcatggggtggacaggtccaaggactgctctggaccacttggtgatcacatgggccgaagtaggggtagaggaccccaaattgaatgtgtggaggggactctgaagcaggtgtgaatgccaggagaggtgggaggaaggacaagggtggtgcatcaagaccacagaagccggcccggccagccttcccacaaagttacttgaactgagctctccataagtacacatgcgcacacacccaagaataaactggacaaatggcagcagaaagagaaagaacagaaaagagagctgatgaatacatccataatcagcactaacacagccctggaaagaaaagcaaaaagaaaaggcaagcgctgtggtgtgcagctcttattgtctaataaaagaaaatataccaattctttggggaatttaattttttctggaaataaattcttggaagaatttatgtgacagaacaccccaggggaacatccttgcgttgggaaggaggccacctcgtctggcggcctcgggcattccagtgatgcaggggaggggcccaggcagctgtgctggtccaaggggctccaggtagaatgagctgtatccttggccagaggatgttgcgcatcctctggggggatatgacgggagaatgatggggggagttggggagatgtccccaggtattacaagtggaggctggggactaccactgtcagttcattgtcaactatgtccgcctcatagacagggcacaagcctatccttagggacacacgtgaagaggggaggcaggaagattcaggcgcgctctccggcctagactggctgaaggagggagattttaatgcttggcataggtggtgaggggtccaccaaaggtaggaacacatccctggggctctgggaggaagaagcgtcaggactgcagctccagcctcttcaggcccagggtcctagggcggaacaaggctggaaaactggtgcatggaggaaagaaaaaaaatgggaagggagaatggacaggtaggaaggaaggaaaggaggaaagggaaacggaggaagaaagacatggaaagctgggaggacagagggcaaggcagaaggtaaaggaggcaaggccaaggctgtgaggaggaattccgcttttattctgctgtctggcttcatgccattgcatggggccctgtaaaataaaaaatgatacctcccagggctattggtttttatcttagaggactctgtggggagatgtggaaagctgttcaagtggcaagccttgggagctgagtttcatgacgatggccgtctagggctgttcaaagttaagatgacagattggcagagtgcagggaggtgagagagtattggggaagttttccatacaggggaccatgtagtgttttgctgggaagatagacctgggtggaggtgagactggtgggtgccacagatgattctaactcctgctccttctcttgtccttccaacaaaccaaccacacatgtaacatagtcataagagcttgcagggaggagaaaagagagatatcaacagaccaagggagacagagggtggagggccatgctgtggacagtgaggggaggaggtccttcctctccgccactgccctcaaggctgcttgaggctcccacgctgaggtgtccacctggctgagaggctgctgcttatctgttccccaacttctccacctgctggtgcagctctcccttgctgtgctaggagagaacccactgggagggtcttggcatctccaagtggggccctcctgctgagacactgggtggctgtggagggagctcagccctcattcctccccgagctcatatctacagagcagcaagtctccccactccaccagaggagagcacaggagagctaggcagctgcctccaccaagacttcacccaaccacggtccttcactcccaccaggacaggacaacccagcctcccgggtcccaggaggacttggcatggctgaggacacccaagaggaaccaccagcctatccctgaaaaagcaaagacactttggggaacagaagaacgtcttaaaagatatcaactttgactcagagatttcaagaagacgctctatccgaaaaccaaagaagaagtgtcaaagctgttgtaaatgtttaaaagaatagccaccttgattgcattttgagtgaattgtgaattccctctccctgggtcttcctcattcttctacatcctccccatttctgtactgaatttatagcagactgaatttggaagttgatttgaatgtttaaatatatgagacactctttgttactttggaatgagtaaggcattaattcttttacgttttgatttttaaaggttttatagaaaattgcatgtttcatcaggaaaaaagttatctagttctactcaaaataacatcttatggaaactttcagagtttcaccagacaaaatgccccaggctttggctttgcagctggtgtctacagctgagcctagtccttgaagtaatcatgactcagcttattcaaaataaactcttcaagaattgcaaactctcctctcagcgcatgccctgtgacctccatgtccctccattacatctcctcagagtaaggcccaatgccactgactcatgggggaaccacaggcagcaaatggccagagctcacacagagggatgagtgcacttcacctgcagtgtgactcagcaggccaacagatgctatcagggaagagcactaaaaaccaaagggtggctggctgcgtctcagcatctgtccgcgagaaacacgatgccatggttattttgtgattttggtggtaggctgctggtcaggtgtctccaagcaagttggtcaaaatgggaacagttgtttctctgggcgggcaggggtcaaggctggtctggaaaaggccgaggcagctgcaccctcttgagccactggccagcacctgtgccctgtctggggctttcctctgcccacaggagacccttctccatgcaggtgctgcgtggcaccaggcatgagtctgaagttccttctgccacaagcaccctcgttatttgtgattgtgcaaaaaaggaagtctctgccaagaaactaactgaatgttagtgcctgttctcaggactttccataaccctgctctactaggattcctttcaccctctttgaaagcagccaaagggttaagtcatcccaggtgcatctcaaagcagggctgcgagcagcaggagtttgagctttgttgcaattagaagttgagtgtgagaaaggacattcaggcacagcttatctttgaatacacatgcaggagtatcaggagcagttagagataaacagctggctaataaacacatgaaaagatgctcagcatcattggtcattagggacaggcaaatcaaaaccacaatgagactctacttgactcccattaggatggcgacaacacaaacaaacaaacaaaaaagaaggtaatcagtgtggatgaggatgtggaaaagttggaaacttcagacattgccgttgagaatggaaaatgatacagctgttttggaaaacagtttaatgtttccttaaaaagttgaatagagaattagcatatgacccagcaattccatttttatgtttgtaccccaaagaattgaaagcaaggactccaatagagactagtataccaatatttattgcagcattattcacaatagcttaaaaaaagtgtaaacaacccaagtttctgttggcagataaacaaaatgtggtatgtacacacaatggaatactattcagccataaaaaggaatcaagttcttatatatgctacaacgtggatgaaccttgaaaacatgctaagtgaaataagccaggtacaaaaggacgaatattgtataaaaacacgtatataaggtacctagattagtcaaactgattgagacagaaactagaatcgaggttgccaggggctggggagaggggagaatggggagttattggttaacaggtacggagtttcagtttgaggtgatgaaaaatgttttggaaacagtggtgctggttgtacaacattgtgaatgtacttaatgccactgcattgtatacttaaaataactgggttaggggcatttatggattttcctctcattgtaggtcactaagaacatggtgggaggaggagccactgcctttataggccccgactgccccagagcttcattcctcaccaggatgaatgacaggattctggactagagggctcttgcctgagccaccagggcatccgggggatccctgtgagcagggtgagggtgagcacccaggttccacagggctctgtcctgggcaggccagcagatgcagtgattgcaaatcctccttgtacaaatggaacaggcacgtgcatttgtggcacactcagagctgctggccactagtgtgctttggagaatcagttgtctcccaggcagggaaggtccctcagacataaaatactcacccatttagaggaatgacaacagcaaacgaaactatattctgctaatttactggtaagagaggaaaaactctgtcatgcatacacagacagaggctctgccaaaagagagaggcagcagatacagatattagcaaatgactcctctccagaagaaacacaccagccaggaacggcactcacacctgtaatcccagcactttcggaggccaggcggtaggatggcttcagaccaggagtttgagactagcctgggcaacatggcagactccgtctctacaaaaaatgaaaaaaacaaacaaacaaacaaaagatcagtgtggtgacacacacctgtagtcccagatattccagaggctaggcaggaggatctcttgagcccaggagatggaggctgcagtgagctatgatcctaccactacactccagccggggcaacaaagcaagaccccatctcttttttaaaaaaagaaagagaaaacgaaaagaaaaaaaacacacacgatttcacctgcttgaaggcctgtgcttctctttgttgtccccatgacactatacccaggccactgtcagggaccctggggggcttacagtggcttactgaaggctagacagtatccccttgcagtatcagttaggattctatcatcatgagaaagaggctccagctcgctcaacggagcaaactggaaggtaatgaggggctcagggaatttgtcctgggaaggcaggaagcacaaccctgtcttatggcagaggccatcagtccagggtcccagctggacctgctgatcctctgtccctgtctcactcattgcagatgccacctcttcggtgagggcctgtgagctagggttaggtcacctaccctaccctgtgtgaccacaggcagggagagacaggatttcacttcctagacttccacggtggaggccaggcacctaagattattctcccacccacaccaaacacagtgggggaaaactcatccccaaaaggaaactggggccaataggcaggggtggatgtggggcagcccaaaaaccaacacacagccaccgaccccatcagccatgatttatatccatgcctttcctggacaaaaaaccaaatcccactgccctgggcatcagcgggcagggcccacacaggcttcatagatgtctcctctccgggaagtggagggtgtgtttgtgcattcggagtagctggtgcctggtagaaaatcagtgcggttttggctttggcagagcagcccaggctccctttgcattcccacaaatcgaggcagctctgctgtgctactatcacagttttggcggctttgaccgcaggtcctcctgaggccgggagactgctggggcgtggtatatcagttgttgggggccgtgcttccccagggcagatgcatgcaggggctctggggcagagtgaccgtggaagttcgatgatgtcaccccttctcatgcagctgatcgttgggtcaggaaacgactctcctggcatgaacctgttcctggtctcagcaacccgcacattgtgctggtgccaggtcaaaggcagggcaggaagccaagggatggggcaggcccagggggcagagaagggcaggtgggtgggatgtcgggggcaggtgagggtagagcatgtgtatttacccaggcaagggtccggccaggctcgcaatcagaagagagagagaagaccctgactccaagccaaacccttcaccgagggaaatgcaccaacactcagagggttcttgtttagtaggtgagcaagcagccaagcattggccttccccagggcaggggcataaggccggtgagcagctgagccaggatttgaacagcagtcacccttggtgaggcagaagcagatgaggatatgaatggggatggctaaggaaaggtgggcttgcttgcactggggagaggccttactggggattcagaattgagggctggggtttgcttccccggagggtaatggtttcagctgcctgagtttttatctcaccccttcttacctcctcctgcaatgactgaccaacttccacttcaaagagatctttgattatgactccatgacatcagtaagctttcaagtcagtgaatttaccttctaatggtgattggaactcaaagccagttcacagcttgacctgcatacatcaagcagctgggtgactgtcagatgtgtcatctcatgtgggaggagaatttgttaaagtagggagagaggacctcaggaagaggcctcttgaaagtctgtgggtgcctgaggctggaggccacacctggcctctggccttcaggacaatcctcaaaaagggattaggattagcccacctggttctcagttggctgattggttaaaaacgtgaacaccaaatattaatttgcttttgtttttatcaagcgattctatttggggtgggatgggggagaacgagaaacattttaaaagttagagtaaaaacccagcgctacattgccaatttcaagatgaagtaataaagaactacctgggagggagaatcatttctaatgaagttaactttgcaaactgagcattatgcatttttcactcttggtggttaatattgggaaagtgtctggtggtccttggggtttagggtgctgtctaaaacctagagctgcctggttgtggccagtttttgtttttaaccacgaattaagcttggatcattcagaacagactgacttactcatcagggatgcaaactccacacgcccaaagcagtctcgagtcttcagtcctgggtctcggcttctttctgtgtttcgcaggcactcacacccccgtgggcttggttctccaaacaagcccttatggaaaccaggccagatgtagggattaaagttcccgaatttcagcaaagttaaataataatagtagacacaaaacaaccaaccaacaccaaaagacataggtgcaaactatgctaatcccagcagtggagaggaacaggcctttgatgatgatggccctgatggatggaggacgatggaatgctctaaacacgaggcctcaggggacagccccggtcctccttgtcagagcctgctctagtttgggatccagcaggaacctcaggagcctccttcactttggtggagaggactgagactcagagcccccaagcgcaccttgggacggtccccacgcttccctagggtgggtctggggcaggcctggggcatttctatactgctgtttgggagagcgccccagacctagtgtcctggctggggcagatgaagccagggcgctctggctggtagaggcaggaggggaggccagccaggccccgcttgaccccgcattgacaggaaggagaacggacactttctttcaaggtgctcaaatgtcccacatcacttctgtgaaaacccaaacacagaagccacccctctcagctgctacaggccagaaatgaaaattactgcaatccccaggagcctgggaagacctctgctgacattccctatgaccactgtgacggtgcccccttcggctgcctcccccctccgtatggagagcgttccagccccaggctcccagcgcctgctcccagtgcctgctccccggcctccatcactccacgccccagggacctaaagtagaaagcttagttttctccttgtttgagtgcagttgggataatttttaatacattcctttttgctcttcatcaacttcaaatgtctcaagatgtcctgagggcaaaagagctgatttagctctcagattaaaagagagtggcctaacgcctcactcattttgaaatactgacattaacggggaaaattactcaagctctcctgttacttcctgtgcttaattaagtggctctgcaggtgactcactcccttatttttcagaatgacatcagacttattttccattttaatagcctggttacttcattgattttttaaaaaatccaatttcactttctagtgcaatttctttatctgattttttttctccacactaggaaatgctaactctcgtagtggtaaaacttcgacttacgaatgcctcaatttttttttgagtctagggccccaaatcagaatttaaagaagaaattagaggtgtaatctttatttgctaattacctaaataatttcacgaagtgttggagttgttaatattattaactattcctgagaaggggcccccggggccaccaaatgaatactttgtcttggaggcaggtctgtgtccctgcaagaagccacatctggctctcggcaccctccacacccacagaaatgcctccacttttgtcactttctccatcaatttgagaaggatgattccaaattcagaagcttgttttgagctcattcaatatgcatcaggtggcggtaacatctggaggtcagtttttcttgcagtttggtaaattctgttgtctaaagagagatgtgagaattgctcatcttcatataccacacttggcactcgtaggtttgtgaagcagcagatgcaaatgtttcacgtggtgcttggcatttatttattgtttatttgtttatattttgtttttggtttgtttgttgggtgtctgggctggccaggtgaacttcattttctgccctcactgagaggttttcctccattcagctctgactctgtttccccataggagccacaccggtgagggcagggagagggtgctggttctgagccaactttgcatggaaggcccagcagaccacgctcattacttacagccagcatcatcggggaactccggcacagacctgtagtcagtgccccacagcgccccagccttctctcccgacaggagtggccaggacagggagcagaaggtgactgctgtgctgcctggagctcttctgtccggaggcttagtgaaactagagaaactcagtggacacactacaagacttcagagatactttttgtaaacccaggaagaatcaaagatatgaaacatgcagtaggcactcactaaatgttaattttcttcctttttaaatatatgcattatgatagttaaattaatgactgcacgactggaagaatacacactctaatgattcttttccctaaaataaatgtgtccactatttgctgtctaccttcttgaacatcctgcttcctctaaataactaaggagattgattctacactaacatccagttgaagcaaagttgcgtcatgataaaatctggcatgggctatcccttcaaaaagttctttctgaaccatcatgaccataaattgcactaggcaggaggtggtgctggagggacaaagaaatgccagccagtccctgcactggagttgccagcaatcacacgggaaggcctctagtctagagagacgggtaggagagagacgggagcacatcagaggagcgcagatgctagtgcacgggttaaatagtctcttacacatctggttaagatcacctcaaattgctgtggggttccatagctctctacagcccaattccaagcttctgctctcactggattagttccacggatacatggtcctctgcattagctgggttctctatcttgggtgacatcaaacctagagatgaactctagcccctcactgatacctcacaactcagtctcagaagacatttttgcatggaacagactttaatgaatggtgggtgagggggtgcctgctattgaatgaataagtatggggggaattagtcacaggacttcatactgagcattagagtccggcgtctttgttcttggaagtcttcagctcccgcccggtccctgaggatcttcccccgactgcttgatcttgcatcattgccctccctccccgagggagcaacacagagcggccctagtccactctcatgatgcctccattaatcccccggtcagggaccttccagccctgcccacagcagtcgatgccttcagtgcatctcagtcttccacccccaaaagccgtggggggtctctgtgcgggatcacccctctcctaatacccctggtcccaggagatggggaggatggagacaaggccggtgtgggaatgaggtggcaggcttctcaggacatgagctgccttgctctgcccccttgggcctcatggaccccattctccctgctggagttgatgttctggcagactgggctgccccttggcccagttcctggaataccaagtaattaggtcatcatcggggcagcggaggccagcctctgatattctgcggcatgttacttgctcttggggcctctgtttattggggctacattgccctttctttgcacagctggctttgtgcttgctactaatttttttttaaactgaagaatccattgtttagagatcacacataaatggtaaattataaagaaaaacaagtggatgaccgacataaaaatcaggaggtttgctagccctggtgagggagggaggaagacaccatgtgagagaaacacaggaccgttttgtaagatgctgcttttttgttttgttgttttgttttgttttgtttagcattgggtgtggatactcaaatgttcatcttatgattattctttaaatcgttcaggtacattttgtacagtcttctgtatgtgtgatgcattttataatatgagtggtatatttcacaatcaaaaacacttttaagaagctcttttgccttggctaactctcgtttgccgtttccccagggccagccagcccggcggagcatggggaggacctgaatctgccccggcactgtcctaccctccacaacatgctcaagtcacatcctgtcctgctttccattgcctctggtcactgtcacttgccaacattctgaacatcccactgccttcaaccctccccacttgttcggcacaatatggaaagtgaaaaaaaaaatgagttgcagagagccttgcttccgggtttggaatccagctccatcttgagtctgtttagagaggtatgagtgctttctgacgtagggcacttatcactttagcacacagggggctgtgtgatggcccagtaagagcctgagctttggagttacagagcctgggccttctcaactccatccctcatgggtggtatagatggttcttccctccctgctttccctgactaggattaacttccccctgagcccaggacacttgttactcttgtgccctaaccttcacgtcatctttccaccatcttccatctgcagctttctcaggtcatccgctccatggaggtccccgttcctaccttggccttgcctttccccctgcatgtaaccttggtgaacttttcacaagagtctgcgcagtcttcttgtaagcagattaatgccgaggaaaagccttggtgaatgcacaccccacctaccacctccaaccttgcacagctggccggggcagtcggtgccaaggatgcctcatggcccttcggactctgaacctgctatgggtcccactggccagacacgtgctttccttttggaagtgcttgtctcaaacatagacgcattgaaccaaaccattgtgtgtgggctattggaaggggtgcacagattcatttgttggttgcagcaaatgcttggtttggcaaatgcttgagggccttgtggctggaatagctccactgcatgtctgcagatctgtcacgaggatcccagctcaggtgggagaggataggggctattggtcagactttctcaggccaccctattcccttcctccatgcaaggcagcgcggtatgaatgctttagatgggcctgggtgcaaatcactgtgtgatcttggggaagttgctcagcctgtctgagcctcagtttcttgaagcatcaaatgaggatgataatctctgtttctcagggtcagcaagggacttaagtgagaaaattgaggtaacccatgggcagagcacagggcactttgtgagcactcagtaggtgcaggctcctttctcctcccctctgcctttctctccccacttactcctgtcaagtaacttcacctctcagaaagcagcaaaaattgtccagtgtctccctcattcccaagacccccactggcccctcacccagtggcctctcagggcactcccccgtcctcagaagtcctatcccagcggagatggaatccacatagctggccctttcctccacacgaccctgccagctcaacccttccccgtatgattacgatttgtttctggttgtttaccatgagaagctcactgaagcaacgaaggcttcctaggtgcctctaaagaagcaaggtaaattttagaaccttggtttaaaaaaatgctgcgctgtgcagagaagcccgtggagagagccccgctggtgaggaagcacggggaccctgctgcagggctggtggagggctccttctgcagacttctgagcttggagcacagatgggcagcacacaggtgaaatgtgatcctctgtggggctgtgttttctgccccaggaagaaagaagagtcaacaacttaattatttcgtcatggttttgtacaaagcttgagaggaggaaaaaggttcccttttttgaataatagacaggagttacagcctgaagggagcctgctcagggcgggcagggctgctgctgtaccattggcatcagagacgtgctgctgtcccgaaggctccgccctcctctgactggctgctggccctggctcctgcactactatggccttttggctcaggtgcatccttcctggaggctggaactcatcccccgcccccggcatcacctccatagccagggggccacccaggaaacgcaagccaacatctggggaggccagccatctccaggcaagttggagaccaagagaattgtgtgaatttagactcttggtagatgctgcctgaccctgggctgcctggagcactgcatccctgttgcctggcacacagtagggttattgtctctgagtagctgggtgaatgtaggtcagagctgggaggcgctgtgggctttcatagtcaaggtcacatggctcattagggacagtgctcgaaacatttcagtagggactcaccattcagtcaacaaattttggttgagcatgtattatgtgcccgccactgcattaggagctaagagtacagtcaggaacaaaagagcattcagtgtactccagacagatgttaaacaaatacatagaagccaaattatgtacagtgctaagaggaatggcatccaggccagggcagggttctcccaggtggtggcatttcaggatgagtgacattgaccacgtggagaagtgagaagagggtctcaggtgagggagcagcttgtgcaaaggccctggggaggcccacactgcaggagctggggaaagggaaatgtggtaagaggtgaggaggagaaggacctgatggtgaggatatcacagtctgatttttattttttaaaggacaccttggttcctgcaaaggtgggaggggaggagaggggcattggtgagtccataggtgatgattgcagggggtggtggcttgtggtgccctgtcactcaccagatcagtgactgtggcaagcaactggcctccccaggctcagcttcctccatgtgacttggggacgcatgcttcacagcactgttgtggggcatatattattgcaaggggctggtgctgggagggagccaacactgccactcttcccatgcataccatcc
